United States Patent 10,888,096 (BIOPESTICIDES FOR POTATO LATE BLIGHT DISEASE) - sequence listing, part 9

SEQ ID NO: 14 - DNA, 4477201 bp, Pantoea sp. OXWO6B1 (residues 2,984,803-4,477,201 of 4,477,201)
cgatctctttaacaaagccgggaatgtcgcgcggattggtgattaacagattctggccgcctaactcaacgaacagcaagccgttaacggttaatgcaaagatgtggtagagcggtaatgccgtgacgacgcactctttaccgtcacgtaacagcttgccgtaggtcgctttggtttgctccaggttggcctgcatattgcggtgggtaagcatagcgcctttggccacgccggtggtgccgcccgtgtattgcaaaaatgccaggtcatcgttgctgacttccggacgctggtacgccattttttcaccggcatccagcacatggcgaaacgatatcgcgcctggcagatgatatttgggcaccagccgcttcacatacttcaccacaaagttcaccagcgtggctttaaccggcgcaagctggtcgcccatgcgggtcagaacaacgtgtttcacggcggtttcactgacgactttttccagcgtatgcgcaaagttagaaacaatgacgattgcactggcaccgctgtcattgagttgatgttttaattcgcgcggcgtgtagagcggattaacgttgaccaccaccatccctgcccgcagaacaccaaacagcgccaccggatattgcaggaggttcggcatcatcaaagcaacacgatcgccgggctgcagtttcagcgcatgttgcaaataggcggcgaaggcccggcttttctcgtccagttggcgataggtcatcttttgacccatgttataaaaagcaggctgctcagcgtagcggacaacggcctgctcaaacatatcaaccagagagtggtaacgatcagcattgatttcggcaggtacgtctgccgggtagcgttttagccaaaccttattcaaggattcaccccgataatcttgttgtgtactcatcgccgcctcgacaatcgtatttttaacaatattttaactgattgtaccagtttgctctgcttgtcatgttgaggttgcgaagtgcatcactaaatttcgtgttagttaacaatacaaataaaaagcccggctgcgagcaccgcgaccgggcttattaaaaacggctaacgcttatggcgtcaggaaagtttccacctgggcaggcccggtgttatacatgccccagtaaggattgtgcccccagtaaccgccgcgatgacgcgttggcccgtaccaaatccacggatcgatcggctgtggtggcgcaacgatctggcgcgtgagatgccagcgctggtagccccgcacgtcaatgaccacaaactggtaatttgcctcgccaatcttgccctgctcggtgccttttagcgtgccgagcaccgttacgtactgatctttcacatcggtaggatcaacaaagcccggaatatcagcatagattcggccaagcgagctggcacccaacaccggtcttgcgctctcatccagcggctgcgttgcgatttccagccgggttttgccgttgcggttgataacgttaaccactttaccgccgaagcgagattcctgaccaacatagatggccggatctttcattacgcgcagcaagtcctgctggggcatcggcgagttgcccttaatattatccggtacggaagcacaaccacttaaaaccagggcacaggccaacatcaaacctgcaacaccgcgacgacacattgacatgggtattctcctgaacgttgctgtttagagtgcctggataacaataagttgcgtcatattttaccgtccgggcagttttttccatgccacttcgtttctcagataagtgggctcggcatgttcaggttgcacggtagcgccctgctgtaatgcggcgaccgccagtagcaacatatcttcagcggctggcagcgccacattgctgttgaccagttgcagcgcgtgcccctgctgcaggtccggccaggcctgccagcccgttccagcggtgtaccattccccttccagcgcctgcatccgggccagcgcggcggcgggcgacagcacgctctccgtcgcttccccctgccagttgccctgttcatcgcgctgatattcggcccagtagacttcacccatacgggcatcaatcgcggttaacacccggtttgcgccgtgctgccgccaggcaccctgtgccagcgtggccagggtggagatgcccgccatcggcaaggcggcacctaacgccaggccctgggcgatcccgataccaatacggacgccagtaaaactgcccggcccgcggccaaatgccagcgcgtcgagttcggtcagttcaagctgctgagactcaagcagctctgcaatcaggggtaaaatgcgttgcgtgtgatcgcggggcgctatctcaaagcgcgcgtcaatctgttgcccgttgagcaatgccgcagaacaggcttctgtcgctgtatccagcgctaaaattcggaccgacataacgacctctgaagattcaaaaacggcgcgcatcttagcacacaattactcgccaggttgctgacgaataaaggcaatagcttgcgcaatatcacgtgttcgtggcgttggcggcagactgttaagaaacagcgcgccatagggacgggaaaccagccgctggtcgcaaatcaccagcacgccacgatcgtccgtatcacgaatcaaacggccaacgccctgtttaagcgtaatcaccgcgtcgggcagttgcacgtcgctgaagggatcgccaccccgaatccggcagtcttccatgcgtgctttaagcagaggatcttccggcgaggtaaacggcagtttgtcgatgatcaccagcgacaacgcatcgccacggacatccacaccttcccaaaagctgctggtggctaccagtagtgcattgcctttatcaatgaactgcttcagcagttgccctttgctggtttcaccctgcactaacaccggcaacgtcatagaggcacggaactccgcggccaactcacgcatcatcagatgcgaggtacaaagaaagaaacagcggcctttgttcgcgtcgatcagcggcttcatcatttttgccaactgacgcgcaccacccggacgattgggttcaggcagattgcgcggcacgcacagcaaggcctgctgtgaatagtcaaacggactgttgaggatcagattcttagcctggctcacgcccagccggtcggcaaagtggtccatcttttcatcgacggccagggtcgcagacgtgaaaatccatgcggctttacggttatccatgacttcgcggaagcgttcggccaccgataacggcgtcagcgccagcacaaagtgacgcgatgtgcattcataccagtaactgaagccgggttcactaatggcgcgtatccgtttcagtcgtgtgcgatagagcgctgcacgttcaaacgccgcatcaagcagcgccgaacgccctagcgagagcttgatcacgtcgtaacaaagctccagcgcatcatcgagcagggtaaacatgcgcatgatgttgttatcgctgagtagatcacgcaggttaccgcgataacccggctcgcccagcgccagacggaagtcctgcgcgcattgtgccagacggtcggctgatttttgcagctgctgtacgtcacggacttccgtgcgataggcaataatgatgtcttttgccagatcgcctaactggcggctggagagctgctgaccgaaatactggctggcgatgtctggcagttgatgggcttcatcaaaaatcatcacgtccgcttcggggataagctcaccaaatccgccctctttcaccaccagatcggcaagaaacagatgatggttaaccaccacaacatcggcgtccatggccttcttacgcgccttcaccacaaagcactctttgtacagcgggcagtcgctgcccagacagttgtcattggtgctggtcaccagcggccaaatcggactgtcttcggtaacgccggcacaggaactgatgtccccatctgtggtttgcgatgaccaggcgcgcagcgtcactaaatccgtgagcgcctgaacgctcagatcgccgccggtcgccgactgttgttccatgcgctcaaggcaaaggtagttagagcgacctttcagcagcgccgttttaccggtgaacttcagcgcgttggcaatggtaggcaaatcgcgggcgtagagctgatcctgcagggcttttgagccagtggacacgatcacttttatattggcgcgtaaagccggagccaggtaggcataggttttgcctgtccccgtccccgcttcgaccaccagctcgccgctattctgcacggcttccgcgacggcctgcgccatttcacgctgggcttcacgcggtttaaatcccgcaatgccttttgccagcgcgccatcagttgcaaaatcgtctgccacgtaccctctcaataacggcaaaaaacactgtatattatgccagcattccctgacttaaggaaatcgctgacggtggcgtctttatcaccctgccgtcctgttgcctgcagacccagggatgacgccgttttcagcgctaatgactgatgtaaagcgcgccggcaatcagtagcaccagtaacaccgccagggtgataaacccctgtttggccgtgcgtgacatgccgacaaaggtcgatatgacgataaacagcagtgtcagtgctccaaacatcacccaaaacagatattgcgtattcgccatgccttcatcctgatagtcctgaaccggtaagcgacgttttataccacttttccgcccgtgatgcgcggctgacgcccagcgcgcgctgcaacggatgacaatcgcaccgggattatggcaggctaggcgttcaaaaaaacagggagaagatgatgagcattacgcgcattgatccagaacatcgtatgtccgaagcggtcattcataacgacacgatttattataccagcgtgcctgaaaacctggaggcggatgccgaagcgcaaaccgccaatgcgttggcggtgattgatgccctgcttacgcgggtgggcagtgacaaaagcaaaatccttgatgccactattttcctggtggataaagctgattttgccgcaatgaaccgcgcctgggacgcctgggtttcacccgataacgcgcccgttcgctgcacggttcaggcaggtttaatgaatccacagtataaagtcgaaataaaaattatcgctgcacgctaaaccgcttgccgggcgtcagccttcgtcgtcttcatcttcgaagcgcgcccggatcagttcaccagtgtggctttcgcgaatctcctgcgcaaccagggtaatcgcttcaccgctggacatgccaccagccattaattgctgaatacgttcaacagcgcgctgctgctggtcgtgtgaaagtgcgggtaatcctgtaatcatgttttactcctgctatgaggctgccattatttcatggggaacaaacaggtgccagtcaggaaaaaatatgtcagtctaacggccttactgatgtcagatttcgtgctcaatgatcgttcaaactcataacctaagttattcgcctgacgccatcacccactatttttcccgtattgcgcatctgccgtgggcgatgctgttgtcttcaggacaagctgaccacagcgataatcgttttgatatcctgaccgccgatccgctgacgacgctgacgacccggggcaggataacagaaattcagcagggcgatcgctcccaacgtagccaggacgatcccctgtccctggtacaacagcagtgcgacgcgttgggcattgccccgcaacgccatccggacttgccgtttttaggcggcgcgctgggtctgtttggctatgatctgggccggcgttttgagcagttgccgcagaccgccctcgccgatcttcacacaccggatatggccatcggcatttatagctgggcgctgattgccgaccatcaccgtcatacattaacgctggttgccattgatgatgttgcgcgacgtcttcgctggcttgaaggctggcccgaacgtgaaaccgcgcctttctctctgaccagcaaatggcagtccaaccttagccgggatgaatacgcgcaacgcttccacaaagtgcaggcttatattcaggcgggcgactgctatcaggttaatctggcacagcgctttaaagcaggctatcagggcgatgaatggcgtgctttttgcctactgaaccagaccaaccgcgcgccgttcagcgccttcttacgtctgccggaaagtgccatcctcagcctgtcccccgagcgctttatggcgctggatcaacacgtcattacgacccggccgattaaaggcacccgcccgcgtaaccgcgatcctgttgctgacgcggctcaggccgaaagcctgcgtacctcgaccaaagaccgcgccgagaacctgatgattgtcgatctgctgcgtaatgatattggtcgggtcgccgttgcgggttccgtcagcgtcccggaactgtttgtggtggagcccttccctgcggttcatcatctggtcagcactattcgcgccacgctgcctgatcacctacaggcctgcgatctgttgcgcgcctgctttcccggcggctcgatcaccggcgcgcctaaaattcgtgccatggagattattgatgagctggagccgcaacgccgcaacgcctggtgtggcagcatcggttacctgagtttatgtggccgtatggataccagtatcactatccgcacgctggtggctgaaaatcatcacctttactgctctgccggcggcgggttagtggcggacagcgaagtcgaatctgaatatcaggaaaccctggataaagtcagtcgtattttacctgcgctggaaaaaggggcctgaatggcattgacgctcgcggatttccgcacccgttttttactgcaacagcccctggagcctgcacaagcactctcaggtcgtcatgctgcggtgttaattcccatagtggcacgccagcagccgggtttgctgctcacccagcgttcgcacggattacggaagcacgccggacaggtggcctttcccggcggcatgcaggaccctgaagatgcctctctggttgccaccgcattacgcgaagcgcacgaagaagtgggtatttcgcctctgcaggtcgatgtcctgggctgtctgccggctgtcaccagcagcacggggtttcaggtcacgccggtggtgggcatcattccagaccagattgcgctgcgcatcaatccggatgaagtgttaagtgtgtttgaaatgccgctcacggaagctttacgtctgagccgttacgccgagcttgattactatcgcgccgggattcgtcatcctgtctggttgtcgcgctatcaggattacctggtctggggaatgacagcagggattattcgttcgctgagtcagcagattgcattttaattgacgcagcctccatttttgcgcctgtttacaggcttccgcgcaatatcacactataattttttctcgtggtgttaattagtttatttcatgcgaaaagcagcgcgtttaccctgcttagccgtttactattagcgccataaactgctgcggcagtctgaacgttttttgtgaggagtgtcacccatgatttcggtttttgacatgtttaaagtgggcattggcccatccagttctcatacggtcggtccgatgaaagcgggtaaacagtttgtggatctgttgtctgaacagggcaaactgcatgaggtgacacgcatcgccgtcgatgtctatggttccctgtcgctgaccggcaaaggtcaccatacggatatcgccattattatgggattagcgggtgagtcgcctgacagcgtcgatatcgatgctatccccgccttcattaaagatgtgcaacagcgggaacgtctgctgatcgcgaaaggtgcccatgaagtcgatttccctcgcgaaggcggcatggtgtttcgcagcgagaatctctcgctgcatgaaaacggcctgcgtctgctggcgttttccggcgatctgctggtgctgtcaaaaacctattactccgttggcggtgggtttattgtcgatgaggagcatttcggtcagtctgcgctggatgaagtgtccgtgccctggccgtttcattctgctaaagaattattatcccactgccgcgagaccgggctttccctgtccggcctggtgatgaaaaacgaactggcgctgcattcgcgtgaagagattaaccagtatttcacgacaatttggcaaaccatgcaggcctgtatcgatcgcggtctcaacaccgaaggcgtcctgcctggcccgttgcgcgttccacgccgcgctgcctcgctgcgtcgtttactgatctcctccgccaagcactctaacgatcccatggtcgttatcgactggatcaacatgtatgcgctggcagtaaacgaagagaatgctgccggtgggcgcgtcgttaccgcacccactaatggtgcctgcggcattgtgccggcggtgctggcttactatgaccacttcattgaaacggttacacccgatatctttattcgctatttccttgcctccggtgccattggtattctttacaaaatgaatgcctctatttccggtgctgaggtcggttgtcagggtgaagttggcgtggcctgttcgatggcggcggcaggtctggcagaactgttaggcgcaagcccggagcaggtttgcgtcgccgcagaaatcggcatggagcacaaccttggcctgacttgcgatcccgtagccggccaggttcaggtgccctgtattgaacgtaatgctatcgcatcagtgaaagccatcaatgccgcacgcatggccctgcgtcgtaccagcgaaccgcgcgtttcactggataaggtgatagaaaccatgtacgagaccggcaaagacatgaatgcgaaatatcgcgagacgtcacggggcggcctggcaataaaagttcagtgtgactaatcatttttgagatttaattctaatttttttctttttaaccagtgcattagtcagtcctgcctgctataaatattaacgatattaaagcgacctgcgggtcgctctgcttttcttgtagcctttcattttacgctcgggtcctaaatttgcgttgggccgtgccgataacaacccagctatatctattttctggttttgggaaggtgattcttgatgttcatggcccagcaatatgttggacaatacagacgtaagcgtttgcttattgctgtggtgattgcttcgattgttctttcgttaacgctggcttttcgctactttgaagaaaaatcatatgttcaacagcgagcaatcagttttgccgataatgcaattacgcgttttgatcgcatgttttcaccgcttgatgtctccgccaacaacatgcagggattggtcggaatgtcctgtccggatgcccgttttcccttaatcgaaaaaatttcttcgctacaaaccgtgcgcgctattttgctggtcgaggaggacaggctttactgttccagtatttttggctcacgagatatctcgttcagccagacctaccctgaacttgcccttaacgagaagcgcatgctgctctccacggatgactatttgctcaaaggttcgcccgtcttgttattgtggacgcccacgatgctggataaccgttccggaatacttcaggccatcaatattgaattaatgagcagctacctgctggagccgcaggcaccctgggttgaacgggcaatttttaacgtgaacggcaaaagccttgaatatggcaatcctctcattgagtccacgctgccttctgaggatgaagttacctataccgaagcctcgctgcgttatccctataccgttaccctttatggcccctcaccttcgcgcctggccctggcctctctgccttcgcagttgcccctggcgctcatgctgagtttgctgattggctatgtggtctggctggcaaccgccaatcgcatgagcctgagctggcagattagctacggcatcacagccaatgaatttatggtttactgccagcccctgatcaatgcccgaaacggtaaatgtgatggcattgaacttctgttgcgctggcataatccgcgtcagggctggattccacccgacgtttttattcccctggttgaacgccagaacctgattgagccgttaacccgctttgtgctgaaccgcgtcgtcgacgccttgccggatcttccccacagtccacactttcatattgccgttaatgtcgcggcgagccattttcgcgaacgtgccattctggaagacctgcaaaatatttggtggcccgccaatcctgtcccccagttggtggtcgagttaaccgagcgtgatgccctgcccgtggtcgatcagacggtcattgctcaactgcacgacatcggcgtgcgtttggcgatagatgatttcggtaccgggcacagttcgctgtcctacctgaaagatttgcagccagacgtgcttaaactggacaaaatctttaccgcctcaatcgggacggatgcgattaacgccaccgtcaccgatatggtgatctcgctggcgcagcgtctgaatatcagcctggtcgcagagggcgtagaaacccaggagcaggcagactatctgcgcgatcgcggcgtggatcatctgcagggttattactttgcccgtccgatgccgctggaggactttccggcgtggttgcgccatcatcaactgacctgtgacctgtagtgccctcaacgccatccacacgtcggcaggtcatgtcttcacgcaaaaaaaaacgcatcaccatgtgatgcgttttacgctaagaagtacgctaagaaggtaggttaacctttttcttcctcatcatgttgttgatctttggtcacgcgcaccagatcgatacggtactccgtggcttcgatgatctggaaatgaagcggctcaatatcgatgacgtcgccaggcttaggcaactgccctttctgcgcaatcagcaaccctgccagagaagcgtgatcttcttccggctttaccagctcgtggaagtcgaggagctgctgcagtgaatgcaggtcggtgccgcctttcactaaccagccatcaccgtccatgatgatatccggcgtttcatcttcatccgggaactcaccggcgatcgcttccagcacatccagcggcgtgattaagccctgcaccacgccaaactcgttagtcacgataacaaagctgcctttggcacggcgcaagacgcccagcaggttaatcgggtcaagcgtttccggcacgatgatgatcggtgtattggcagcaaaggtcgcgacgtcaacgccgtgatccagcgccaccaacagctctttggctctgaccacgccaatgatttcatccagctcaccccggcataccgggaacaggctgtgcggcgtatccagcagctgaatacgaatttcgtcaaccggacggttggcatccacccaggagatatcaccacgcggcgtcataatgctgcgaatcgaacgggatgccagcgtcagcacgccattaatcatatagcgttcttcgtctttaaaggcttcctgtggcatggcaatggcaatcgcctgctcttccgtgctcgcgggagcggactgcacccgattacgtccgcccatcaaccgcaaaatcgcctcggcggtgcgttcacgcataggtcgatgcgactgatgacggataaaattgtggcgggcaatctgattgaacaactcgataagaatcgagaaaccaatcgccgcgtacagataacctttcggaatgtgaaaaccaaagccttcggccaccagcgacaggccgatcatcaacaggaagctgagacacagcaccaccacagtgggatgcgcgttgacgaattttgtcaggggcttagacgccgccagcatcacgatcatcgcaataacaaccgctgtcatcatcaccggcaggttattgaccataccgacggcagtaatcaccgcatccagggagaagaccgcatccaggatgacaatctgcgtcacaaccgcccagaagctggcgtagctgcggttgccgttgttttccaactcacggttctccagccgctcatgcagttccatggtggccttgaataacaggaatatccctcccgccagcaaaatgagatcgcgtccggcgaagctgaaacttcccacgctaaacagtggacgcgtcagagtcaccatccaggagataagcgataacaggcccagacgcatgaccagcgccagcgacaaaccaatcaaacgcgctttatcacgctgcttaggtggcaacttatccgcaagaatggcaataaagaccaggttatcaatgccgagaacgatttccagcacaatgagcgtgagcaatcccgcccagatcgaggggtcgaacagaaattccattagtgactcctgaacaaggatgtgattacgttaaagcgtgccagcgtcagatgacgtgactgaaataagcgcggaaaagcagagaaaacgcggtctggcgtgaattgacgcgctgaagagcgcaaagacaaggttaagcaacgtcggtgacgatccataagggtgggctgcagcccgctactcctgaataataaacagattgctaatgtatcagttcgtaccacgaggtcaaaaaattttcttatttttacactctctcacggccgggttcaggcgtcataaaaactcaatttccctcatttatgctgcaaatagccaaccaatatcacaaactttattttttcggacactaaaataaatccggcattcacgtagtgagttggttatcccaacaatgttgaaattaggttaattcacattaacaagatttagatgttgttaacgcgataattcttaacggttcctcacattatgatgaaccaacaagcgaacggaggtagcacgtgaccattgctcttgtaattggtacacacggctgggcagcggagcagctgcttaaaacggcagagatgcttttaggcgaacagaacaatgtcgcatggatagattttgtaccgggggagaatgctgacaccctgatagaaaaatatcaggcacgactggcagagctggacacatcacagggggtgcttttcctggtggatacctggggcggcagtccattcaatgcggccagtcggctggtcgttgataaaacgcatcacgaggtggtcgccggggtaaacattcctatgttagtcgaaaccctgatggcccgagacgataacccctcttttgacgaactggtggcgattgcggttgaaaccggccgtgaaggcgtcagagcgttaaaagcacaacctgaagaaaaaccggctgctgttgccgccccgccgtctgcgcctcgcgcagcggcccccgtcaaccggccgctgacgcctgacgaacacatgaatatttgcctggcacgcatcgacgatcgtcttattcatgggcaggtcgctacgcgctggaccaaagaaactaacgtcagccgcattatcgtggtcagtgatgaggtggctaacgacaaagtgcgtaaaacgctgttaacccaggtggcaccgccgggcgtcaccgcacatgtggtggacatcgataaaatggtgcgcgtctggaataaccccaaatatgcccgcgatcgtgtcatgctgctgtttaccaacccaacggatgtcctgcggattgttgaacaaggcgtggatatcaagagcgtcaacattggcggtatggcatttcgccaggggaaaacccaggtgaataatgccgtctcggtcgatgaaaaagatatcgccgccttccgccagcttcacgcgcgcaatatagaacttgaagtgcgcaaagtctcgggcgatcaaaaactaaaaatgatggatctggtggctaaggtgagcgcataacacgccagctatatttttctatcctgtagaggacaagaagtatgatggaaataaccacacttcaaattattttaatctttattgtcgcctgtattgccggtatgggttcgattctggatgagttccagtttcatcgcccgttggtggcctgtacgctgatcgggattgtacttggtgatatgaaaaccggcatcatcatcggcggtacgctggagatgattgcacttggctggatgaatatcggtgctgccgttgcgcctgatgccgcgctggcctccattatctccaccattctggtgattgccggtggacagagcgtgggtgctggtattgcgttggccatcccactggcggcggccggtcaggttctgaccatcatcgtacgtacgctgaccgtggcgttccagcatgcggcggacaaagccgcggaaaaaggcaaccttacggccatctcatggattcacgtttccgccttgctgcttcaggcaatgcgcatcgcgataccggcgctgattgttgccatctcggtgggaacggatgcggttcactctctgctcagctccatccctgaggtcgtcaccaacggtctgaacatcgcaggtggcatgatcgtggtcgtcggttacgccatggtcatcaatatgatgcgtgcaggctatttgatgccgttcttctatctgggtttcgtcactgccgcgtttaccaactttaacctggtggctttaggcgtgattggcgtcgtgatggcggtgctttatatccagctcagcccgaaatataaccgcgtagccggtgggcccgcggcatcgccgtcagctaacgacctcgacaacgaactcgattaaggaacaggtgacaacatggttgatataacaaaagtcgaaaagaaactgacgccgggtgacgttcgcgctgtatttttacgctcaaacctgtttcagggttcctggaactttgaacgtatgcaggcgctggggttctgtttctcaatggtgccagtgatccgccgtctttatcctgaaaacaatgacgaccgcaagcaggccatcaaacgccaccttgagttctttaatacgcatccttacgtggccgcgcctgtgttaggtgtgacgatggcgatggaagagcagcgcgctaatggtgcagcgatagatgacggtgcaataaacggtatcaaagtgggcctgatgggcccgctggccggcgtaggcgatccgattttctggggaaccgttcgtccggtgtttgcggccttaggcgcaggcattgcgatgagcggcagtttgctcggtccgctgctgttttttatcctgtttaacctggcgcgcctgttaacccgttactacggcgtcgcttatggttatcgtaaagggatcgatattgtcagcgacatgggcggtggcttcctgcaaaaactgaccgagggagcatcgattctcggcctgtttgttatgggcgcgctggttaacaagtggacgcacgtcaatattccgctggtggtttcacgcattaccgatcagaccgggaaaaccacggtgacgacggtacagtcgattctggatcagctgatgccgggcattgtcccactcctgctgactttcgcctgtatgtggctgctgcgccgcaaggttaatgcgctgtggattatcgttggcttctttgctatcggtatttttggttactggatcggtttgctcgggctgtaacgttaaccgcatcgggagcctcggctcccgatgcttttaagcggcccgctgcgtgagaaagccggcttttatctgtaaaggaagaacaatgtcattgaccgacggcatcatcgccctctgcatcatcgcccttctgtttttttgctgtttatgatgaagcggttctgccacgtcgtcatggccccacgctgttacgtgtaccgttacaacgccgtcataaagccgacagcctgatcttcataggtttactgctcatcctgttgtggaacaacgtcgcccatcaaggcccgaaacttaccaccgcgctgttgatggtgctgtgttttttatcattttggcttttctggctgcgtcgtcccaaactgctgatgaaaagtcagggattgttttatgcgggcaggtggacagactatcggcgcatacagggcatgaatctttcagaggacggcattttagtcatgcagcttgagcagcgacgtttgctgatcgccgtgcagcagcttgacgatcttgaacgtatttaccaaacgctggtcgaggcgcgttagtcgcgttgccaaagggtaatcataaagtccgcttcacagtgaaattgcgagctttcagcgagggactgccagacttctggccgcgcgcgccaggcaaacggggtcatctgcaacagggtggttgccgcctgtgcggtcaacgccatcggataggtcaaacggtgctgggcccgttgcgtaaatccctggtagactttctcttccgacgcgtgaagctgcacctcgcgataaatcagcgccttgaactgctccagatgatgaggcccgggcgtaaccgttagcagcaggccacccggtttgatgacgcggctcagttccgcctcgttgcagggcgcatagatacgtaccaccgcatccaacatgttgtcactaaacggcaggcgctggcttgaggccacacagaataacacctgcggatagcgcttagccgccagtcgaatcgccattttcgccacatccagaccgtatacctgcccttcaggggcgagattgtcggcgaatgcgcccgtgtagtaaccttccccgcagccgatgtccagaatctgcgcagccggttgctgcaggtgctgatcaagcacgctcaccacccgatcccgcaacggctggtaataaccggcctgaagaaactcacgccgcgcctgcatcatgtcagcactgtcgcccggctcacgcgagcctttatgttgaacgggcagcaaattgacatagccctctttcgcctggtcgaactggtgacgattctcacagcgccagctgcgttcggtaaggctcaggggaaagtgacaaagtgggcaaatcaaagacatcaggcgctccggcagaaatcgacgcgcagaagtgtactcgacgggaaacaatatcgaaagcgtaaaaaaagcctcggccagatggccaaggctttaatatctgagactgtggtgcctggcacccgtctgaggcgaaatcagatagcagtaacgttaactgctgctggacctttctggccgtcctgaatttcgaactctacgttctggccttcagccagtgttttgaaaccgttgccctgaatagcagagaagtgtacgaacacatctttgctaccgtcagctggagtgataaaaccgaagcctttagactcgttgaaccacttaacctgacctttaatctttgccattttactaattccttaaagtgtttattttgcccggaggctaacctacagataaaacagagacattactgaatgaggcactgattaaagttcggcaaggaagcggtattcaacgtcaacgtctttactcgtaacttctttactgaagatgccatacataaacagaactgtacctcgtttaacccacgaattgttatcacatatccgctaaataatggcaagccatttttatatgcctgaccggcgctttttgcataattgcaaagtggctcccagagaatgtacttcctggtacaaaaccctggatagcggacgccagtaatagccctgacatcactataaaataatgctttcctgcccggacaggatgatatctgactcccttacccacctcactcgcgatggataacattaaaaaaataacattgcactaatatggcaatattgcaccaaataaaggagcagataagtgaagcgcgagtaatctattgcggcaagcttgtacaacaaaacttattccgtacacatataaatattattttcagcaaaatcataagttgagcgtgaacgcaatcatttatagcttgcgcgcaggcgttttttgaattaggcctgcgccatgtaggatattaaaatggattccagtcaacacgtagcggcgtctgacgagaatgttatcacgacggattaatcgggttgatatatgtcaggctgcggctctcgccaatctgccatggcgtaaagtgcctgctcgcttcaccgctttgcgttaaaacacgctgcaattccgccggaggcgcatccagcgattcatcggccagttcaaaaaccccccaatggattgggacagtaagaggctggccgattgcccgccacaacgccaccgcctgttgagggtccatatgttgtgcccccataaaccagcgaggttcataggccccgacgggcagcgcggccagattgaacgggccgtgacgttctgcaatggcatgaagattttccgtgtagccactgtcacccgagaaccaaaagcgcactgagtcggttttaatgacccaaccgcaccagagagatcggttgcgatcggtaaaggtgcgcatactccagtggcgggccggtaccgcatcaaactgaatcccacccatcgccttgtgttgccaccagtccagcgcgtgcacctgtttaaccccacgacgtttacaccagtccgccagacccaagggcaccagaaaaacagcctcaggaaaatggcgtacgatctgcttgatggttggcttatccagatgatcgtaatgattatgggagatcagcacgtaatccagacgaggcaactgactgatggtcagcggggacggcgttttccgttctggcccgataaacggcagaggcgaggcccgcggggaaagcgcgggatcgattaatatatagcgttgattcagtcgcaacagcagcgcagcatggcccagccaccagagccggtcatcctcaccgctcaggtcggcaggttgccaccactgcgcaataaagtcgtcataaccccgctgaggcggatggggtaatccctgggctttacgttccttacgccagcgcttcaggtcaccctgctggcgagtatcaggttcggggttgcgaaaacccgccggtgtgtgatgggctttactgctgtcaaaccagggattcttccaggccatccggcctccatgcaggcgttaacgttccggaatgaggcgaataaaatcgccattttccggctgcgcgtcagttttttgctctgacgtaccactttgcttctcgatcaaacgcttcagcagggcgttttgtttcttttgctcttccagcagcgacgccagcaacgcaatctgttcatttgcccgaacgctggcgcggttaacgtagaaccacaggatcaacgccacaatcagcattatccccatcacgccatagctgaccacaggacccgcattagcggctaactcattcataactgcctcaagataccaggtgaaaccaccataaaaggtgcgaccgtctattctaccctgcggcgcagtaaaagataatggcggagtaagggatgggcatcattctgctcatttcagttatctctgatcgcttcccgcgtaaaagcgaggcatgctgctgcggtacatcatgtcaggcagcagtcactggaacgctgcgttaggcatcataaggagatacaatgaaactgtttattcgggcgattgttgttgtggggattatctggctggcgatgctgtttaccggctatggcattctggctggcagtaataagaatgcggcgggactgggacttaagtgtaactaccttaccgcacggggcatgatcacggcacagtatctgcacacggacagcggcgtagtgggcgtgaccgactgcccgctgttgaagaaaagtagtgaagtggttgataactgatcgcactgaagcgggccaactggcccgcttttttttacgaaaacgtgtaatcgtgataacccagctcggcggaaagacgtcgtcccgcgtcttgcagcatcgtgacataagtctgcttattcgactctgagaagcgaatggtgggaaaagagatactcaacccggcgacggccacgccaaagcgatcaaaaatgggcacggcgatacagcgcacgcccgcttcctgctcttcgttatcctcaccataaccccgctgcttcacctgactcagcgcctccagcagcgcacccgcgtcagaaagtgtattggcggtatgaatgctaaacgtcatgcgctgcagaatctcgttgacgtcatcacggctgcgccatgctaataacaccttacccagcgcggtagagtgcagcggattacggcgaccgatacgcgacgacatgcgcaggttatacaacgaatcgatcttgtgaacatagacgatgctctcgtcatccagcgcgcccagatgaatcgtttctttggtcaggcgggacaattcccgcatctgcacatcggcactgcgaatcaaatcgatgttctgcagcgctttcgatcccacctcaaaaagttttagcgtcagcgagtatttctcgctttccccttcctgggccacataacctagtgacttcatggtttgcaggaaacggtaaacggtgcttttcgacatcatcagccgttgagccagttcggtaatcccatgctcgcgcgcgtcacttaatgcctgcaaaatgccaaacaccttttgcaccgacgagaccgaatcaggctgtttgtccttttcatcaggaaccatgtgccaccttgaatacgtgtttcaaaaaaaacggaacgaggttgcagtatagatgggccgacattgccccagcaatctttcaacgcctgtaacatctgcaaaatatatttttcggcccggcgcgatgcattttgtccggtaattgattaggatcatgatattcaccccctttaatattagcctctatgtcactctcttcttcagacggcggacttgctgtgccacaacggtactgggccattctgacgatcgccattggcctcatcatggcggtgttagacggttcgattgccaacgtggcgcttcccaccatttcacgtgaactgcaggccagtccggcccagtcggtgtgggtgattaacgcctatcagatcgccattgtttcttcgctgctgtcattgtcatttctgggtgatatcgtcggctaccgtcgcgtgtatcagttcggcctggtggtgtttgtcgcgacctccgtattctgcgccctgtcgtcctccctgacgatgctgaccgtggcgcgcgtcatgcagggactgggcggtgccgcgataatgagcgtgaatacggccctgatacgcattatctatccgccccgctatctgggacgcgggatcgccattaacgcactgctggtcgcgatctcaaccgccgccgggcctacagttgcggcggccattctctcgttcgccagctggcgctggttattcctggttaacctgccgctcggtgcggtgacactgtggctggcgttacgctacctgccggataacccacagcgggcaaaaacacagaagtttgatgtcatcagtgccgtgatgaatgcgctttttttcggcctgttgatttctgcgctgggcggctttgcacagggacaatcgcactggctgatagccagtgaagtggtggtggtcatcctggtgggttatttctttattcgtcgccagttagcgatggcggtgccgttactgccggtcgatttattgcgtattcccattttcgccctgtctatctgcacatcagtgtgctctttctgcgcccagatgctggccatggtttcactgcctttctatctgcaaagcgtactgggtcgtgatgaagttgctacgggcttgctgttgacgccctggccgcttgctaccatgctgctttcgccggtggctggccgcctgattgagcgggtgcatgccggtttactgggcgggattggtctggctctgtttgctgtcgggctgttcctgctcgcccggatgccggcccagcctgaggatagtgatattatctggcgcatgatgctgtgcggtgcaggttttggcctgtttcagtcacccaataaccacaccatcgtcaccgcagccccgcgcaaccgcagcggcggtgccagcggtatgctaggaacggcacgtttactggggcaaagcagtggtgcagcgctggttgcgttgctgttcaatctgatgggaaatggcggaacccacgcctcgctgttattagccgggggattctctaccgtcgccgccctgctcagcctgtcaaggatgaaagcgtcctgagtccggcgacaaaaaaggcgactgagcagtcgcctttttatcggggtttacttcagatattcgccgctacgcagcgcttcgatacgtttgtctaacggcggatgcgacataaagagttcgctaaatgactttcctttgccgttgatacaaaacgccatcatgctgctgggttcctgcggctcatagctggttttcagacgctgcaaagccgcaatcatcttctcgcgcccaaccagtttggccgaaccggcatcggcatggaattcacgatggcgtgaaaaccacatggtaataatgctggcaaggataccaaacaccagctcaagcaccatggaaacggcaaagtagaccagcggattaccgttgctgctttcttcaccatcacggttgccggacataaaaccggccgcaatctgtgccaggatgcgcgacacaaagataacaaaggtgttcaccacaccctgaatcagcgtcatagtaatcatgtcgccgttcgcaatgtgcgcaacttcatgcgccagcacggcctccgcctcatcccggctcatgttttgcagcaggccggtagaaacggcgacgagggaagcattacgtcgcgcaccggttgcaaacgcattgatatccggcgcgtggtaaatagcgacctgtggcatcgcgatgcccacttgctgtgcctggcggccaatggtctcaagtaaccagcgctcggtttcattgcgtggttgttcaatcacttcaccaccgaccgaacggagcgccatccacttcgacatcagcagtgagacaaacgcaccgccgaagccaaacagacctgccattatcatcaggccctgaacactgcttgactgaattcctgtcaggctgagaatcagcccgaataccaacatcacagccaggttggtcagcaggaaaagagcaatacgcatcataacggttaatcttcctcagtagttcatgcgctcatgcgcggatacatatcctatgagcattacgcgggttttcaagcgaccttaacgtttaagtgcctaaaaagacataactttacaatatgacacaaccttccgcgtaacctgccgaaaaccgtccggaagaacacattaactgcgctaatcactgccaaattaatgataaaaaaaagcaccgcgctgagcggtgcttttcgtcaatcttatgcctttagttggtctttgccgcgggagcgtcgggtaatgacttctccagttgcgccagatcattggcaattttgaccgtttcatccagataaggatcgggctctttatagtccttcggtaaatcatccaggcttttcagcggctttttaccttcagcctgatagcgcgcattaatccgttccagacgcagtgcatcttcttcgtgattctctttctcacgctgggcaagattgagtgacacgatattgcgtttgtctttcatggcattaaagcgagcgatgtccttcatgatgtactggaactcgcgatctttagcgatacgttcgtcgtgttctttggtcagctgcggtgccagcgctttgacatcaccagtcctggtgtacgtggcggccgtaatgctgtcccacggtagcgcgttatcttcaaacttctcgcccgtttctgccgcttctacgccggtcggcattagcaggtcaggcgtaacgcctttgcgctgagtactgccaccgttgatgcgatagaacttctgaatcgtgtactgcaccgaacccagtgccggccattccgggcgcagcatctgatcgtaaatccggttcagagaacgatactgctgaacggtacctttaccaaacgtcggctcgccaacaatcagcgcacgtccataatcctgcatggcagccgcgaagatttctgatgctgaagcactgaagcgatcaaccagcaccaccagcgggcctttatagtaaacaatgccgtcgttgtcgctgtcctggcgcacgtggccgttgttatcacgcacctgcacaaccgggccgctgggtataaacaggccggaaagcgaaaccgcttcggtcagcgcaccgccgccgttggtacgcaggtcaataacaatgctgtccacattctgcttctgcagtttctgcagctggaccttaacgtcatcggtcaggccaacatagaagcccggaatgtccagcacgccgactttctgtttaccgacgttatgaacgctcattttaacggcgcgatcttccagacggattttctcacgcgttaacgtcacaatgcgggtcttggtgcctttgcctgcaggcagaacctcaaggcgaaccttgctgcctttcggtcctttaattttagcgaccacatcatccagacgccagccgatcacgtcttccattggcttgcccggctcaccgacgccgacaatccggtcgccaacggtaatggctttgcttttcgccgccggaccgcctgccaccatcgagttgataacggtatagtcatcatccatctgcaacacggcaccaataccttcgagcgacagactcatttcagtattgaactgctcggtattacgcggcgagagatagttagtatgcggatcgatttcgtgagcaaacgaattcatggccagctggaacacatcttcactgttgctctgcgccagacggcgtatcgcaaagttatagcgtttggtcagcacttcacgaatttctttttcgtctttcccggcgagtttaaggctcagctcatcgtatttgaccttggcgtcccacagcgcatttaactcgctctgatctttcggccacggagctttagcacgatcaatatcgatcgtgtcattgccggaaaagttcatcgggcgagccagcaccgtgagcgcatactgatagcgctcaaagcggcgtttctgcgccagattataaagatcgtagaaaatatctagtttaccgctacgcagctcatcacccagttgggctttcttgctggcaaactgcgcgacatccgacgccaacaatacgttgtggctgtagtcgagcatattcaggtagcgatcaaaaatcttagcggaaaacgtaccgtcaagatcgaactggcggtagtgagaacgggtaaaccgcgaggtcacacgctcgcttaccgtcggatcctgcgggtcctcgtgcaattgaggaatttgatcggcacgcgtgatgttctcggccgcaaaggaagggcctgacaacagcaggcccgcgatcaatccaacttttaaaagggtgttcatgccggggtcagcctccgtttcagaactgcaaatgttctgcgcgcacaatcattgccatgccggaagcgagctgcacccggacgccgtcttttgatacttccagaacggtcgcgtccatcgcacttttgcctgctttaactttaatactctggccgggttgcaaagttgaggtatcagtgatgggtttagcctgctgctccgggcgtggtgccggtttgcgattctgtgatgcagtaggacgctcagcagactgtggacgcggcttacgcgcggcctcaccttctgccggtttacgcggagcaggtttacgtgggcgacgtggtgcagatgcaccttcttcgccttcaccggcttcacgacgcgcggctcgctgctggtcgcgttgtgcctgaacacgcgctttcgcatcttcaagctgcttgcgggcatgctccacgtgctgctcatcgagcacaccacatgggtttccatcgagatccacgcgggttgcgcccgctttgataccgtagagataacgccagctggaggtataaaggcgcagggccgaacgcaactgcgttttgctcaggttcatttcgccctgaacgcgctctaccagatcctgaaagataccgattttgagcggacgcgcttcaccttcagcgctaaagcagtgcggaaagcgctccgccagaaagctaatgacttctttactgctattcaacttaggttgattttccatgaaatttcctgattactacgggtttgccgaccagagcaggcatgaacaggcgacattataatgacaacatcgccaaatgccatgcaatccagtcgattagctgcgcgtcagttgcaaatatttttctaagtcactgttcgcgagcacgtcgcaaagcccgttagtcaaggcgaccagccctttttcatcttcactatcaaagcgattgtattccacgctgtcgatgtccagaacgccgacaacctgaccgtttattttcagaggaatcacaatttctgcattactggccgcatcgcaggcgatgtgtccggggaaagcatggacatcatcaacacgctgaacctgttcctgcgccagtgccgtaccacaaactcctttacccaccggaatgcggacgcaggcaatcttaccctggaacgggccaagtaccagcgtgtccgcttccgtcagcaggtagaagcctgcccagttcacgccttcaagacgttcatacaacagcgcgctaaaattacccatcgcggcgaggaacgccgtttctcccgccagtaaggcgcgcatatcgcgatctaaatcggcgtaaaaggcagttttgttcattattcaaccgttactagtgacatccgagcggctaaccactccgcttgttaaaaataagcactaaaaatccatagccataaggtgaatcatagcgttagttactataaccttaacattctgtggatcgaagcgtgatacccaagacaggtacccaggcgatgtcttactgaccctttgcgttaatgacaataagcgaaacttgcacttaatgatgaaaattcacgctatcagccagacattgcctcacgcacgttatcagcgttgtccgcaatgcgatacccttttttccttaccagatgtgaaatcgcatcagtcagcgcactgcccccgctgcaacgcgcagattgtgagcggccgtgactggtcaatgacgcgtttactggcgatggcggccaccatgctggtgctgatgccttttgcttttagcatgccactcatcgacattcgcctcctgggcatgcgcattaatgccagcgtgctggaaggcatcgtgcagatgacgctgcagggcaatgttctgacggcctcgatggtggcgttctgtactatcggtgcgccggtcaccctggtggcgggcatcggctacctggcgctgggtcagcgtttaggcatgaacctccgtccggtgttgttgatgctggataagcttaaagaatgggtcatgctggatatttttttgattggcatcgccgtggcctcaatcaaagtgcaggattatgccgatcttgaactgggctatgggctggtggcctatgtggcgttaaccgtgctgagtgtgataaccctgatccatctgaacatggagcaactctgggaacatttttacccacaacagcctcaggtgacgcgccgggacgatttgcaggtctgcctcaactgccactataccgacattcctgatgcgcgcgggcgctgtccgcgctgtcatacgccgctcgactttcggcgtcgccacagcttacaaaaatcctgggccgcactgatcgcttctatcgtgctgttgattccggccaatctgctgccgatttctgtggtgtatctgaatggttcgcgccgggaggacacgattttctccggtatcctttcgctggcctccggtaacgtccccgtggccgctgtggtatttatcgccagtattttagtcccgtttaccaaagtgctggtgatgctggcgctgctgatcagtatccatttccgctgcgagcaaggcatgaaaacccgcattcgtctgttgcgttttgttacctgggttggacgctggtctatgctggatctgtttgtcatttcactaaccatgtcgttggtcaaccgtgatcaactgctggcttttaccatgggaccagccgcgttttactttggcgctgctgttgtcctgaccattatggccgttgagtggctggatagccgcctgctctgggatgcacatgcaacaggaaacgccgactacaccgactaatgctacgctgcgcaataagcgtaagatttcgcctttttggcttctgcccattatcgcaatgctgattgcgggctggttgctctggacaagctttcaggagcgcggcaccaccatttctatcaatttccagacggccgatggcatcgtgcctgggcggacgcctattcgctatcagggcgtggaagtcggtacggtgcagggcatcaatctgagcgatgactacagcaagattcagatcaaagccagcatcaaaagcgatatgcgcgatgcgctgcgtgaaaatacgcagttctggctggtcacgccgaaagcctcgctggcgggtgtgtccggtcttgacgcgctggttggcggtaactacatcggcatgatgccaggtgatggtaaagaaagtgacaccttcaccgcactggatacccagcccaaataccgcgtgaacaccggtgaactgatgattcacctgcattcacctgacctcggctcgctgaataccggctcgctggtgtattaccgtaaaatcccggtaggtcgggtttatgattacagcatcaacggtcaaaataacggcgtttcgattgacgtccttattgaacgtcgcttcgtgaacctggtgaaaaccaacagccgcttctggaatgtgtcggggatgaacgctgacgtcagcctgagcggtgccaaagtccagcttgaaagcctggcggcactggtcaacggcgctatcgccttcgactcccctgacggcgctgaagccgcgaaaaccgatcagaactaccagctgtatcccgatctggcacacagccagcgcggcgtgctgatatcacttgatcttcccagcggggataacctctcagcaaaccggacgccgctgatgtaccagggcttagaagtgggcaccctgaccaagctgaatttgcaggatggcggtaaagtgacgggcgagatgacgatcgatccatcggtcgtgggcctgatgcgggcaggcacccgcattgagatgcgcagtcctaaactcagccttaccgataccagcctgagcagcttactcaccggtaacacctttgaactggtgccgggcgacggtgcgccgcagcagcatttcacggtggtcgcgcccaacaagacgttactgcaaaaacccaatgtcctcacggttaagctcagtgctcccgagagctatggcattgatgcgggacagccgctgatgttacacggcctgaaaattggccaggtaatttcgcgggatctggatgaaaacggcgttaactttgtggtcgcagtcgatcctgaacagcggcaactggtccatggtgacagcaaattcattgtcaacagtcgtcttgacgtgaagtttggtctggatggcatgcaggtgctgggtgccagcgcccgcgaatgggttgacggtggcattcgcctggagccgggtaagcaaggcgcacccaaaacggcttatccgctgtttgccgatgccgaacgcgcagaagaaggtattaccggcgatggcccgtcaaccacactgatgctgactgccaaaagcttacctgacgtgcaggctggctccatcgtgctctatcgcaaattccaggtgggtgaaattaccaacgtcacgccgcgagccgatgcgtttgatattgcagtccatatcaaaccggaataccgcaagctggtctctggcgaaagtgtgttctgggcggaaggcggcgcacgtgttcagcttaacggcagcggcttaaccgtgcaggcgtcacctttgaaccgtgcgttaaaaggggccatcagctttgataacctgacgggcgcgaaagtcgataaaggcgttaaacgcgtcctgtatccatctgaaactgcggcccgtgcggtcggcagccagattacattacatacctatgacgcgagcaaactgtccgccggtatgccaattcgctacctggggattaacgtcgggcaaattgagtcactgtcgctgagcaatgacaacaatcaggtggtggcgaaagccgtgctttaccctgaatatgtccagagtttcgcccgcgtcgacagccgtttctccgtcgtgtcaccagagatttctgctgcgggcgtcaatcatctggaaaccatcctgcagccctacgttaacgtcgatccgggcaaaggccgtggcgcgcggacgtttgagctgcaggaaagcaccattaccgactcacgttacctcaacggcctgaacatctatgttgatgccaccgaggcgggttccctgtcactggggacgccggtgctgttccgcggggtggaagtgggtacggtgaccggcacctcgctgggtaatatggcggaccgcgtccagatcgccctgcgcatcagtaagaaataccaacatctggtgcgtaataattccgtgttctggctggcctctggctacaacctggactttggactgattggtggtgtggtgaaaaccggcaccttccagcagtttattcgcggtggtattcagtttgctacgccgccaacggtgccgctggctccgcaggcgaccgcagataaacacttcctgctgcaggatgaaccgcctaaagcgtggcggaactggggaacggcgattccggacccgaatcagccttaagacagacgggcagcgcaggctgcccgttttctttctgcgtgctacactgccacctttgcctcaaagagaacctatccgtgtccgactccgcctcacgcttccctgccgacttcctcgacctgatacgccagagtttgcccgatgacaccagcctgcagcagtttatggatatcagcctgcagcctttgcgccgcagcctgcgggttaacaccttaaagatcagcgtgagcgactttctggcacaaacggcccactacggctggcagttaacgcccgtgccctggtgcaaagagggattctggatcacccgcgaggatgaaagcctgccattgggcagcgtcgccgagcatctgagcggcctgttctatatccaggaagccagctcgatgctgccggtaacggcattgtttgatgcgcaccccgatgcgatgagcatcatggacatggccgcggcacccggctcaaagaccacccagattgccgcctgtatgcataaccagggcgttatccttgccaatgagttctcttccagccgggtcaaagtgttgcacgccaatattacccgttgcggcgtcacccatagcgcactcacgcactttgatgcccgcgtctttggacctgcgctaccggagcagtttgatgcgatcttgctggatgcgccctgctccggcgaaggtgtcatgcgtaaagacgctgatgccctgaaaaactggtcgcttgccagcacccatgatattgccgctacccagcgcgatctgattgacagcgcgtttcatgccctgaagccaggcggtacgctggtgtactccacctgtacgctgaatcagattgagaaccaacaggtggtagccgggctacttgagcgctatccgaatgccgtcgaaattgcccccttgcagtcattgttcgcaggtgcggagcgggcagccacgcctgagggtttcctgcacgtttttcctcagctgtttgacagtgaaggtttcttcgtcgcccgcttacgtaaaacggcgtccgtcgagcgtttgcccgaaccgacttataaagtcggtaagctgccgtttagccacctgagccgcaagctcgaaagcgagattgtgcaggcagccgcgaaggtcgccattcaatgggatgacagcctgcagctctggcagcgtgataaagagatctggctgttcccgaccgcggttacaccgctgttaggtaaggtgcgcttctcgcggattggcctgaagctggcagagacctttgcaaaaggctatcgctggcaacacgaggcggttattgcgctggcctcaccgcgccctgagcagacgtttgcgttgagcgaggcggaagccgaagaatggtatcgcggtcgtgatatctatcctgaaaatgcgccaaccctcgacgaaatgatagtgacctatcaacatcagccgctcgggctggccaaacgtgttggtagccgcattaaaaacagctacccgcgcgagctggtgcgtgatggcaggctgttccgctaggcgcacgcacgcaatgtgacactgtcacgttgcgtgccctgtttttgactcaggattgcggttaaatcgggcgtgatgtgatggaagatgcgttaaacaggacaggaccacgccggacgccgccggcgcgttcagcctttatgcgttgcgcagtttggcgggatgcgtcagcagtttagccgcaggccggattggccgccggactaattccccgccacagtttggacacagccctttaagatgctgctcagcacagggagcgcaaaaggtacattcgaacgaacagatgcgcgcatcgtaggatgcggcaggcaagtcggtatcacagcgttcacagttagggcgcagttctaacatggcatcctccttggcggtagcggctgccagcgtggcaaaagccgcaccgcttgtcgaggattttcatcttgccaccaggatgccgtatggatttaatcagcggttagcgtgttcctgattttgcgtatccttgctgccccgatcgtcatcgtcctctttatcctcttcgtcatcctcattctcttcgtcgctattcaccatcgccgcctgaatcgcctcatcttccagcaccgggttaagcgccgcgcctaatggcgatgtcgccaggctgtctggcaagaccacatggggcagcggtacttcggtggtcggcaacggaagcggcgttttcatatagctcaatgcggcaatcagcagcgtacacagggtgaagaagagataaagcatgttgctgccaaacggctgaattaatgcccccaccagcaaaggaccgatactggcaccgatgccaaaggccatcaataaacaggccgtgagtgacacgcgctgctcggcagccacctgatcgttagccagagcgacctgtaaaggataaagcgaaaactgcaccatgctggcgacaaacgcgatgcccagcacccagttgaaagagaggtttggcaatacaaccagcggcagacaggccagcatcaatacgacggaaatatagaacaacagtcgctggcggtcgtagcgatcggacagccaactgaggggaaactgtgaaaccagcccggcgaaaatagtcaggctcatgaatatcccggtttgggcatcgctgaaccctttactgctggcgtaaaccggtgccagaccataaaacgcaccgaccaccataccggttaacaaggtggtactgagcaactttggaatcgtgcgaataaaatagctcagttccatgggcgcgggcgacatgggccgcacatgggtgcgcgttgtcagggcgatgggtaccagacagagcgcaaaacagagggccacaatcaacaacgtattgataccaaaaccgctttgcagcgtcagcaccacctggccactactcaatccaaggtaggttgccaccatatagaagccaaaaatcaggccgcgctgtgaagattccgcctgatcattgagccagctttccagcaccatatactgacacatcatgcacaggccgataatcagacgcagaaaaacccatagcggtataaagtctgtcagaccgtgtcctatcactgacgcggtgataataccggcgcaggctacatacgcgcgaatatggccgacgcgcgcaatcaggttgtgccccactttcccgccgatcaccaggccaatgtaataggctgcgataatcgcgccgatcaccgccccgttaacctgttcatgcgccaggcgcagcgacacataggtcgtcagcaaccccgatcccagtagcatcagcaacgtagtggtgtaaagcggcagaaatgttctaagaatttttcgcatacgactccctgtcaaccacggtaatcggtgtcctgtagtgtttaaagatagttgattttgtgacggtttaggtcgggactattccgactatgaaaaaagcccgtaaacctctcggcttacgggctgctgactcaggcgttggggaaggtaatgttgcttcccggtgcctcgcgatggaggtggataaagttcaggtgacgttcatattgatcgaggatatcaataatcacctgctctttgctgtagtccatcaggtcattgccctgactgccttccagcaggaaggtttccagtcggtaataggtggacttaccgctacgcgcccggtaggtaaaaccaggtaccgagtattgctgcggccagacctgatagaggaagtcctgctcgtcgcccagctgaacgcgcaaatccagataacccagcggatgctcgtcgtcagccgccaccttatccagcgagaccctggcgccacgcagctccagctcttttgccacttcctgcatggcagggaagatggtctcttccatcatcttcagcgtgtaacgcgagccggggtagttcatcagccgcgacaggcgttttttccaggtcagacgatcggtcgcatgtgccaggtaaggcgcagtatcgcgtgtcgcactggcacgacggtagtcctcaaccttgagtgacttatacaatcccgccatcacaaagaagatcacgaagctaaacggcagccccataatcaccgtggcattttgcaacgcggtgatgccgttggtcatcagcatactcaacgtcagcacaccgatcgccaccgaccagaagatacgcagccagttgggcgcatcgctgttgatgtctttcagttttgaggtgaagtttcctaacaccagcgaaccggaatccgccgaggtgacgtagaacagcataccggtaatggttgccaccgatgcgctcagcttaaacgccggatactgggccagcaggctatagaaaccgcgctctgcgtgcgtcatcacttcctgggcaaagcccgcgtcgccatgaataatttcatacagggcggcgttaccaaatacagacagccaaagcagcgtaaaggtaaaaggaatcaccagcgtgccaagaacgaactcacggatggtacgaccacgtgagatacgcgccaggaacaggccaacgaatggcgaccaggcaacccaccaggcccagaaaaacagcgtccagctgttcatccactgcgttggtcgatcaaaagcaaaggtattcagcgtcatgcccataaagcggttgatatagtcgcccacattaaggaccagcgcattaagcaggaagctggtatcaccggcaaacaggacaaacagaatcaggccaagggccagtgccacattcagctcggacagaatacggatacctttgtccacgccggaggtgacagagatggtcgcgataaccaccgacagaatgatcagcgccgtctgggcagttagcccttcgggaacatcaaacaacaccttcagcccgtaattcagctgaacaacgccgatgcccagcgtggttgcgataccaaaaatcgtgccgacaaccgctgcaatatccacggtatgtccaatcgggccgttaatgcgctttccaaagatgggatacagcgccgagcggatggttaacggcagattatagcggtagctaaaataacccagcgcgatccccattaaggcatacattgaccagccggttaagccgtagtggaacagcgtccagaccatcgcctggcgggccgcctccatggtctgccctgcaccttccggcggctgcatatactgtgaaacaggttccgctaccgaaaagaacatcaggtcaataccgataccggcggcgaacagcatcgccgaccaactcagtacactgaactcaggctttgactgctctggccccagcttgatcgagccgaagcgcgaacacgccatataaaccacaaagacaatatacagcgttgccgccagcatgtaataccagccaaacgcggctgacacccagttaactgcctttaaaatccagcctgcagcttcgttgctaaacagaatggtgatgagtgaaaacgtcagaatcaatcctgccgatgtgtaaaacactacaggattgattctgtctttttcactagttggtggactcgtcatcgtttacctctggttgttggcttgtaaattctgcaagagttcaatccggttaaaaatccggcgccctggcggcatgtgtttttttacgcttcgtttcctgctgttacattctggtcaaaactagccaatctgccacacttaccgcttcacttactcaacttttaagacacatcatcctaacaaggtttctatttatattgaacatccaatcaaaaaaagtttaaatagaggctcggtttcaggctggagtgaaagtcatgccaaaggtagggatgcagccaatacgacgtcggcagttgattgatgccacgctgggcaccatcaatgaagtcggcattaatgatgccaccattgcccagattgcgcggcgcgcaggcgtttcaacgggcatcattagtcattatttcaaggacaagaatggcttgctggaagccaccatgcgcgatgtcacccgacaactgcgtgaagcggtcgcgcttcggctggctccactggcgcaggcttcggcagaagtccggctgcgcgctatcgtcgacggcaattttgacgaaagtcaggtggaacgcgcggtaatgaaagcctggcttgatttctggtcaagcagcatgcatcagcctcagcttcgacggctggaacgggtcagccaccgacggttgttttcagcgctggcagtggaatttcgccgccagttgcccaaagaaaaggcccgccttgccgcccacgggctggccgccatgatagatggcctgtggttacgcgccgcactgagcggaaagccttttgatccggctaccgcccggacactgaccacccaattcattcgtcagcagttagctggcgaacacgagtaacggaaccaggagaaattatgtcccgattcaacgagcaacaactctacatcaatggtacttacgttgccgctacctctggtgaaaccttccagagcattaacccggttaacggtgaggtactggctgatgttcagatcgccggacgcgaggatgtcgatcgcgccgttgccgctgcccgaaaaggacaaaaagtctgggcggccatgaccgcaatggaacgttcacgcattctgcgtcgtgcggttgatatcctgcgcgagcgcaatgatgagctggctgaactggagatgcttgataccggtaagccgttcagtgaaaccgcaagcgttgacatcgttaccggtgccgacgtgctggaatattacgctgggctgatccctgcgctggaaggccaacaaattccgctgcgtgatacctcatttgtttatacccgccgcgaaccactaggcgttgtcgcaggcatcggtgcctggaattacccgattcagattgcactctggaagtctgcgccagcgctggcggcgggcaacgccatgatctttaaacccagcgaagttaccccgctgacggcgctgaaactggctgaaatctacacagaagccggcgtgccagatggtgtgttcaacgtgctgccgggcactggcgcggtcaccggccaactgctgaccgaacatccgggcattgataaggtgtcattcactggcggtgtggtcagtggcaagaaagtcatggcgaacgcggcaggttccacgctgaaagacgtcacgatggagctgggcggtaagtctccgctgattatttttgatgatgccgatctcgacctggccgccgatattgccatgatggccaacttctacagttctggccaggtgtgcaccaacggtacgcgggtgtttgtgcctgccgcgctgcagtctgcctttgaggccaggattcttgagcgcgttgcacgtattaaagcaggcgacctgcgcgatcctgacactaactttggtccgctggtcagctttagccaccgtgataatgtcatgcgctttattgcatctggcattgaagaaggcgcacgtctgctgtgcggcggtaagcgcttaaccggcgaaggctttgatcagggtgcctgggttgaacccactgtattcagcgactgccgtgatgagatgaagattgtccgtgaagaaatctttggcccggtcatgtcgattctgagttacacctctgaagacgaagtggtgcgccgcgccaatgacaccgagttcggcctggctgcgggtctggtgacgcaggatctgaaccgcgcacaccgggtgatccatcagattgaagccggcatttgctggattaacacctggggtgagtccgccgccgaaatgccggttggcggttacaagcactctggcgtgggacgtgaaaacggcctgatgacgctgcaaagctacacccaggtcaagtcggttcaggtggaactgacgcgttttcagtctgtattttaatcccctaacctgaggaacgacgaatggaatttgattacattatcatcggagccggatccgcagggaatgttttggctacccgactcaccgaagacagcaacgtaaatgtcttactgctggaagcgggcggccctgactaccgttttgattttcgcacccagatgcccgcagccctggcttaccctttacagggaaaacgttataactgggcgtacgaaacagagcctgagccctacatgaacaaccgccggatggaatgtggccggggcaaaggcctgggcggttcatcgctgatcaacggtatgtgctatatccgcggtaacgccatggatctggacaactgggctgacatgcctgggctggagaactggagctatctggactgcctgccctactaccgtaaatcagaaacgcgcgataccggtgccaacgattaccatggcggtgacggtccggtcagcgtcactacgccgaagaaaggcaataacgttctgtttgaagcgatgattcaggctggcgttcaggcgggctatccgcgtaccgatgaccttaacggctatcagcaagaaggctttggcccgatggaccggtttgtgacgcctgaaggccgacgctccagtaccgctcgcggctatttagacagggcgaaaagccgccctaacctgaaaatcaccacacatgccacgactgaccgcattttgtttgaaggtaagcgcgcgattggcgtcgagtatttaatcggtgacagcaatacgttgcacacggctcacgcacgtcgtgaagtcctgctgtgtgcgggtgccattgcctcaccacaaattctgcaacgctccggcgtcggtgcctcagcgctactgaagcagttcgatattcccgtggtacacgacctgccaggcgtcggtgaaaatctgcaggatcaccttgagatgtatctgcagtacgagtgcaaagaaccggtatcgctttatccggccttgaaatggtggaatcagcctaagattggtgcggagtggctgtttaacggcaccggcgtgggagcaagtaaccagtttgaagcgggcggatttattcgtagccgtgaggagtttagctggccaaatattcagtaccacttcctgccggtggcgattaactacaatggctcgaacgcggttgatgcgcatggtttccagtgccacgtgggttcaatgcgttcaccgagtcgcggtcacgtgcacctcaaatcacgcgatccgcgtcgccatccggctatcctgttcaactatatgtctcatgaacaggactggcatgaattccgcgatgcgattcgtatcacgcgtgagatcattaatcagcccgcgctggataaataccgtggccgcgaaatcagtcccggtattgaatgccagaccgatgaacagctggatgagttcgtgcgtaaccacggcgaaacggcctaccatccttgtggcacctgtaaaatgggcaacgatgagatgtcggtcgttgacagtgaaggccgcgttcacggactgcaggggctacgcgttgtcgatgcctctatcatgccgctgattatcaccggtaacctgaatgcgaccaccatcatgatcggtgaaaaaattgccgacagcattcgtggccttgaaccactgccacgcagcacggcagactactatgttgcaggggatgctcccgtccgcacggtgccagaacgcacggcgtaacggttttctgtgccaccaccaagccggacatctgtccggcttttttatttctctgccagaacgaaaccgcgcctcaacccacgtcatattcatctgatattcgtcaaatatccgaacaaacagactgtctcttcatctgactacgtgatataacgctgtggtgtttattaccggaggctttatccgtccactgaagagaagcaacaacgtggatgcattgttaaattatgagcaggacgttcattacgctttttaccgccctttttacccttaccgctttcagcgttaacgccgtcgatcagcactggcgcagcgcgctttagtcccctctctgccagcaaatttctctttctgccgttgcgttacgcatcacggtaaatcatgacgtttatttgtggagaaaacccatgcgcgcctggggattattagcactcgctattgttacggaaatcattggcactttaaccatgaaatggtccagcctgaatcaaagccagacgggatatgtgatcatgctggggatgattgcctgttcttatctctttctgagtttcgccattaagcgcattgcgttgggtgtcgcttatgcgctctgggaaggcgttggcattatgctgatcaccgtatttagcgtgcagctgtttgacgaaaccttatcgctgatgaaagtctgcggcctgttcaccctggttgtcggcatcctgttaattaaagccggcagcggtgaggtcaaggaggcagaacatgatcctgcctgatcttattcactttacctggctggcgctggccgtgctgctggagatcgccgctaatattttacttaagtacagcaacggctttaaaaaacccggttatgggattctgtcgttggcctgcgtgctgctggcgtttagcgcgctgtctcaagcggtaaaaggcattgagctgtcgattgcttatgccctgtggggtggctttggcctcgtcgcgaccgtggcagcaggatggattctgtttgatcagcggctcaaccgaacaggctgggccgggcttgccctgctattactgggaatgattatccttaaactggcctgacactgcggggacggtgacgtcccccattgtcatttatgacgtcacgcgtatcaggcgatgcgcaaaaacatccctgcgcgctcgggaggcagtgccggttcaaaaccatagcgcgcataaaaagcgggcgtaccgtggctggcgattaaactgatataagctgacggcggtgcgtgacgctgaatataattcatcagcgcacgcataatacgatcgcctacgcctttcttttgatgctgcgggatcactgcaatatccgtaatgacaaaaaagcatcctccgtccccgatgacccggccaataccaatggggctatcctggttatccgaccgtgcccgcgtgctcttagctgtactgtacgagcatttgcaaagcctcatcaaagtggcctttcgcttcggcctcgcgaaaatagcgcacgcgcgccacgcagacttccgcaggcgttgccccgctatgcaataacgtcatcacctcatcggcaaacacatcaagcggcatactgttggcatcctgtgactgtccgggcgccagctcggtctgcacctggggcgggataatctcaatcacctccacctttccctgcaatagtggccgaatagccgccgtataagaatggagtgccgctttggtcgcactgtaagttggtgacgccggaaaaggcacaaaggccaatcctgaggagacgttgatgatggctgcatcgggctgaccgctgagatgatcgatcagcgcatccgtgagcctgatgggagcaataaaattggtttctgtcattctggctacctcgctcagatcccgcactgtagtgatatcttcggggctgaacacaccggcattattcactaaaacattcacgtgcgggtaggtgcgcagtagttgaggaatggcgttgttgacgtcggctgcatccgtaacattcatcacccaggttgcaatgcgctctcgtccggctgccgcatcgtctaaggtttcctgccgacgtccggtgataatcacctgatttccggcgtcgtgccagcgatgtgccagtgcccgcccaatgcccgatcccccgccagtaatcaacaacgtattgccactctttttcatgttttcggttcccgtttgacgtaccagacagcgttagcgagcacatcatctcgccgttcaattattaaccacagcgtcagaatcctctcacttttttgtttgcgggtggacttggcaacagcgttaaggcttagttaccgccttagagccagtataactaactgattaacgaggttttaccatgtctgcgacacgaggttggtccacggagctggaggggttgcgtggcattgcttctctttgggtactgctggggcacatcagtctgcttatccattgccatatcaccctgatttcctcacccggcattggtgtggatctgtttatcctgctttcgggttatctgatggcgaaaaactacgtagaacgccagcataaagagccctggcaaagtgcggaaaccatcaagaaattctggttacgtcgttttttccgcatcgccccactctactatttgctgctggccgttgcgctgatttacggcccctggtttggtgaaatgcgcgataccattgcacagttttattccggcaccgcgacagaatcctcccgctatgccgatcagtcgttgatgaacgtgctaacgcacctgtcgttcctgttcggcttgctgcccgcctatggattcaatacaacgctgcccgactggagcattgggctggaaatgcagttctatctgctgtttccctttattatgctggcggtgatgcgctttggttatgccaccgccctgctgagcattatggcgctgagctgtgccggtcgttacctgctgcccgactactatgaagcgtttgaaatgccatcgatgattctgattaaactgaatatgtttatttcaggtatgttgctggccgaagccgttcgacgcaaatccctgctttatatcgtgtttgcccttgccggaccggcagtcagcgttcttatcggattgggtgccattaagctgcaggtgatgctggaagccgtcatgattatcggtatggcggccgtgctgtggcagtatcaggaaaacagtctgatggcgaaactgatccagatcccacgcaagcttttgaacaaccgactaagtacatggttaggtgacgtctcgttttcggtttatttgctgcacctgctgatcgtgattccagcgattgcgctgttgcttaatcagacggatattgagtatcaacatgatctgacgcgtttcctgatcgtatgcgccgtgtcgattccgctgacctatggactggcatcgttactgttcaaatacgtggaaaaaccggggatcaatctgggtaaaaggttcctgtcagctaagcctgcacgctgaccgaacaatggctcgcgagtgcgagccattttattcacttcacacggctttacccacctcgtgctgcctttccctcacgtgttcatccggtgactccggcgtatcggcgatgctgctatgggtttttaatccggcgacatgaacgcgatcgatcctggtgtgcaccagaccttgtgcggttgccccaaatgaaatcatcaaaaataaccaggccacggctaacggtttcttcattgcgctttcccatgctgtgaatggagtcgctatagtgaagaaactggcgtaatgaagtgtctgataaacttaaaattcgcgtcaagattgttaccttgatcacatattcttgctgctgtttatcctctctttctgcgggcacagcacccggttgcatcctgctatctcggcacgcggtgttatccgttcggtaatgttgcgtcctctccgcggagagaggatggcatcgccgtgtgcgataggcgttatgcgttaaggcactggctaaagcctgatagcaggtcgcgggcatgatcctgatgtccgctgaatcagcgctatcagggttaatcgcaaccaccattataatttatgttttcaccgaaaatccgcgctcaaaccgattaaacacatcaacctgccatcttaaattcctgacttctgcctgaatatactgcccataacaaaaatatccctctttattgattaagatcatttttctgatttataaaaataatattaaagaaacttatgtaaattttgcttttttcgttaatccttttccagactggtgccgatagagaacaaaacggtaatccatcgggaacatctacatgaaaatctctactcgtctttcaataggtttcggtttgttaattctgctttttattatctgtacctccgtctcccttaactcgctgcataacgctaaaacggggatggatgaggtcgtgaatgtcaaaatgaggaagtaccagcttattcttgatatgcgcggcgggctgcgggatttggcgatagccgtgcgaaatctggccttactttctgacacgaaagagatgcagccagaatgggaacgcattgaaacacagaaaagcctgttcatcaaaaaccgtgaaacgctcgaaaccattatgcagagccagtccactgctgaagaacaagctgccttgagtcacatcaaagaacttgaggccacggtgatgggtgcctttgagtccgccgggcaactgggactgaagaatgagcgagatgaagcgacacgttatctcatggaaaccctgcgtccgctgcaacgcgatatgctgaacgccctaaataaaaccaccgacattctgatgcacaacagccgaaatgcggtggaagtcaacagcaatgccaccagtcgggcctcgctgaccttggtgtttttatccgtgctttccgtgctgttctcggtggccaccggctatatgataacccgtgtgttgatgcgccaacttggcggtgaaccggcgcaggcacaggtgctggcggccacgattgccgcaggcgatctgacctccagcgtcacgctccgtcgtaatgattccaccagcctgcttgcttcactggatgctatgcaggccaaacttcgtggtctggtatcggaaattaaacagacctcgggcaatgtcgcgctggcggctgaagaaatcgcccaaggtaatacggagctctcctcccgtaccgaacagcaggcagccgcgctgcaggaaaccgcagccagcatggaacagcttaccgccacagtgaaaagtaatgccgccggtgctcagagtaccgcatctacggctcgcgagaccgccgtactggcacgcagcggcgaaagcgacgtccaccggatgtcggaaaccatgaacgagatttcgctgagcgcgtctaaaattcgcgatatcaccggcgtcatcgaaggaattgccttccagaccaatattctggcgctcaatgctgcggttgaagccgcacgggccggcgaagatggccgcggttttgcggtggtggcgggcgaagtccgtaccctggcgcagcgcagcgctaccgcagcgaaagagataaaatcactgattgagcaggcagtggaacaggttggtagcggcgtgaaagtcgccagcggtacaggtgaaagcatcctgaagattgtcagcatggtgggcgatctggccagcgcgatggatgagatctcactggcctcttccgaacagatgcagggcatttctcaggtcagcgtcgccgtcagccagatggacagcgtcacgcagaataacgccgccctggtggaagagtcatcgtccgcttcacagtcactttctgaacaggcgcacgccctgcgcggcatggtcgaagccttcagggtataaatgcgccctcttcatctggcagagatgacctgaccgatcaggttatctctgccatcccgttacggggaccgggccagaacagtgcggcctggccccagccggcctctgcgtccctgtctgactgccatacctcgccctcatagatgatgaaactcttgccctgtttatctacccgcggcccgctgtagccggtggcaatgccgtcgcgtttgacaatgtccagcaggcgctgccgcgcttccctgtcggaaggtccggcactgagtcgtgaaggcaattgcagcatctcttccaggctgtatttgaagcagctcagtgcacaacgattggcataaacaaataccggatcggcttcgctactgtgggccagaatgctgtacggtgcatgttcatgcagccacaggtagcgatcaacatgctcatcggggcaataaaggccgcgtccggtgagtgcacggtagcgttcatcaatacgctgcaataaagccagttggttttccgtcgacattatcaactccgttacaaaaggcaggatgcgaggaggtaatgtggcgggatgcgtgttgaaaatcaagaatgggttacggtgaagatgaatggctcacaggtatctacctcgcgcgctgcgcacagcacggctatcgccgctcagtgcacgttagaatattggcatctcccgcgctccatccacagggtgatccataacggcattcgattctgttggctcgccctgtgtgcgctgaagtcagccagcctgaacgcaatcccaggctggctggcggtttagctcaatggcggccagaaggctttattcgcctcgataagatcgtcgagaatcgcgtttgcgaccgccgcactcggcaccgttttagacaaggtaatggcctgccataacttttgccgggaacgctgttcccatgcctccaccacaagcttttcgaccgcaacctgctgactcattaagcccttctggaaagtaggaatgtctccaacctgaagcgcttctgcaccgttacgaccgaccagacagggaatttccaccatcgcttccgggtcgaagttggaaatggcaccccggttaggcacaattaacagcatacgcgcctgagtattgaaggcgatcgcggttgccagatcgacaatgtaggaagcatgttcgtctatctccaactcgccggcagatgaatgacctgcatcgctgattgccctgcaggcactgaatacctgcttttcacgatgatccatcacttcattagcgcgggtgcgtgcaggattggaatgcgcgaccacataatctggaaacagataatatttcagataggtattgggcaacgtcagtgggtccagcgcctgcacatcgcgcgccttcacgaaggtgtcgttccaactcggctccactgacgacgcctctgaaggcggcacatagccgtgtttcgccacgtactcacgcagttgtggcatcaaatcatttcctttcagatcttcaacagcagtccaccagccaaaatgattgagtccgtagtagcgtacccgcatttgtttgcggtcttgcagaccgacaattttcgccatccgaccttctataccaatcggcatatcacaaatgttcaggatcttcgcctcaggtcgcaggcgccgcgttgcctcagccacgatggcggccgggttagaataattcagcatccaggcgtcgggtgagtactgttgcatataatcgacgagctcaaggacgccgccgattgagcgcatcccataggcaatgccacccggcccacaggtttcctggcccagcacaccatgacgcaacgggattttttcatcttgctcacgcatgggatatttaccgacccgaatatgcgccataacaaaatcgacgtcgctaaatgcttcctgcggatcggtggtgtagctgaacgcaatctcaggtgcctgttcctgcaagataatctgacaggcctgtgcaatggtttcctgacgggcggcgtcattatcgtaaaatttcagctggcgcaaaggaaagcggtgccggttcgccaggagcatcagcacaatacccggcgtaaacgtgctgccgccgcccgcaattaaaactgagaatgtcttcataatggtttctccatggaaggtgttgcttcagattcggcctggtctttcatttggctttcaagttgctcgcgcacctgggggacctgtaagcccacgatgacctgaataccgttgccacgccggacgacaccgtgcgcccccagcgccataaacgcggcatcgttttgcgttttagcctcatcgaccagggttatccgcaggcgcgtggcgcagttgttgatgttggctatattgctggccccgcccaatgcatgcagaaaaccccgtgcctgatcgtgttgcgggttctgcccaccagatgaagcaggcgcgtgtcgcgctgcccggtagtcggctttgttgtaaagcctgacttcactgtcctcacgaccgggcgttttcaggttcaaccgcaggatgagttggtgaaaaaccacaaagtagaggcccgtaaaaaccaggccaatgcctatttgggtcaggaccatgccagcatgattagggaacatgggtatccagttttgcggcagaaactggtccagtaagccgccgccataattccccacgacgccgcacatatacattgctgtcgccatgctggcggccagcacagcgtgcaccgcaaacaacaggggcgaaataaacaggaaggtaaactccaggggttctgtgatgccgaccagtacggctgtcaacgtggccggaattaataaccctgcgactttgatccgctgaagcggtgaggctgtcgaatagatcgccaacgcaatccccactgcgccaaacactttggcgttgccatgaagggcgaaaccgccttgaggaaacagttgtttgaggggttgcgtgctctggctgaacgcctgcagatgctcggcccagtaaacctggatgccaccttcaaccactgccgggccaaagataaaaggtccataaataaaatggtgcagtccggtggggatcagaatgcgttcaagaaaggtataaacccacacgccaacagcgcccgcatcgcgtaaaaactgttgaagcgactcaatgcccatttgaattttgggccagccaaacagcgttaaccaggcgcaggggatcatcgctaagaaggcaacaatgaccacaaatgatgagccctgaaaaatacccagaaacaccggcagtggtttatcaaaataacgattgtgtagcgccgtcaccagaccggcgatgacgatggcaccgatgatgctggtatccagcgtttttatcccggcgatcatggccagtccgcttccggcttcagtgcctttggaaaaatcgacggaaaaaaaatcgccctaggtgctgcccatggcattaatcaggtaattccaggttaaaaaactgacgacaacggccaggcaggcacgtccctgagcctgttttgccaaccccaccggcaagccaaccgcaaaaattaacggcatatttctaaaaaccgtccagccgccttcttcaataatgaacactatttgattaaataaactatctggatgcgttagtgcttcccctacaaataaagggttgcgtaacataattgaaaggccaacgatgatgccggcaaagggaaataacaatactggggtaaacatggcgccgccaaagcgctgtatttgactgagcattttagttcctcacgcaacgactctaagaatatatcgttatagtcaatgtaaccgcagtcaaaataaggcaatacctcacctgacatacgtggtcactggcgactttgtgagcaccctcatggttttatttttaatcatgatgtctattttcatggtaataaccagacatcttgccgtgcggttaaaaaaataaaaattgagtttatttataacccctgcacgccttaacgttatgctacgtatgttggcggttatgtccccattccaggaggtacagaagtgatctataaatttattgctgacaaacttcgtctccggttaaattcaccctacgtggcagtcggtagtgctataccggctgaaaaagtgctcgccacagaatttggcgtggcgagaatgaccctacgtaaggcaatagatttgctggtcagtgaagggttgctggagcgacgacatggcagcggaacctacgtttcaggaaaggatatttgtcatgaaaccagttcgctcaccgggctggctgaggtattacgtctgcagggaaaggaggttattagtaaagttctggcatttgaattaatcgccgcgcctcccgccgtagccagtcagttacgcataaacagcggtgaacgcctctttttctcacgtcggttacgatatgttgatgaaaagctgctgatgcttgaagaaagttatatgccagttaaaacatttcctgatcttaccctggcccatctggaaaaatctaaatttgactatatcgagcaggaatgtggcattgttttagagggcaattacgaatctttgagcccggttttatcagataagcgcctgtcgcacctcatgaatatcgctgagaaaacactgctactcagagtcgattcgctttcatacagcaatacgggcgcatttatcaactacgcagtgatgtacagaaacacctacgattaccaggttaactatcatttacgacgcaccgggttgagtgactaaagctatcagcagtcttcatcaaggcgcgagcgtgcttcactcccgtgaaagaaaatcaccggttcgaatcgcagtttagtttttgagacagagtttcgttaacacattttaaaatgtcgttaaatttaatgtagcaggcgatcggataaacttgtctgttaatttaacaaaagcgtcacgcataaggaaaatgggggcacttatttcaaattaaggaaaatgcagttctttcctcgtggcacatctttagcgatccactgctgtgctgcataatagctttgaaaaattatcctcctccctatcatccccatgttcaattggttaattaaacttacaagtccttttaaatgaccattcccccagaaactttcaccctacgtacagattttattatttcaaaaatgtgcattttttattaattttttatatattttctgccgataagaaccctgaacttaactttcaggaattctaagatgaaaatctcaacgcgtctggcaataggttttggcctgttaattctgctttttattatttgtattgttatttctttcaaagcccttaattccgccagtgccggtatggatgatgcggtcaatgttaagatgcgcaaatatcaactcgctgttgatatgcgagatgaactgagagatatggctattgcagcgagaaacctcgcgcttcttaccgatatcaaagcaatgcagcctgagtgggagcggctgaaactgcaaaaagcggcttatttaaaaaatcgtgaagcccttgaaaccatcatgcgtacggactccacggccgccgggcgtgccgcgctggaaaaacttcaggtcaatgaagatcaggtgatcgccggtctggaaaaggccggtcagtttggtctggataaccgttcacaagaagccataaattacctgatggtaacggtgcgtcctgctcaacgtgcactactcagttctcttagcgaaatgactaccgttcagttgaataacagccgtaaagcagtcgaagataacagtcgttcaacccgaacctcaacactcattttggttatcctgggcctgctttccatcgtgttttcagtcgtcaccggatttattatcacccgtgtgctgatgcgtcagttagggggcgagcctgctcaggcccagtctattgcggctgcgattgccaacggtgatttgacctccgcagtgctactgcgtcgtgacgatacttcaagcctgttggcctcccttgacggtatgcaggccaggctccgcagcctggtttcagagatcaaaagctcttccgctaacgtcgcgctggccgccgatgaaatcgcacaaggcaataccgaactctcttcccgtactgaagagcaggctgccgccttacaggaaaccgctgccagcatggagcagttaaccgcgacagtgaagagcaatacctctggggcacagcacacagcgacatcagcgcgcgagacagccaatctggctcaacgtggcgaggcagatatgcaacggatgtcggaaaccatgaaagagatttcagacagtgcgacaaagatccgtgatatcaccggcgtcattgaaggcattgcttttcagaccaatattctggcgcttaatgccgccgttgaagccgcgcgggccggagagcagggtcgcggttttgccgtagtggcaggggaagtccgaaatctggcccagcgtagtgctatcgccgccaaggaaataaaaacgctgattgaacaggccgttcaacaggttgcagacggtgtgacagtcgcgagtggaaccggtcaaagtattctgaagattgttaacatggtgggtgaactggcaacggcaatggatgagatctctctggcctcgtccgaacagatgcaggggatttcgcaggtcagcatcgccgtgagtcagatggacagcgttacccaaaacaacgccgcactggttgaggagtcctcctctgcttcacagtcactttctgaacaggcacacgcactgcgtggcatggttgcagcgttccaggtgtagcgccctttagcacaaggcaatgaaacgtgaccgcgccggttacgtttcggccctccggttgcgggggccgggtgctgtcgggtggataacatctcagacaatctgcgccgtcatgtagcgtgcagaaaagcaaaaaaagaccgaacacgattcctgtattcggtccagggaaatggctctcaaggagccgtgcgctaaaagttggcattgatagaggctctcgccttgctaataaagcgtaggacaaccctgtagattttccagccagcgcagcggctcagtccataaacccgacaggtttgtgaccggtaagacaaatttgcggtgattcgggcacgtcaccgtgccctgagtcttattgggtgcacagcgcctgggcgcgttcaacaatcggttgcagactcatcatctgacccggatgtgctttatcgggtgcctgaatcacactgatgggctgcgctgtcacccgcttagcgttgagctgggcatccgctttatcattgagcggatactgcatcagagtactgggattgatggcaaacagcgatccgtctttctcgcaggttaacatcacctcttcacgattaaatggccatttgtctttgccaatttcaaaacggctgacggtgatgatttgcgccgccagcgcctgaccagccagcgttaataacagcagtgtggggatcgctctcttcagcaacataacttacctttatcgggttcttatcaatcaggttggcgacaacgtggcaaacacgctgaccaaccccactacgccgcatgccagcacaatttccagctgagtcatacgaataaacagacgttgcgcagcaaggcccgcaacatgaaagcgcgggaccagccagtagcggttccagagcgcaatcagcaccataagtgacaccagccctgccttgcacaacaacagtacaacataatcattgagatgccagtctactggcgacccggcaatcagcaggctgttaatcacaccggtgacgatcgttaaggctacagcaatgtgaccataacgggaaaaacgcatcatggttcggatggcatcagtccggaattcaatattacgtgccactcgcatcagcaccagcatcggcactaacccgcccgcccagaaggcggcggcgactaaatgtactgcgtggttaccttgttgcagcagtccggttatgccttcgcgcatcgcggcatggccggtgagcgccagggagccggtctgcagcaggccagacaacagccagacctgctgacgtagccgcccgcgcaggattatcgcggccaggccgcacagcgcaaacagtagctgccattgccataccgatccccagcgggttgagaacaccgccaaccagacagacatgtctgacagattatgccagtcgccgctcatcagcacattttgcgtggccagcatccctagcgccgttaacagcgccagccaggcgcttgcctttagcaagggaaacagacgggttgccagtgatggccgaaacgcagcaggcgccagcagcgtggtataaaaggtacttcccaccagcaatatcaacgccgtgaaatgcagcgcgcgcagcaccagccacaacagggtcacagatttatttcacggtaaaagcgtaacgtccgtgcgtcttatgcccatccacggacagcacgtgccagttgacctgatagctgccctgcgccagcggttgggcaaaatccaccagcaggcggttgtgctgcttgccatccagccgggccttttcgcctacggctttatgctgtgcattggttacctcaacgccactgaatgccgcttccacatcttcggtgaaggtcagcgtaatgttctgtggggcgggtgaaaccgccgcgttggctgcaggcgtcgaagactgcagatgcgcatgggctagcgcgaactggctaaaagccagggcaccagtggcaaccaggccgattaccacacgagaaatcgctgttttgttcatcacatcatcctgttagctgtcgttaaggccacgagcgtggcgcaagaatacgccgcagcgatttaactgtcgaggccagcaatgctatcctgtaccttgcgctatgcggaggaaaacattccgtttggccacgtttatcgggagaacatcatgagtcataaccttgccttgctgtcgcaggaagagaaagacaaagttaatgtcgatctggcggcggcaggcgttgcgtttaaagagcgctataacatgcctgtcgtggctgaaatggtcgcgaatgaacaaccagaagccctgcgcgactggtttcgtcagcgtttaatgcattaccgtcaggcctctctcaacttgtcacgcctgccctacgagcctaaacagaaataatgatgctacgcgtaattgatacggaaacctgcgggctgcaaggcggcgtggtggaggttgcctcggtcgatgtggttgacggccagatcgtcaatccaatgagcgatcttgtgtcacctgaccggccaatcagtcgtcaggccatggccgtgcaccgcattacggaagccatggtcatcggcaaaccgccgattgaagaggccgtcgcccgctatcacggcagtgccttttatgtggcacataacgccagtttcgatcgccggatgttgccggaaatgcacggcgagtggatctgcacgatgacgctggcacgtcagctgtggccgggcatcaaatatggcaatcaggcgctgcgccatagccttaagctggaagttaccccgcccgcggagttacatgcccaccgggcactttacgactgctatgtcacggctgccctgctcatcaggattatggcgatctccggctggaatgcggaagaaatgtgtcaacgctcgcagcctgccgctcaacgtgatgatgtgctgccatttggcaagtatcgtggtcaggcgttggccgtgattgcccgtaaagatccgggttatttgaaatggatgctggataacgtaaaagatttgcgcccaccattgcggcaggcgctgcgtaaatgtcttagtcagcttccgtaagatctgccggtggcaggctaccctgcgcaagggcgacaatgaaggtgagctcaagggctacgccttcataagccttatatcgacccgacttgccgccatgccccgagtccatgtcggtacacagcagcagcagattgtcatccgttttatgctcccgcagttttgccacccacttagccggttcccagtattgcacctgtgaatcatgcaatccggttgtcaccagcaggtggggacaggtttttgcttcaacattgtcataaggactgtattgccggatatagcggtagtattccgcctcattgggattgccccactcctcatattctccggtcgtcagaggaatagactcgtccagcatggtggttaacacatcgacaaaaggcacctgtgcgaccacgccatgataaagcgttggggccagattaatgatcgcgcccatcagtaatccccccgcacttccgcccatcgcgtaaagccggtctggatgaccgaatccgcgagccacgagcgcattcgtcacatcgataaaatcggtgaagctgttcattttattcagcagtcgaccaccgtcataccactgctgtcccatctccccgccgcctcgcacatgcaccagcgcatagacaaaaccgcgatccagcagactgaggcgactgacgctaaaatcagcgtccatgctactgccataggcgccgtacccgtaaaccagcatcgggttttgccccttctggaaatacttgcggttgtacaccagcgagaccggtacttctgtcccgtcagagacggtgatccaatggtgctcgcttttgtaatcatccggattaaagtcttttaccgcactctgtttcaaaatgcggcgctcgcccgtgtccatatccagttcaaacaacgtggcgggcgtggtcattgacgaataaccatagcgcagcttgctggtgcgggtcgtggggttgtatgccagccaggtgacataggtgggatcgtcaaacgcaatgccgctggtttctcccgtttgccagttgatttgccgcaggctggtcagcccacgctggcgctcttccaccaccagccagtcacggaagagctgaaagtcttccatcacaatatggtcgcgcgccgggatcacggtttcccaacgtgactcctccagatagcggctgcgatacaggccgaagtttttcccatcgcgattcgagcgtataaaaaatgtatggtcataatgatcgagactgtattcgtgatcgcgccgtctgggcaaaaaaacctgtggaatagcgtccgggaaactggcatcaatcagctgaatttcactgctgctggtgctgtacagcacgaccaggatgaattgtttcgatgtggttttatggatgctgaggtgataggtatcgtctttttcttcgtaaactaaccgatcgtcgctctgcggcgtgcccaactcatgttgccagagctggtaaggcaacagggtttgcggatgtttacgtacgtaatagagcgtgcgcgaatcgctggcccacgcgaagctggaggacgcatcgttgagcacctctggataccaactgccgttatccagattgcgaaagcggataccgtactgacgccgggaaagaaagtcttctgccagcgccattacccggttatccgggctgatgtgcagcgcgcccatggtgtaaaaatcactgtgcgacgcacgctgattcgcatccagcagcaacgtccacgcctcgctctcctcgctggcggctggctgtcggtaataggcagcgtattcattgccgctttcataccggctttgatagcgatagccatttttcacataaggtacggagtgatcctgcggtggcaggcggtcgataatttcatgcagaatacgatgctgtaagggctgctgtgaacccatgattttttggccgtaattgttctcagcgcgcaaatagtccagtacgtcgctgtcttcacgtctgtcatcacgcaaccagtaataattatcaacgcgcgtctcgccatgcaacgagagttcataaggtattttttttgcgctcggtgctttcatgtcatccgtcccgctgaatgtaatgaacactaagcgtggcactaatgtaatcagatgccaagttaagtaagaacattgttaattaattcagggccatgtggcggccctgttcgggattagctggctttctgctggaggatatcttgctgaatgccatcacggacatcctgtgggatttttaacgcatcgcccagtgccgatagatagctgcgctccataaaatggtccacatcaatggcggcacagctcagaaaatagagttcaagcgcctcttcttcatttttgacatcagcggcgagccactcagggtccagcggtcgctgcatagcctgctggatgagcgtttcggcatcctgaccgtagcctgcctgatggatattttgctcaatcgctgcgcgttcccgatcgtcgatatgaccatcacttttggcggcaaagaccagagcggttaccagacgttctgcccgctgatccacaggcgtttgccattcgccaaagccggggtcattctgatgggtttcccgcacccgttgtttgtatttgttccacagtacagcccctgctgctgcaccgccgccgataatcaatgctttgccgccatagcgggttaacaacttccgggatgatttgctggccaccagcatgcccgccagcccacccagtgcacccggagccaacatatcgctcaatccaccgctggatttgccatcgctgctttttgtagccagtagcgattgaatctgttgcagccagttattcatcgttcactcccttaaccattcggaaacatcatcattaccaaaaagatgtcaggaaacgtcagagcaggaaaagtagcgcaaaccctgcctcaacagcagaaggggtgagaacgcaaacgttttcgtatatactgcgcgcgcattttgactgctttgattttaggtggatttatgacgactctcggaactgcgctgcgccctgccgcaacgcgcgttatgctgttgggctcaggtgaactgggcaaagaagttgcgctggaatgtcagcgtctgggtgtggaagtgatcgcggttgaccgctatgccgatgcgcctgcgatgcatgttgcccatcgcagccatgtgattaacatgctggatggtgatgcactggccgccgttatcgcgcaggaaaagcctcactttgtcgtgcccgaaattgaagctatcgcgaccgataagcttctggagctggagcagcaaggccagcacgtggtgcccactgcacgcgccgcgcgcctgaccatgaaccgcgagggcattcgtcgtctggcggcagaggagctggcgcttcctacctccagctaccgttttgccgacagtaaagataattttgtgtctgccgccgccgagatagggtttccatgcatcgttaaaccggtgatgagctcttcaggtaaaggtcagagctttatccgggatgccagccagctggaaaaagcctgggactatgcccagcaaggtggccgtgcgggcgcaggacgcgttatcgtcgaaggcgtggtgaagtttgattttgagatcacgttgctgaccatcagtgccgttgacggcattcatttttgtgcacccattggccatcgtcaggaagacggcgattaccgcgaatcctggcagcctcaacagatgagcgaactggcactgcaacgtgctcagcatatcgctgaaaccgtggtaaaagccttaggtggctatggactgttcggcgtggagctgtttgtctgtggcgatgacgtggtattcagtgaagtctcaccccggccgcacgataccggtatggtgacgctgatatcacaggacctgtctgagttcgcccttcacgttcgtgcttttcttggtctgcccattggtgccattcgtcagtacggcccttctgcgtcagccgtgatcctgccgcagttaaccagccagaatgtgcagttcgtgaatgtggaagccgcgctgggtgcaggtttacagttgcgtctgtttggcaaaccggacatcgagggtcagcgccgtttgggcgtcgccctggcctgtgctgatacaaccgaagaagccgttgcgcgcgcggtcgccagcgcggcagcagtcagcgttcagggttaatgccgtttgcggtgagtccgggactcaccgcacacttttgacttgctttacttcgcgccagcgacggcgtcactcgccagttgggtaatgcgttgccagtcacccgcttccagtgcatcgttgggcaccagccaggagccgccgatgcaaagcacgcttttcagcgccagatagtcacggtaattcgctggtgagataccgcccgtcggacagaaacggacctgagggaaaggcccgccgatagcctgcagcgcttttaccccgccgttagcctccgccgggaaaaatttgaattcccgcaaaccataatccatacccgtcattaattctgacaccgtgctaatacctggaatcagcgggatcgggccttccaccgcagccttgagcaacggctcagtaatacccggactgatcacaaactgagcacccgcgtctgtgacttcctgcagctgttgagggttaagcacggtgccggcccctacaatggcgtcaggcacatgtttgataatggcacgcagtgcctccatcgccacgggggtgcgtaacgtcacctcaagcaccttgacgccgcctgcgaccagcgcctgcgccataggaaccgcatgttccagtttattaaccacaattaccggcacgaccggtccggttttcagaatctgttcggcactcgttttccagtttttcatcacatcccctgatgcataacattgggagcggcacgccggagaaaacacagcgtcagccctgttaacagcgctactaccatacaggaacaggggtttatccgtctattgcaggttgagatttttaaaacggcagttcatttttgagagtgagtgcaaaaaaaagcccgcacgcggcgggctgaggcatttattcaaattcgttccaggaacgaccatcacgggtaatcatggcgacggaagcaaccggcccccacgtccctgcctgataaggcttggatgaatcgccatctgcggcccatgcatcgataatcgaatccacatacgtccaggcggcttccacttcatcgcgacgcacaaacagcgcctgaataccgcgcatggattctagtaacaggcgctcgtaggcatccgccagatgagactggttgaaggtttctgagtagctcagatccagcttggtggtttgcagtttatgtttgtgatccaggcctggcactttgttcaggatctcgatatcaacaccttcgtcaggctgcagacgaatagtgagtttattctgtggtaactgagagtaggaatctttgaacaggttcatctcagggtttttgaaatacaccacaacttctgaacactttgtcgggagacgtttaccggtacgcaggtagaaaggtacgcctgcccaacgccagttatcgatatccacgcggatagccacaaaggtttcagtagcgctggttttattcgcgccttcttcttccaggtagcctggtaccttcttgccctgcacaaagccagacgtgtactgaccgcgcaccgttttttcgcggacgttggtttgatcgattggacgcaacgagcgcagcactttcactttctcatcgcgaatactgtccgcgctgagatcggaaggtggagacatggcgatcatcgtcagaacctgtaacaaatggttctggatcatatcgcgcatctgcccggctttatcaaaatagccccaacggccttcgataccgacttcttcggccacggtaatttgcacgtgatcgatcgtgcggttatcccagttattcacaaagatggcattggcaaatcgcagggctaacaggttcagcaccgtttctttgcccagatagtggtcgatgcggaaaacctggctctcgtcgaaatattcgcccacgctgtcgttaatttcttttgacgtttccagcgaggtgcccagcggcttctccatcacgacacgcgccggcttgtcattcagcttcgccttgcccagtccctgacagatggcaccaaaggtgcttggcggcatggcaaaatagttgatggtggtacggtttttctgatccagcatcttacccagtcgtgggaaatgcgaggtatcattcacatcaagattacagaagtcgagacggctgctgagcttgtcccagagcgcttcatcaatcttttccttcatgaaggtttctaacgcttcacgcaccactttggtgtattcagctttatcccactcagcccggcccacaccgatgattcgggtttcttcatgaatctggcccgctttttctaactgatacagcgagggcaatagtttacgacgggcgagatcgcctttggcgccgaaaattaccagatcgcatgcctgggctatttgtgttaccgccattttcctctcctcgttgcaggattgtcccggtggcgttgcgtcctgagcaccgggttcacgttgtcatgttctttcagcacaatgtacttttttccccaggccaggtaaaccagccagcggcgtcgcgacgctaactctgcacccaattagcatctgaggtaggttgacccgtgcgctttcctctatttttctgtgtcaaatattgtctggcaaaaatccagcgtgggcctgattatcgcaaaaaaaagtgctgcagacttatcagaccttgcgcccctgtcggtcaggcagggtatattctctgttaattaactgtaacaacagcaattattcattttaacagatacgccatgcttagcaggtcaggactatgttggataaaattcgtgcgcagatgactgtgctcagtaagtcagaacgtaaagtggcacaccatattctcgccgcacctgagcaagcgatacattccagtattgccacgctggctcgggcagccgaggtcagtgagcccacggtaaaccgcttttgccgacacctgggcacggcgggtttccccgactttaaacttcagcttgcccaggccctggtgaagtcacctaactggctgagtcgggatgtgcaggaagatgacagcgttgagcgctacagcgagaaaatcttcgattccgccctggccggtcttcagcgggtacgggacagcctcgatcttgctgccctgcaacaggccgtggtttatttaacgcgtaccgataaaattaccttctttggtttaggtgcgtccgccgtggtagcgcatgacgccttcaacaagtttttgcggtttaagctgccggttatctggtcagacgatgtggtgatgcaacgcatgagctgtatcaacagccgtgacaacgaggtgtttgttttgatctcccataccgggcgcacccgcaatatggtcgagctggcgcagctcgcgcgcgccaacggttctaccgttatcgccatcacgtcagcaggctcgccgctggcgcttaacgccacgctggcgctgctcgtcgatgtgccggaggacaccgatatctatctgccaatggtctcgcgactggctcaactcaccgtgatcgatctgctggctaccggatttacgctggaacgggggccatccttccggcagaacctgaagcgggttaaagaagccctgaaggcctcgcgctacgacaaaaccgctatcgccgataacgatatctcctgattcaccggctggtcgggcagcatctggctggcgcgtagcctgtgcgaaaaagcgacctggcttgcgtctggtcaattaagctttcgctaaagccgtccaggggatgacttccttggtgagtctcagtattgtatctaagaaaaatgcctttactttacttcgttaaggcccggtgccacagttctgacacactcgaatgtataataatacctctgtgtggtaagcatgatctgataggttaaccccttaaaatgtaatgattcagctcagttccaacctccaaaggaatccctatgtcccgacgtttaagaagaaccaagatcgtaaccaccctcggcccagccactgaccgcgacaataacctcgaaaaaatcattgctgctggcgctaacgtcgtgcgtcttaacttttcccacggcaccgctgaagatcaccaactacgtgctgacaaagtgcgccagattgcggcaaaactggggcggcatgttgccattcttggcgacttgcaagggcctaaaatccgcgtttcaacctttaaagaaggcaaagtcttcctgaacgtcggtgaccctttcctgctggatgcgtcaatggggaaaggcgaaggcgataaagagcgcgtgggcatcgactataaaggtctgcctgaagacgtggtgcctggcgatatcctgctgctggatgatgggcgcgtacagttaaaggtgctggaagttcagggcgtaaaagtctttaccgaagtcacggttggtggcccgctctctaacaacaaaggcattaacaaactgggtggcggtctgtcggcggaagcgctgaccgagaaagacaaagcagacatccttactgcggcaaaaattaacgttgattacctggccgtttcctttccgcgctgcggcgaagacatgcactatgcacgtcgtctggcgcgtgatgccggctgtgatgccctgatggtcgccaaggtggaacgtgctgaagcggttgcctctcaggaagccatggacgacatcattctggcctcagacgttgttatggtcgcccgtggtgaccttggcgtcgagattggcgatcctgaactggtcggtatccagaaagcgctgatccgccgcgcccgccagcttaaccgtaccatcatcaccgcgacccaaatgatggaatcgatgatcacaaacccaatgccaacccgtgcagaagttatggatgtggccaacgccgtgctggatgggacggatgccgtaatgctgtcagctgaaaccgccgcaggccagtatcctgctgaaacggtagctgccatggcaaaagtctgtctgggtgcagaaaaaatcccaagcgttaacgtctccaaacaccgtctggacgtacagtttgacaatatcgaagaagctatcgctatgtcggcgatgtacaccgccaaccacctgcagggtgtaaccgcgattatcaccatgacggaatccggtcgtacgcccctgatgacttcgcgcattacctctggcttgcccatcttcgccatgtctcgtcatgagcgcacgctgaacatcacggccttattccgtggtgtcacaccggtgttctttgacagcaacaatgaaggcgtggctaacgcccatgatgcggtaaatctgctgcgcgacaagggcttcctggtgtctggcgatctggttgtggtaacccagggtgacgtcatgggtgccaccggcacaaccaatacaggtcgtgtgctgcgcgtcgattaattccgcctttttagcctcacctgtattaccattggaaacgcgactgccctgcagtcgcgtttttgttttttgacaaggaggccggatggcccgttaccaacccatcagccagctcactggtcgcatgatgctgtttccgctggcgatggtgctgtacgaatttgcgacctatattgctcacgatatgattcaacccggcatgttgctggtgactgccgaattcgatgtaggcgcagaatgggtatccacctctctcacagcctatttactgggcggcgttgtgctgcagtggttacttggcccgctgtcagataaatatggccgtaggccagtattgctgtttgggattctgtttttcgctgccgcctgcattctgaccacctgggtcagtgatattcaggagtttgtcagcctgcgtttcgtccagggcatcagcctgtgttttattggcgcggtaggttatgcggccatccaggaagcttttgacgaagccttagcggtgcgcatcatggcgctgatggcaaacgtggccttactggctccccttgccggcccgctggcgggcgcagcctggctgacagtgggaagctggcgcagtatgttttggctgttcgccgcctgtagcgctgtggcatttatcgttttatggcgcgtcatgcctgaaaccgccggggatcgcacccagtctgttgcgctgcctgtgctggcacgcaactacggccgtcttctcaaagatcgtcaggtgatgtttggctctttcgctattgggctggtgtttatccccatcctgacctgggttgcgctgtccccggtgattttaatgcgggatgaagggctttcccgtatgcagtacgccctgctccagctcccggtttttctggcgatgatcgccggcaacgtgacgttgagtaagctggtaggccggatgccgatagaacagcccgtcaggtttgcggcatggccgatactgctgggcctgagtctcgccctgttagccacactgcttaacgcgcacagctacctgtttattacggcgggactcagtttgtatgcgtttggcggcggcatggtcaatgccggtctttatcgcctgacgctgtatgccagcgatgagggcaaaggcagcgtagcggcgatgctgggcatggtcagcattatgacgctggccacgggcattgaactggctaagcatttttattttaacagcggggtgatcgggtttagcctgattaactttatcagcggcatactgtggtttggtttggtgctgatgtttctgcgcgaacgtaagcgccacgcaaaagtgacgccactttaaatcatgcaggccgccttgcggcctgcatgttatttgcgcggatacagctcgtcacgcgaatagggttctttgtctcccgctttgcgtgttttaagcagctttaatatccaggtatattgttccggatgagggcgcacaaacacttccacttcttcattcatccggcgagccaactgacggtcatcggcttccactaaatcgtccatcggcggacggacataaatttccagcttatggctttcggcattataaaccggaaacatcggtataacccgcgcgcggcagactttcatcaaccggccaacagcaggcaacgtggctttataggtcgcaaagaaatccacaaactcgctatgttcagggccgtggtcctgatcgggcaaataatagccccagtatccctgacggatcgagctgataaagggtttaatgccgttttcgcgcgcatgcatacgtccaccaaagcggcgtcgggcgcggttccagacataatccaacagcgggtcgctctggtgatggaacatcgcagcaatgctttgcccttctgacgccagcagcatggcgggaatatcgatggcccagccatgcggcaccaggaaaatcacgttttccttttcggcgagcatctgatcgataatttcacgaccgtgccactcaacgcgttttcgcacctgagccggatcgcgcatgcccagttccgccatcattgccatggcctgtggcgcagtcgcaaacatctgatccacgatcgcttcacgctgagattcactgagttcaggcaggcaataatagagattaatcagcgcacggcgacgcgctcctttcgccagctttccggcaaatttacccagccgccccagaagcggatcgcgcatttttgccggtactaacgcaataccagccagcgcaccaatgcccagccaactgccccagtattttggttttaaaaaagaaagttcaaaaacgggaataaattcactgttattttttttacgggtttccatgcactcgcctcaatcaatgacgggctaatgatagtggcgacgagtaaatttgcaatcatcctgcgccagagataaaaaaagtcgacggcaataccgtcgactttatcaaaaacttacttcagtcccaactggggtagccagcctttcacctgagcaagatactgtgttcgttctttacccgccagcccttccatacgcggtagcttggccgttaaggggttcacagcctggttattaatccagatctcgaaatgcaggtgtggaccggttgaacggccggtgttgccagagatcgcaatacgatcgccacgcttcactttttgccccggtttcaccagcacttttttgaggtgcatatagcgcgtcatatactgacgcccgtgccgaatggcaacatagttaccggctgcgccgccatttttggccaccacgacttcaccatcgccaaccgccagaacaggggtaccgatcggtaaggcgaaatcgacgcctttatgaggcgcaatgcgtcccgttaccggattaaggcgacggggattaaaattagacgacacgcggtactgcttgacggtcgggaagcgcataaagccacgagccaggcctgcgccactgcggtcatagaacttgccgtcatccgcacggaaggcgtagtaatctttacctccactgcgtaaacgcacacccagcagttggctttgagcactcttgccgtccatcatttcacgtgacatcagcacgctaaacttatcgcctgcacgcagcttacgaaagtccatttgccactgcatcgctttgatgacgctgctggcttcaccactggtcaggccggcacggcgggcactggcggcaaagctgccgtgtacctcaccctgcatcacgctattgcgccattcgccctgctgcatctgcgactgcattttaaagccaccgttatcggtgcgctcataggtgcgggtttcccgacgcgaaatttcccaggtaaaggtgttcagtgcgccgtcgtcgtttaacgtccagctaagctgctgaccgacctgtaaattacgcagatcacgatcgctggaggccagggcgttaatatcgcccatgtcgataccgtactgattcaatgcactactgagcgtgtcaccagaagaaaccgtgtattcatgcgtaccagcgctgtctgcaacatcctgatcgacatcatccgcaggaagctcttcatccggttcaggggtgctttgatcgatgggttcactggcttcaggaagcagtgtccgaaattcgtttttgtccagttcgatagttttgacgatgggggtcacatcgttactggggtggtagacgtaaggccgccagactgcgacggccaaagtgacaacggttaacgatcccagcataacgcggtgggggcgcggcaaattattaaatgcgagggcgacagagcgggctatctgctgcacgttgaactattcctctatgctcctttcaggcaggtctcatactggctcgacaactgtgagaggaatttcacatagctgtcttttcctaagctgatgtctgtgcccagtggatcgagcgtgccttttcgcacctgggttccacgggcaacagcatcgatgaccgccggcctgaattgtggctcagcaaagacgcaaacggcctttttctcaaccaactgtgttcgaatttgatgtaagcgctgtgctccaggctgaatttctgggttaacggtaaaatgccctgtgggcgagagaccgtagtgtttttcaaagtacgtgtaagcatcgtgaaaaacgaaataccctttatctttaaccggagcaagctgtgagataatgcgcttatctgtgttcgctaattctgcctcaaagtgctgcaggttggcgtcaagtttggctttatcctgcggcataagttccaataatttgccatggattgcaaccgcggtttttttcgctatctctggtgacatccacaagtgcatattaaactcaccatgatgatggtgatgctctgcatcgtgatcgtgctcagtatcgtcgtggtcatgatgatcatcctcttcaccaccgcggagcagcatcggttttacgccggaaatttgcgctatctcaagattctttttctcgggcagtgctgcggccgatttggtcatgaaagcttccatttcaggaccaacccaaacaactaactccgcgttttgtaagcgttttacgtcagagggacgcaaggcataatcgtgttcggatgccccatcaggcagcaaaacgtccacgggcgtcacgccatcagcaatggccgaggcgataaaccctacgggcttaattgaggccacgatagtggcatgcgcaggtaagacagcagaggtcgcaaaagccatcgcagtcagggtaaaaaataccccttttttattatgtaacataatgcgtcattccttcgtcatcaacagattggatgtgatattataacattcgaaattctgtgcaacctgtaaatcttatgccatcacttgtcacacttgagaacgtatccattagttttgatcatcgcccggtgttatctggcgtgagtttagaacttcatcctggtagaattttaacgctgctgggtcctaacggcgcgggtaaatcgacgctggttcgggtggtacttggcctgcttgcgcccacgtccggtcaggttcgccgaagtgcggacttgcgtatcggttacgtgccacagaaactgcatatcgatcctacgctgccggtgacggtcgagcggtttatgcgtttgtcacgtggcgcccgtaatcaggatattttgccggccctgaagcgcgttcaggccggacacctgctgaaatcaccgttgcagaaactgtcgggcggcgaaacccagcgcgtgttactggcccgcgccctgctcagtcagcctcagttgctggtgctggatgaaccgactcagggcgtggacgttaacgggcaagtcgcgctttacgatctgatcaatcagctgcgtcatgaactgaattgtgccgtgctgatggtttcccatgatttgcatttagtcatggcaaaaacggatgaagtgctctgtcttaaccatcatatttgctgttcaggtacgcctgaagcggtgtcacagcatccggagtttatcgcgatgtttggaccgcgtggcgcgcaggaactggctatctatcgtcatcatcataatcaccgtcacgatcttcagggacgtatcgtattacgcaaaggaccgggtccatcatgattgaattactgcttccgggctggctgggcggcgtgatgctggcgctggcggccggtccactgggctcgtttgtcgtctggcgtaagatgtcctatttcggcgatacgctggcgcatgcctcactgctcggtgtcgcttttggtttactgctcaacgtcaatccctattacgccgtgatcatggtgacggtctgtctggcgttgggtttggtctggctggaacgccgcccacatctggcgattgatacgctgctggggattatggcacacagtgcactctcacttgggctggtcgtggtgagcctgatgtcgaatgtccgggtggatttgatggcctatctgtttggtgatttgctggcggtaacgcccagcgatctgtgggcgatggcggctggcgtgctgttcgtcctggccgtgatggcctggcagtggcgcgcactgttgtcgatgaccatcagcccggagctggctcaggttgacggcgtcaatattcaacgcacccgactgatgctgatgctggtaaccgcattgaccattggtgtggcgatgaaatttgttggcgcactgatcatcacatcgctgctgattattccggccgccactgcccggcgctttgcccgttcacctgaaatgatggcggcggtcgccgtactgattgggatcatagcggtaaccggtggattaaccttctcggcattttatgacacgcctgccggcccttcagtggtgctgtgcgcagccatactttttatgctcagcatggtgcgcaaaccggcgctgtaatcacgcgtctttggtgataccaaagtggcgataggcatgctgcgtggccatccggccgcgcggtgtgcgctgaataaagccctgttgaatcaagaatggctcgatgacatcttcgatcgtttcccgctcttcaccaatcgccgccgccaggttgtccagccccaccgggccaccggtgaatttatcaataatggccagcaacagtttacgatccatatagtcgaagccttcactgtccacattcaacatattgagtgctgttaccgacacctcgccgctcagaagaccatttgcacgcacctccgcaaaatcgcgtacccgacgcagcaggcgattggcgatacgtggtgtgccccgagagcggcgggcaatttccagcgcggcttcttcgctcagcgccaggccaaggcaggcggcactccggcctacgatatgctggagatcttttacctgataaaactccagacgctgtacgatgccgaagcgatcgcgcaagggcgaggtcagcgagcctgcccgcgtcgtggcaccgatcagggtaaagggcggcagatccagtttgattgagcgcgctgccgggccttcgccaatcataatatccagttggtaatcttccatggccggataaaggacctcttccaccaccggcgaaaggcggtggatctcatcaataaacaacacatcgtgaggttcgaggttggtcagcatcgccgccagatcgcccgctttctccagcaccgggccagaggttgtgcgcagattaacgcccatctcgtttgccacaatattggccagtgtggttttacccaatccgggcggaccaaaaatcagcaaatgatccagcgcatcgccgcgcagttgcgcagccttgatgaaaatttccatctgctcgcgcacctgaggctggcccacatattcggtcagcattttcggacgaatagcgcggtcgaggccctcttcttcgttaatgctgacagcggagatcaggcgatcggcttcaatcatgaattacctcaaatagcagcgcggagcgcttcacggatcaacgtttcgcaatccgcatcagggcggccaactttgctgatcatacggctcgcttcctgcggtttataacccagggaaaccagcgctgcaaccgcttccgcttctgcgtcgttggtctccggctccgggccaggcgtggtaagcgtaaaggccgaatccccgccaaacagatcgccatgcatgcctttaaagcgatctttcatttccaccaccagacgttcagcggttttcttgcccacgcccggcagtttaaccagcgcggcgatctcttctttttccactgccgtgacaaactgctgtgccgacatgcccgacagaatcgccagcgccagcttagggccaacgccgttcactttaattaactcgcggaacagcgcgcgttcctgcttgctgttaaacccaaacagcagttgcgcatcttcacgtaccacaaattgggtgaagatcaccgcttcgtgattaagatcaggcagttcataaaaacaggtcattggcatatgtacttcatagccgacgccatgcgcctcaagcagcaccagcggcggctgcttttccagaataatgccccgtaaacgaccaatcacctgatgccttccttatccaaagtatgtggcggaatttataccataaaaaaggctggatgaatatccagcctgatagcgattaagatgcggttactgttaactctggcgcaatctgccacggctcagcaccagcttgctgtcactcatgcgcgccgcgttttgtgcaacgtggcagtgcgtgatggcgattgccagtgcatcggcggcatcggcctgcggattcgccgccagtttcagcagggatttgaccatatgctgaacctggcttttttccgcaccgcctgtgcccaccaccgtttgcttcacctgacgcgccgcatattcgaataccggcaaatcatggttaaccgccgccacgatagcagcacctcgcgcctgccccagcttcagggcagaatccgcattcttcgccataaaaacctgctctatcgcgaaaaaatccggggaaaactgcgtaatgatttcgcaaaccccggcatagatcagcttgagacgtgctggtaattccgttgtgttggtacgaatacagccgctgcccagataagtgagctggcgaccggtctgacgaatcaccccataaccggtaacgcgtgagccggggtcaatccccaaaataatcgacataacgcgtctccagcctgagcatgcggcagtacagcattaaagcgtttccgccacctcgtcggagatttcaccgttatggtaaacctcctgcacgtcatcacagtcttccagcatatcgataagacgcagcagtttgggggccgtttccgcatccatttccgctttagttgacgggatcatcgccacttcggccgtgtcggctttcaggccagccgcttccagcgcatcacgcactgcacccatctcttcccacgcggtaaacacgtcgatggcaccgtcatcgtaactgaccacgtcttctgcacccgcttccagcgccgcttccatgaccgcatcttcatcatgtcccggtgcgtaggagatcacgccttttttgctgaacagataggctacggagccgtcggtgcccaggttgccgccggttttggtgaaagcatgacgcacttcaccaacggtacggttgcggttgtcactcaggcactcaatcatcacggccgacccgccaggaccgtaaccttcataaatgatggtttccatattggaatcatcttcaccgcccacgccgcgtgcaatcgcccggttcatggtgtcacgcgtcatgttgttggacagcgctttatccatcgccgcacgcaggcgcggattcgagccaggatcgccgccgcccagtttggccgccgtgaccagctcacgaatgattttggtgaagattttaccgcgcttggcgtcctgagccgccttgcggtgcttggtattcgcccatttactgtgtccagccatcttactttctctccaatcttttatttcgcccgagctatctgacgtgcgaacccgactcccgccagtgctcacccaggttgcagacaacctgaacgcccggaaaaggcggccccgaaggggcgagcatcacccgtcatcctcacgtacccaagtacgcgtcggttgcggtacgctggcggtaaccggcctcgctgcgccgattgcgctcgactgttcaatgcgttggtgaagttgtgtgaaaacttacccgcttcataaaacttaatgcattcgccgcgcaaataacgcgttgcggcaagcattcaaataaattcttcaatcgcctgacgattactccaggacttagtgagggccgcggcggcggcaggctcaagccagcacgcggcaagatgctcagtgagcagcaggtcgcgctcagtcggtaaggtcaatctgaaccagtgctcacgattgtgcgtggtgccgggcgcgtaacgatgccgatagtgcgggaaaatctcaaagtcgatttcacgctgacagtcttctattgttagctgctcggcctgcacatcaatgcctaattcctcacccacttcgcgctcagcggcctgaagcggcacttcatccgcttcaaggctgccggtgaccgattgccaaaagtccgggtcatcacggcgctgcagcattaacacccggccactgtcctgcgcaacaatcaccactaacacagaaaccggatgtttatacggcattacttattctcaagcttatctttcttcaagactttaatgcctaattcaagcagtgaggccggattggcttcgcttggcgcttcagtcatcatacaggccgctgccgtggttttcgggaaggcgataacgtcacgaatattatcggtaccggttaacagcatggtcagacgatccagaccaaaggccaggccagcatgcggcggcgtgccgtacttcagtgcatccagcaggaagccaaacttctcacgctgttcatgctcttctatgcccagaatgctaaacaccgtctgctgcattttaccgttatggatacgcacagaaccgccgcccacttcatagccgttgatcaccatgtcgtaagcattcgctacggcctgggtaggatcggccgccagctgttccgcactcatcgctttcggtgcggtaaacgggtggtgcattgcggccagaccaccttcgtcatcttcttcaaacatcgggaagtcgataacccacagcggtgcccaggctttctcatcggtgatctgcaggtcgcggcccactttcagacgcagtgcgcctaacgcatctgccaccactttggcacgatcggcaccgaagaagaggatatcgccatcctgagcgccggtgcggctgagaacggtttcgacgatctcagcgttaaggaatttcgccaccggactctgcacgccatccagaccgttcgcgcgttcatttaccttcatccatgccagacctttggcaccgtagatctcgacaaacttgccgtattcatcaatctgtttacggctcagctgcgcaccgccgggaacgcgcagcgcggcaacacggcctttctcgtcgttagccgggccggagaacacctggaattccaccgttttcagcagatcgccaacatccaccagttccatcgggttacgcaggtccggtttgtcagacccgtagcgatgcatggcttcggcaaaggtcatctgcggaaactcaccgaggtccacgcccttcacgctctgccagagttcgcggatcatgcgttccataatctcacgcacctgcggcgcggtcaggaaggaggtttccacgtcgatttgcgtaaattcaggctggcgatcagcgcgtaaatcttcatcacggaagcatttgacgatctgataatagcggtcaaaacccgacatcatcagcaactgcttaaacagctgcggtgactgaggcagtgcgtagaacttccctttgtgcacgcggctcggcaccaggtaatcacgcgcgccttccggcgtagccttcgtcagcatcggcgtttcaatatccaggaagcccgcctcatccataaagcgacgcacaaagctggtgattttcgcacgggtctttaagcgctcaaccatttccggacgacgcagatcaagatagcggtacttcagacgcgcttcttcgctgttgttctgattggaatcgagcgggagcggttcggagcggttaatgatattcagcgtttcggcaaacacttcgacttcaccggtcgccatatcggcatttttgtttttcccgtcccgcgcacgcacagttccgctgatctggatacagaattcgttacgcagttcagaagccagcttgaatgcatcctgacgatcgggatcaaaaaatacctgcacaataccttcacggtcgcgcatatcgataaaaatcaggcttcccagatcgcgacggcggttgacccagccgcaaagcgtgacttgctgacctacatgagacagattgagctgtccacaatactctgtacgcataacactatccttttaacttcgccgctgcagctgacagcaccgggccgcgtaacctgatgaggtgctgtcgtaaaaaaggccgctattataatggaaaaaggcaaacaggataagtggagccacgttaaagcgcggcatttcctgttcgcttttcacctgtttgcgtcaatatactgccttacaggataattactatcacactcaacggcgggagtcaggcgtgacacttcgtattggtttgccacaatggcaccatgcgcactggaagcgatggggcatcgaaaccctggctgactatgcgcgttatttcggcacggtggagggcaataccacgctgtatgcgctgccggataccgaaacggtcctgcgctggcgggatatgacacatgaccagtttcgtttctgttttaagtttcccagcagcattagccatcaggcagctctgcaaaatactgacgatttagtcaccgacttttttcgcctgatgacaccgctcgccgatcgcattggtcagtactggttacagctgcctgccagcttttcgcccgcccagttgaacgatctctggcgctttctggacagtttaccggcgcatttttcctatggcgtagaagtgcgtcatgccgcgttttttgccaaaggtgaggcagaacgcgccctgaaccgcggtctgctgcagcgtggcgtgaatcgcgtcgtactggacagccgcccggtccatagctcaacctcgcaaagtccggcagcgcttcacgcccgtcagcaaaagcctcgcgttccgccgcacgcgctgttgaccggttcgcggcccatgattcgctttgtcggcagcgacaatctggaagaaagcctgccactgtttcacatctggctgacaaagctggcggaatggcacacccagagtgaaccgctggtgtttattcacacgccggatatgggacaggtttttccgctggtgcaggctttatggcctgaactccaaaaaattgatgccagcatcggtcccggacctgactggccgcaacaggattcgctattctgatagcaatgggcagcctcgccccctctggtgatatcgataaaaaaggaatcaatgatgatcagcgcgttatatgtggttataggtgctttactgataatgaagttcacgctcaacgtcgttcgctttcggcgtcagcacaaggttgcctttggggatggcggccatcacgacctgaatatggctatccgcattcacggcaatgccattgaaacgattcccctggcgttgctgctactcgtgaccctggaaatgaacggcgcagatgtctggatggttcacctgacgggcatcctgttttttattggccgtttcctgcacgcttatgggttgcgcaatgacgccatgagcggccgtaaatacggcatgatgctgacgctgtttgccctgtgcggaatggtggtttttaacctcatttatctcccctggcagttggtgctcacgctgcattaatgttcgcggcttaaagggtgcaggccgcggcagtttctgccagaatagcgccctttccgctgtctcttcggattttcgatatgtctgatcgcgatcaactcttttctgcgcccattgcaaaactgggcgactggacttttgacgaacgtgtagctgaagtgtttcccgacatgattcagcgctcggtgcccggctattccaatattatttcgatgattgggatgctggctgaacggttcgtccagcccaacagccaggtgtttgaccttggctgctcattaggtgccgccacgctctcggtgcgccgcaatattcacgtgcccggctgccagattattgccgtggacaactctccggccatggtcgagcgctgccgccgccatatcgatgcctttcgcgccgatacgccggttagcgtggttgaagcggatatctgtgacattgagattgagaacgcctctctggtcgtgctcaatttcaccctgcagtttcttgagccaccggcccgtcttacgctgttaagtaaaatctggcaggggctgaatcccggtggtgcgctggtgctttctgagaagtttagctttgaagatcctgaggtcggcgaactgctgtttaacatgcaccatgactttaagcgtgccaacggttacagcgagctggaaatcagccagaagcgcagcatgctggaaaatgtcatgctgaccgacagcgtggaagcgcacaaggcgcgcctgaagcaggcgggtttttcccatgctgagttatggtttcagtgctttaattttggttcgttggtggcattaaaatgatcgactttggccgtttttatcagcaaatcgccgttggccccctggcaaaatggctggaagtgctgcccgcacagatcagcgactggcagcgggaaaatttgcatggacatttccgtgactggtacaaatcactggaatatttaccgctgctggaaccccagcggctggatctgctgaatagtgtgagcgccgatcgtgatgatatcagcgatcgtcatcgtcagggcattgagaaactgctgcgaaacctgatgccgtggcgtaaaggcccctattctctgtatgggactgagattaataccgaatggcgttcggactggaaatgggagcgcgtgctgcctcatatttcatcgctggccggacgaaccgtgctggatgtcggttgtggcagtggctatcacatgtggcgcatgattggtgcgggcgcgcatctggtggtaggtatcgatcccatgcagctgtttttatgccagttcgaagccgtgcgtaaactgctgaatgacgatcggcgcgcccatttgctgccgctcggcattgaacaactgccggttcttcaggcatttgatacggtgttttccatgggcgtgctgtatcaccgtcgctccccgcttgaccaccttctccagttaaaaaatcagctggtgaacggcggcgaactggtactggaaacgctggtgatcgaaggcgatgtgaatcaggtactggtgccaggcgaacgctatgcgcagatgcgcaacgtctattttatcccctcggctgaggcgctgaaaagctggctggagaagtgcggttttgttgacgtgcgtattgttgatttcgccctgacctccaccgaagagcagcgccgtaccgactggatgaccagtgaatcactggccgagtttctcgcccccgacgacagcagcaaaaccgttgaaggttatccagccccgctgcgcgccgtgctggttgccacaaaaccgtagccctcagcggcgagacagcgccagtttcgccgcaaagcctataaacacacagccggttaaacggtccatgaccttcagtacccgaggccgttttaactgcgcagcaaaataatggctgctgccgatcagcaccgtgctccaggccaatcccaccagcatatgcgtcaacgccatcaggctgcaccaaatcgccacggaagcaccctgcggaataaactgtggcaaaaatgtcacatagaaaacgccgactttgggattcagcagattacccagcaagccacggctaaagcagaccagatggctttgctgaaccacggcttcagcaggcagcgacgcgctctgggtgcgtgggtgccacagcaacttgacgcccagataaagtaaataggccgcacctatccacttcaacaggttataagccatttcagaggccagcagcagcgcgcccaatcccagccccaccgctatcccccacaacaaacaccctgaggccacgcccaatgccgtggcgctggcgcgccgccagccttgtgccgctgccgaacgcaggattaaggcggtatcaaatcccggtgtcagggtcaaaatcacaatagcaaacaggaaagagagtaaagaagccgtcatacgcgtatccccgataaacaccgactcacgatatcaagcgcatttctgtctgtacagccagcaaaaaagcattagctgctattctttttaagggctttatcttcgggccggtaacggccttcatttatgtaaccaggagcaacgtttatgaaatttattttctcttcaccccgcaaatatgtgcaaggtgctggcgtacttgatgaactgggaaactatgtcgccgagctgggtaatcatgcttttgtggtggcagacgatgtcgtctggggactggtcggtgagcgggcgcactcaacgctgacccaggcgggcgtgaaggttattcgccagcagttcaatggtgaagcgtccagtaatgaaatcacccgcctcagccagcaggcacagcaacaaggctgtaacgtggtgattgggctgggtggcggtaaaacgctggataccgttaaagcagttgccgatgaactcaagcaaccggtggttatcgtgccgacgattgcctccaccgatgcgccctgtagtgccctgtcggtgatctattctgacagcggcgtctttgaaagctatcgcttctacagtaaaaacccggatttggtgttggtcgataccgcagtctgcgccgccgcgcctgctcgcttatttgcctcgggcattgcggatggtctggccacctgggttgaagcccaggcagtagcccgtagccatgctaaatcgatggtgaatggcgatccgaccattgccgggctggcaatcgcccgcgcctgcgaagagaccttattaacgtggggctacagcgcctatgtggccgttaaagaaaaacgcgtgacgcctgcggtcgaggcggtggtggaagcgaataccttgctgtcaggactggggtttgagaatgccggtctggcaggcgcgcacgccattcacaatggttttaccgccattgaaggcgatattcaccacctcactcacggtgagaaagtggcctacggcaccttaacccagatggtactggagcagcgtcccgatgaggaaattgcccgctacatccgtttctaccgctccatcaatatgccaacaacgctgaaagagatgcatctggacggggtaagttgggagaatctggtaaaaataggggcactggccaacagtgaaggcgatacgctgaaaaaccttaaccccaacctggcaccggagcagattgcccatgcgctgctggggttggatgcctttagtcagacggtaaaataatcgctattccgtcgcctcagcggggttatcccagtactggtatttatagaccgcgctgaggtgacgttgaatggtccctttttcgaacacttcggtttcattcagataactcagcgtgcagttgcccttttcatcccaaaactggcattcatcgacggagcgcaaggtgctgacgtcggtcgtcgcggtgccattcaggcgcagttcccgcgcctgcttgtcgtaggtgtaagtatctttgcgacgggccgaggtcgaacgcgttaccagaccttgcgaattccattgataacggtattcaccgttactgacgggatcggttccccgcgcaacacttttcagcaaacggaagccgttgtcataacggtaagtcgtatcggtaaaaccgtctttgcccatgctgataaatttatctgacgcgctgatgatgttgccgtttttacccttctgccagttaatcgtgccctggcgattatccaccaccacttcgctaccctgctttaacactttaaccagataggcatattccgcgacccagccgccctgaacccgcaccaggtgttgctccatgctcaggatgacattacgctcatttttgtcgtagctgatatcggccaccagcagatcgccacagcggtcgaactgccccagcacccgcttttgtgaattaacgtctttgccaaactcaccggcgatgacctgacgtacctcaccctttgcgctaccgcccagcagaatccagttattactgttggtcaccgctttattgtgtggctggcatgctgctgcccatgaagaggggaatgaaatcagggtgattacagcggacagcagaacgcatcgcatggtatgagcctcggacgtcaatgtcgttaacggtttaccttaaatagcaggaaccgactgatgaaggaaagcagaattattttgacagcacgattgcctcacaggtcatcccagaggcgtcctgacggaattttggacaaaaaataccccagcaaatgtgctggggtttggtacttgcaaacatcacgtcatcaaacggcgtgctgcgcggcaaaactggtagtgagtcaggctactcgggcggtattcatctgcatcacgcttttcattgcttcaacgacatcgctgtcgacgcagtaacggctgaactcatcaatttcggcttcggaacacatggagacacccgctttgcggtagcgcatcggcgatgccacaaggtggctggccgagctgtgtacctcgcggatatccgcatcaagaaacttttgcaggttgctgagacgtaccccagcaccggccataatgattggacctgtgctgtattcattaagttccctcaataatgcaattccgttttccgcgctttgttgctggccagaggtcaggatgcgccggacgccgaagtccgtcagcacctcaagcgatcgcttaggccgatggcacaaatcaaaggcgcgatgaaaggtcaccgccataccgtcgcaaagcgccataatctggcgcatctggctggcgtggatattggcatcttcatccaacatacccagcacgatgccagggaaccccagttcacggatgcgcgcaacgtctgacttcatcgtttcaaattcacggctggaatagcaaaagtcgccgccgcgcgggcgaacgataggatgcaccggaacagaaatgtcacgacgggcgacttccagcatgcctgcagaaggcgtcagtccgccttcacgtggcgccgcgcaaagctcaatgcgatcggctcccgcctgctgggcggttaatgcacaatccacgccatagcaacaaatttccagtgtggtcattctcttctcctttacatggcttcctgttcacgccaaattcgtcaggtatgcttatcccttagaacagtttacgtggaaaactaactatgacattcaattttgaccaacggatagaccgccgtcacagtgatagtcttaaatggcacaaatatgcgggtcaggatattctgccactgtgggtcgccgataccgattttcgatcgcctgagtcgatcattgaagccattaaaagtcgcgtggaacacggcgtttttggttacggtgatgcgcctcacggcctgataaaagcgctgatcgcacgttgtgcatcgcgctatcactggcaggttgatcccgaatggatagtggttttacccggcgtggtctgcggcttaaatctgtcggttcgggcctttacctcgccacagcaaggcaccgttgcccccttaccgatttatccccctttccgttcggccgccagactggcagagcgcgatcagctgagcctgccattaaccttgcagcaaggacgttgggtgatggatctgcgcgcagcggagggaaagatgcaggacaaaaagctgttaatgctctgtaatcctcagaacccaggcggcaccgtttatcgtcgggaggaactggaggcacagctggcatttgcccaacagcatgatttactcgtgtgttctgatgagattcattgcgatctgctgttaacgccgggcttgcagcatattccgtttgcctcgctgagcgatgatgctgcccagcgcagcgtcacgctgctgtccccctcaaaaacttttaatattgcaggcctgggcgcctccgtcgccatcatccccaaccccgaactgcgcgcgcgttttaccgccgtgcgtcagggcattgtgccctcggtggatattctggcgctggtcgctgccgaggttgcctggcgcgacaatgatgactggcttgatgcacagcttgaatatttgcggggtaatcgcgactggctggtttctcaggtgaatgcgctgcccgggctctcaatgacatcccccgaaggcagctatcttggctggatcgatgccagcgacttgccggtggccagtccggcactttacttcgaaaagcacggactgggattctccccgggtcgcgattttggcgatgaccgctttgtgcggattaatttcggttgcccgcgcgccctgctggaagaagcggtcaaacggcttaaacgcgccgtcgaggctctcgcctaagactgctcactggctacgatttcttccaggctccacgggtgaaattttatcgtggtttctccatcggtcaccgccagggtcggattaggcagacgctcattttcccctttaggcgagctggttttaaaagaaataccgggttgtgcgagcgcgtggtcagacaatagcgccatcgcacgcatcccaagggtttctggctcgcccctcaataccacttccacatgctcccagccttcatggcgataacgtttctctcccggccacggcagttcaatcacgtcaatgtgccaactggcaataaccagaggttgatacagtttgaacaggcagacaggacgaccattaatcatggccgccgagaactgccgccccatttgtgccaatccccgctgccaacgttcggcggtggcgttttggtgacagcgcacagcaacgtgatcgacgtgcagttcgtcagcccttaaccccaaacgttgtgaaaacttttgtaaccgttgttcaaaggcggccagatcgtcgcgtaagtcgtccagttctgctggaaagggggtactcactgttacttctctcccgatcaaatttaattacttaaggttcgtaactcattgtcaacgttgaatcgtaaatgacaaaagggtgagattcatcttatttgagtgattattttcagctaaagcgaataaataacgtttttaattcagagttatcttctttttagatccactcttaagttgataaacaccagttaatataatgtttttattgaacataattaatacaataagataagtctcatttaatcccggactgattgcagctgcgtcgcctttcttataaatttgcattgataccattataaggaaagtttttatgactatgctcatcgttgttgcaacattgatcgcactgatgggatttgcccttgcgcgccactggaaggtgcgagaagacaaaagtgttaaaaacgcgcgccacgcacgccgtcgctgacgccgccgggaaacattttcgggcctgtttcccccgcctttatccagttactgactcaagctgacatttcacgtatactttttccctcattttttccgttctgcctgatgatagctctggtcactccatccggcagaatgatgatgacagcacgctgcgctgtcagcgtgcttttctcagcatatttaaggtaatccggtgaatattcaggcgcttctttccgcaaaagtcagtcaggctatggtgctggctggtgctccctccgattgtgaacctcaggttcgccagtcggccaaagttcagtttggtgattatcaggcaaacggcattatggccgttgctaaaaaactgggccaggcgccacgacaactagccgaaaccgtcattcaacatctggaccttagcggtatcgccagcaaggttgagattgccggaccgggtttcattaatatctttctcgatcgcagctggctggcagataacgccagaaaagcactgcatcatccgcgactcggtgttagcaccgttgaaccccaaacggtggtggtggattactctgcgccgaacgtggcgaaagagatgcacgtcggtcacgtacgctccaccattattggtgatgcggccgtgcgcaccctggagtttctgggacataacgtcatccgcgccaaccacgttggcgactggggcacgcagttcggtatgctgatcgcctttcttgagaaacagcaaaacgagaaccacgccgaaatggcgctggcagacttagaaggcttttaccgtgaagccaagcgcacttacgatgaagaccctgattttgcggagcgtgcgcgccgctacgtggtgaagttacagggcggcgacgagtactgccgtcagatgtggaaaaagctggttgatatcaccatgagtcaaaaccagcatatttataaccgtctgaacgtcaccctcacccgtaaagatgtcatgggcgaaagcctttataacgatatgctgcccggtattgtcgccgacctgaaagcaaaaggcttagcggtcgaaagcgagggtgcaacggtcgtttttctggatgaataccagaataaagaaggtgagccgatgggcgtcatcattcaaaagaaagacggcggctatctttacaccacaaccgatattgcctgtgcgaaataccgttacgagacgctgcacgccgatcgcgtaatttattacatcgattcgcgccagcatcagcatctgcagcaggcatggaccatcgtgcgtaaagccggctatgtacctgaatctgtcccgcttgagcatcacgcatttggcatgatgctgggcaaagacggtcgtccgtttaagacccgcagtggcggtaccattaaactttccgatctgctggatgaagcctatcagcgtgcttacacgctggtgcgcgaaaaaaacccggatatgagcgaagacgacgtagtttcgctcgcggaagtggtgggcatcagcgcagtgaaatatgctgacctgtcaaaaagccgtaccacggattacatctttgactgggacaacatgctggcgtttgaaggtaacaccgcgccctatatgcagtacgcttatacgcgtgtgctgtccgtattccgcaaagcgggcatcgaggccgagacgattcaggcagacatcaccctgagcgatgatcgtgaagccctcctgacaacgcgcctgctgcagttcgaagaggtcatcacccaggttgcccgcgacggcacgccgcatgtgatgtgtgcttacctctacgacctggccggtctgttttctggcttctacgaacactgcccgattctggcggcagaggatgacgcgacccgccagagccgcttacagattgctgccctgaccgctaaaaccctgaagctggggctggatacgctgggtatcaaaaccgtcgatcgcatgtaattgcttaaggcgctgagtcctcactcaaactcagcgcctgtctgtcatcctgcccacctgccttatcccccgctgcctcatgatttcctctgcgcccctctgcatgcctgtcttcgcacctgaaggtggtaacgacataaatcagcacgctattgcctcaaaacaagacatcgtcatgcctggcggcagcccgatcggcgcagacaacctacatcccctgtttatcggcaaaatctcatgacgtgatgccattctcagtaccggactctactataagcccgcatttcatcaggtctttacgtatttcgagaaaggataatccatcgatgttaagaaaaacatttgccgaattcatcggtacattctggctggtattggggggttgcgggagcgccctcttcgccgcgaattttccgcaaaccgggattggttttgctggcgtggctctggcttttggcctctgcgtgctgaccatggcctttgctgttggtcatctctcaggcgggcattttaatcctgccgtcactctggggctgtgggccggtggccgcatcggatatcagactattttcccctatatgattgggcaagtggctggcggtatcgccgcggcggctctgctgtatctgatcgcacggggccaggctggttttgatgtggcagccagcggtttcgctgccaatggctttgccgaacattccccaggcggctattcactgtgcgcagccgtggtgactgagctggtgctcagcgccttttttctgatcatcattcagggtgcgaccgataaacgcgcgcctgcgggtttcgcgccggtggcgattggcctggccttaacgcttattcatttaatcagcattcccgtaaccaatacgtcggtgaatccggcgcgcagtacggcgatggcggtattccagggaacctgggcgttacagcagttgtgggtattctggctggtgccgctggtgggcggtgtaactggcgggttgctctatcgttatttgctggcaagtaacgactaatggatgacggtgatgaccgaacctgtgggtcatcgcccagaccggcagcggcaacaggatcgcacgctgtcggtctgacctgagccggttgatggcccgactcagtgataattgaccgtcacttctgtgctgaccacttttagtcccggcggtaagcttccgctgccggcgaaaccaaacaccatgtgcaacgtttcacctgcggcaaccccggtaagaccgcgcgtcccaccatttgccccctccagatcggtacaacgctgctcagcacaaagccgaacctgcaggcctgacggcgcaggctgggtaaactgatagcgccagtttacgaggctgattgcccctttgacctctcccggcggcgtcaacggctgggacgattgccagctcccgcgattgaccagcaatggccctgcggcgctggcactccatgcgccatctgcggcctgagcaaacatcggcagcagtagcgcaaacagcatcatcgatctcattgtttgcctccgatggtggcggtcattcgaatctggcgattatcgcttaattccatatttgacagcaccaccagctgcggcatgttacggcgcaggaagcgggccagtaaggcacgtaatggatgattcaccagtaataccggcggtgcgcccatcatctcctgacgctgcaatgcttcttgcgtctgcgctaacagacggtcggcaagccccggctccagtccgccaccgccctgcagggcctgcagcaacaggcgctccagtgtggcatccagtccaatcacctgaacttcaccgttacccgggaaccactgctgggtaattgcccgacccaatgccacgcgtaccacgctggttagttcctgcggatcgctttgtaccggggcgtgctccgccagggtttcaataatggtgcgcatatcgcgaattgagacacgctctaccagcaggttttgcagaactttatgcagggtggtcagattgataacgcccggcaccaaatcttcggtcagtttaggcatctctgaagagacgcggtccagcagttgctgtgcttcctgacgaccaaacagctcgctggcatactgaccaatgagatgattaaggtgggttgccaccacggtactggcttccaccacggtaaagccctgaatctgcgcctgttctttcagcgcgccatcaatccagacggcggcaaggccaaaggccgggtccaccgtggcttcacccggtaaggtccccgcggcggtgcctgggttgatcgccatccaacgtcccggataggcgtcaccactgccaatttccacgcctttcatcagaatacgatagcgggctggtggcaattccatgttgtcgcggatatgcaccaccggaggcaggaacccgacgtcctgcgccacctttttacgaatgctgcggatacgaccgagcagttcgccgttttggttatgatcgaccatcggaatcaggcggtagcccacttccatgcccagcgtatcttccagttggacatcggtccaggaggcttcagccgatgccggtgtgtccatggatttggtgaggctgcccggcgattcgatattcgttttaggctgcatttcacggccacgtaaccaccatgccaggcccagcaatgcggcggtgaacagcaggaaaacaaagtttggcatgcccggcactaagcccagcaaaccaatcaccccgccactcagcatcaacacgcggggatctttgaacagctgccccaccatctgctcacccacgtcctggtcggtcgctacgcgggtcacaatcacacctgccgccgtggagataaccagcgccgggatctgggcgaccaggccgtcaccaatggtcagcaacgtataagtctctgccgcctgtcctgcggccatcccgtgctgaacgataccgaccaacagtccaccgatcacgttgatcaccatgatcataatgcccgcgatggcatcgccgcgtacgaacttactggcaccgtccattgagccgtaaaagtcggcttcctgggtgacttcggcacggcggcgtttcgcctcatcttcaccaatcaaccccgcattcaggtcggcgtcgatggccatctgtttaccgggcatcccatcaagcacaaaacgcgcgcccacttcagcgatacggccagcacctttggtgataaccataaagttgataatcaccaggatgataaacaccacaataccgatggcaaaattgcccccgaccagaaagtggccaaaggcttcaaccacccgtccggctgcggccgcacccgtgtgaccttccagcaaaatgatacgggttgaggcgacgttcagcgccaggcgcagtaaggtcgaaaacagcaaaatggtcgggaacgccgcaaattccagcgtccgctgggtaaacatcgcgaccagcagcaccataatcgacaaggcaatgttgaaggtgaacaacagatccaggatgaatggcggtaacggcaggaccatcatcgacaaaatcatgatgatcaggaccgggccagcaagcacctgccactgcatgtctttgaagttgcccggtaggcgtagtttagcggccagattagccatcgtttttgttctctcctgcaaagtccatctctgccgggaccggcaggtctttaggttttacgggtatcaggccgccttcgcgcttccagcgacgtagctgccagacccaggccagcacttctgccacagcgccatacagcgcgcccggaatgtgttgtccaatttcagtatgtcggtacagcgcacgcgccagcggcggtgcttccagaaccgggatacgatgttccgcgcccagttcacgaatgcgtaaggcaatatcccctgcgcccttggcgataaccttcggtgcactcatctttttctcgttatattgcagggcaaccgaatagtgcgtcgggttagtgacgatcacatccgctttggggacatcggccatcatgcgacgccgggctgcggcacgcatctgttgacggatgcgtcctttaacatgcggatcaccctcttgctgcttatgctcatcgcgaatttcctgacgcgacatgcgtagctttttaaagtgactgtacagttgccagaaaacgtcatagcccaccatggggatcaacccgagcatgaccagcgaacagcagatggcaatcatatccatgccgtgaatcagtgccgttgtgggtgactcggcaatcagacgcagcatatccggccagtgcgtccagatgtaccagcctgccacacagccaaccaggatggttttcagtatccctttaaacagttcggtccatgcctgcgccgcaaacatacgtttaaagcccgtcagcggattaagcttgccgaaatccactttgatggatttaccgctaatcaccacgccgcccagtagcatcggcgaggcgatggcgaccagaaccagtccacccagtaacggcaacagtgcgccaagagcctgcataatcagattgccgacatgggcaataatgattttgtcatcggtgaccatgccgtggtcaaaacgtaacccggttgacaccatggcacccagtcggtgagccatcatggtgccgccaatccataaaatcatgatgccggctaacagcatcagcaatgaggtcagttcgcgcgaacgcggaatctggccttcttcacgtgctttttcaagtcggtgggccgtgggcgattctgttttgtcttcgtcgctattttctgacaccacacacctcggttggcaggaattctgagcatagaatgccaaatttgggtttggttaaagcgtggataaaacgtgaaaaacacgcgctctttcacggatggcaaaagagaaaagagaagtggcctgtcagaaacaggccatcttgaagaagggggcgatggcgacccggtagtgggtcagccatcgccagacaggctggcggttaaaagcccaggctatccaacaggtcatcaacctggtcctggttagccacaacgcctggcgcagcagagtttacctgcgggccattgagcagcgtggtgccaacctgacgtttctcggcgctgacttctggcatgttttccagcagcaccattaacaactggcgctcgatttcctggatcacatccatcatgcgcttgataacctgaccggtaaggtcctggaaatcctgcgccatcatgatgtcgagcaactgcttgttagtaaaagaggtgtgctcaggcacttcccctaaatactcacgcgtatccgtcaccagttcgcgcgcgtcggcaagttcaattggattttcaaaccacgcatcccagcgtcctttcagcgctaccgctcccgcttccattttatcctggtgcggttgcgcagcttcgacgctgttcagcgcccggtcggccgcctgggcggtcttttgtactacatagtccagacggtcgcgggcgtcaggaatggcttcagcagcttctgcaatggcctgatccagccccagctcacgcagactgtcacgcagcatgcgggtcagtgaaccgatgcgggaaataatatcatgtgccgcggcttgctcagctgatttcggaaggtcgctcatcacatctccttacatacccagtttttcaaaaattttgcccagcttttcttcaagcgtggcggccgtaaacggcttaactacgtagccgcttgcacccgcctgagcggcagcaataatgttttctttcttcgcttccgccgtcaccataagtaccggcagactcgccatggcagcatcggcacgaatggtctgcagcagttgcaggccatccatattcggcatgttccagtcagagatcacgaaatcgaaaccacctgccttgagtttgcctaacgcatcaacgccgtcttctgcttcttctacgttattgaagcccagctctttcagcaggttacgcacaatacgacgcatcgtattgaagtcgtccactaccaaaaagcgcatgtttttatcagccatatctactcctgtgttatctcgcccggcaggacgggcctgttatatacgcaatgcctgtccggcgctaattttcgccagcatatgctggctgatgttgcttaaatccactacttcgctcacgccaccgctggctatcgcctcgcgtggcatgccaaaaacgacacaacttgcttcattttgtgcgatggtccaggcgccggcgcgatgcatttccagcatgcctgcagccccatcgttacccataccggtcaggatgacgccgacggcattacgccctgcgttgatcgcaaccgatttaaataagacatcgacggaaggtttatgccggttgaccggcggaccttcattcagtttcaccacgtagttggcaccgctacggcccagttccatatgcatcgcgccgggcgcaatgtaggcatggcctggcagaatacgctcgccgtcttccgcttccttcaccgtgatctggcacagcttattcagccgttcagcaaaggaacgggtaaaacctggcggcatatgttgtgtaatcagcagcgccgggctggtcgcgggtaacggttgcaaaacgtgacgaatcgcttctgtgccccccgttgatgaaccaatggcaatcaacttttcactactcagcaacgggccggctttcaacgtgagcggtgctggcatcacgttacgcacatgcaaacgtgcccgggcagcggcgcgaattttgtcaccaatcatctggctgtaggccagcatgccttcacgaatacccaactgcggcttggtgacgaaatcaatggcgcctaactccagcgcgcgcaacgtgatttctgagccctgtccggtcagtgatgacaccataacgacgggcatcggccgtaaacgcatcagtttttcaagaaaatccaggccatccatgcgcggcatttccacatccagcgttaacacctgcggattaaactgtttaattaaatcgcgtgccactaatggatcgggggcagtcgccaccatttccatatcaggatgactgttgatgatttcggtcatcagttgccgcatcagcgcagagtcatctacgcacatcacggtaattttgctcatcatctttccttcgtcagtccatacacggtttgcccacgcagccaaaactctttactaatctggctgaagttctctgagtgtccggcgaacaggatgccgccaggcttaagcaggggaacaaaacggcgtagaattttttcttgtgtttctttatcgaaatagatcattacgttgcggcaaaaaatcgcatcgaaaggtccgggtaaggcccagtcgtttgccagcaaattaagttggctgtagttcaccatgttcgccagttccggacgtacacgaaccatgccagcatgcggacccgtgccacgtaaaaagaaacgctgtaactgtgcaggcgacagcgtgcgcagctcttcctggcggtaaacgcccgccacggctttttccaacacctgagtatcgatatcactggcgtgaacctggaatttacccggtcccgcgcccaatgtttctgccagcgtaatcgcgatagagtaaggttcttcgccggttgaggcagccgtactccagacgctaaaattaccctgacgtttacgtgcatgttccgccaggattggaaaatgatgcgcctcacggaaaaaagccgtcaggttggtggttaacgcattaataaacgcctgccactctgcactgttctgatcattctctagcagcgccaggtagcgaccaaagtcatcaatattcagcgtgcgcagacgacgaaccagacggttgtaaaccatctcgcgcttatgatcggccagcacaatacccgcacgctgataaatgagctggctgatacggcgaaaatgggtatcggagaggggcaggcgctgtaccatttgtgacagcagcgtggtcgcctccggttgatctaataacgtcgatttcttcatctttgcacctggcctgaactaaacctgttgaacatctgctgctacgcccaaccgcacatcagcggttgggccatccaggcaattagaaggtttcccagttctcatcaccgcgtggtgatggctggcgaataccttctgacggactttctaaacgtaaattttttaccgccgtagtcttgttaacggcctgcgtgacaatttctttaccaatattgaagacagaaaccgcttgttttaagttactggcctgatcttccagtgcagccgcggctgcagcagactcttcaaccagtgaagcattctgttgtgtcacgcgatccatctccgtcaccgcctggcccacctggtcaatgccacggctttgctcgtcggatgcagaggcaatttcacccatgatgtcggtaacgcgcgtcaccgcgctgacgatttcactcatggtgtcgcccgcgctttcgaccaggactgaaccggtgttaacccgaccaacagaatcttcaatcagccctttaatctctttggccgcctgcgcactacgctgggccaggttacgcacttcacccgcgacgacagcaaagccacggccctgttcgcctgcgcgcgcggcttcaacagcggcgttaagcgccagaatattggtctggaaagcgataccatcgatcacgctgataatgtcggcaattttgcgcgaactgccggcaatctctttcatggttgtcaccacgccatccacgactttgccgccctgctgcgcggtttcagaggcgttaagcgccaacttcgaagcctgacgggcgttttccgcattttgcttcacggttgcggtaagctgctccatgctggccgccgtttgctccagcgacgccgcctgctgttccgttcgggacgagagatcgttattgccaacagcaatttcgctggcaccggtataaatcgcatcagcaccgtcacgtacggtgctgacagtacgtaccagcgcctgttgcatgtcttgcagggaggtcagcaaatcgccaatttcgttacgcaccgagatatgaatcggctgcgtcagatcgccattcgcgatatgttgaatgtgttcgatgctttgtttaagcgggcgaataagcaggcttcgcatcaggttccataccagcacgatcactaacagcgtgaccgccagcgtaccgatcaccagcataatcatgctcttataggcggcatcattggcatccacaccctgctggctcagcttaaggttataattgagccagtcatcgtagtctttctggaatttgtcctgatagctctgcgtcggctgatcaacaaatcccttaaagttaccgttacccagaaacacaatcagttcagcgagcccgtcatggaactgcttatagttcgcctgcagcgtcagcacgttagctgcgcttttgcctttctcagaaagattcgcgttgaacaaggcatagccttcctcggcgcgctttaattcgctatctgccagcgccactaattcttttaccgtggcacctgaacccgccatttgtccgtcctgtaaataacgaattccggcgcggtttaaggtatttcgcgcctgaaccagtgccacccaggaggtgcccatggcgcgttgaagagtactcagacgttggttataggcaaagttttctttatcttccgtcaccgtcttgtaaaacacaccacctgaaaaaatttgcagtaatgcgaacagtgccaatacacatagaagaccggagacaacacgtactcgactaaacatagaaacctcattcattagcaattcgattctgtttatcggcccggacgtgcggaactttacggccagcgtgaagagaggttcacgccggccgtaaaaagtgttggaaaacttataagcgggaaattttaaatacggccacggcctgtgacagtgagctggcctgttgctccagcgcagcggcggcggcggcggactcttcaaccagtgaggcgttctgttgcgtcacgcgatccatttccgttacggcctgacctacctggtcgatgccgcgactttgttcgtcagaagcagacgcaatctcgcccatgatgtcggtgacgcgcgttacagcgccaacgatgttattcatggtgctgcctgcgctttcaacctggagggaaccgctgtcaacgcgcgcgacggagtcttcgatcaagcctttaatttctttagcggcctgggcactgcgctgcgccagattgcgcacttcacccgccacgacggcaaagccacggccctgctcacctgcacgtgccgcttcgacggcggcgttaagcgccagaatgttggtctggaaagcaatgccatcgatcacgctaatgatgtcagcaattttcttcgaactgccggcaatctctttcatggtggttacaacaccgtccaccaccttgccaccctgcagcgcagtttccgatgccgtttgcgccagctgagaagcctggcgggcattatccgcattctgtttcaccgtcgcggttaactgctccatgctggcagcggtttgttcaagcgatgctgcctgctcttccgtacgggcagaaagatcgttgttgccagcggcgatttcgctggcgccggtgaaaatggcatcacatccactgcgcacctcacccaccgtggaaaccagagagcgttgcatctcatgaatgccctctgccagctgactcatctcattgcggccttccaccagaatgggttgcgtcaggtcgccagaggcgatggtccgaatatccaccagcagacgttgcagaggatggataagaagctggcgcagcccaaaccaacagcccatgatgacaacgataaccagtacgccaaccatgccaagcagccacatcatctgggtaaaggcctgctggttctgctctgccccgtgcgcagacagttcactctgcttcatgcgccatgttgaataggtggcctgcatcgcctgctgtttctgctcaatgttttgtttaaacataccttccagatctttcgctttcaggctggcgatcatgccgcgcagtccggtcaggtaggcggcaaaattgtgttgcagctgatcgcgcaattcggtatcggcccctggcgtttcaggaatggcgttaaactccgtcaggaactgttcacctttgttggcttcgctgatggctttatctgtcaggctctccagctgaccgccattcatctgtgtcgccaggctggtttgtaagcgcagcatggcgcggttgagcgtggtacgtgactgattcagcgccatataagcatcggtcatcgccgcaacatttcgggtggaaatttgcgacagggcaaaggcctctttatctttgtgcagcgctgaccagaacagactgcccgatagcagctgcatggcaccgaaaagcatcagtaccgcaataagactggtcaccacttttattcgttttaacatcgttttccccgagcgtaataagtaaagtgcaggggctgtatcggcgggaagatgagatgttttagtgaagatcgaggaaaaagcagcgtttaaggcttttgtaattattgatatcagtcaattgtgttatttagcgggaacgatcacagacaacgcaagaagaattaacatattgcgaacgctgttaacgcgtttgaagcaggcgagaatgcagaaagctatggagatcaacacgggccagcgttcactgacccgtgaaggaagattaggcagtacgcaggttgtctaccagcgccatctcttcgctgctcagcagcttctcgatgtcaaccagaatcaacatgcggtcgcccagtgcacccagaccggtcaggtactcggtggacattgtcaccgcaaactctggtgaaggacggatctgttcctgcgtcaacgacaggacatcagaaacgccatcaaccacgataccgactacgcggttttccagattaaggacgattacgaccgtattctcattgtactcaacatcggcctgtgcaaacttcacacgcaaatcgatgatgggcacgataacgccacgcaggttggtcacgccacgaataaagtcaggcgtgttagcaatgcgggttacctgatcgtagccgcgaatttcctgaaccttaagaatatcgatgccgtactcttcatcacccagcgtgaacaccaggaattcctgaccaacggtttcgccagcaatttttgtcacggttgccattccactcatgttatttaccttttcgttatcaatcaggcggcagcgccggccacacgtttttcacggttaagtgattgcaacgccgaaacgtcaacaatcaacgccacgctgccatcgccgaggatggtggcggctgaaatacctggtactttgcgatagttgctttccaggtttttaacgacaacctgatgctgaccgattaactggtctaccagcagcgcgtaacgcttgcccgcgctttgcagaatcaccacgatgccttgcgtcgcttctgttttggcctctttcacatcaaagacgttccacagctcaaccagcggcagatattcaccacggacttccagaacacactcgccacccgccagcggttttaactcttctgcgcgaggctgtaatgattccatcaccgcgttcagcggcagaatgaagacctcatcggctacgcgcactgacataccgtccagaatggccagcgtcagcggcagcaggatacggatcgtggtgcctttaccttgtttagaggcaatttcaacgtgaccacccatttcctggatattccgtttcaccacatccatgcccacaccacgaccagacacatcggttacctgttctgcggtggagaagcctggggcgaaaatcaacatgccaacttcttcgtcgctcatgttttcgtgaaccggcaagccggatgtgagcgctttagcaagaatacgttcacggttaaggcccgcaccgtcatctgacacttcaatacagatgttgccgccctgatgttctgccgacaacgtcaggttgcccgttgccacttttcctgcggcaatacgcttgtccggcgactcaataccgtggtcaagactgttacgcaccagatgcgttaacggatcgatgatacgttcgatcaggcttttatccagttcggtagaactgccgagtaaggtcagctcgacttctttgcccagtttgctggccaaatcgcgaaccagacgcgggaagcggctgaacacatattccatcggcatcatacgaatcgacatcaccgactcttgcaggtcgcgtgcattacgctccaactgccccatgctgttcagcagttcgccatgggcaaccgggtccagctcacctgaacgctgcgccagcatagactgggtaatcaccagttcgcccaccaggttaatcaactgatcgaccttttctacggcaacacggatgctgcttgattcgctggtcttggccggtgcggcaacacgtttgctttcgcgcttgacggcagcaaccggcaattcggtcacggtggcggtctgcacttctgcaacctcaggctcagcatcgctttccgccgctgcagcagcgtcggcgtctgcgctcgggaagcgaatctgtgcttcatcaatcacaaagcagagtacggcaacaatatcgtctttaccgacgccagtgatgtggcactcaagagacgtcgagcctttcttgacgtcgctgagcgtgccgaggttacccagctcttccagcatcaggtcgatgtctttttctttcagatcgaccagctgcaggtggacgctgtctgcgcccgctttcgctgattctgcctgacttactggcacatcaagtgaaaccacaaccggtgctgcaaccggaagacctttagcctctaacgccagttggcgtaatgcttcacagatatacttgaagctttccgcgttaggctcttgcgcggttttataagcatctagctgttcctgcataatgtctttagtttccaaaaacagattgatgatgtcggtgctgagctgcatctcgccgcgacgagcaccatccagaatgttttccaggatatgggttgtttcctgtaaaaccgtaaaaccaaaggttccggctccgcctttaatagaatgggcggcgcggaagatggcgttaagctgttcagagtctggctcctggggatcgagtcccaacaggtgttgctccatatccgctaacagctcatcggcttcatcaaaaaacgtctggtaaaaatcgctgatgtccatgctcacgggaatcacctctgctgtgagggggctgctgtagtcaccgcacccgccgatgatgctggcggcgcggaggttattttacccgcaccagccgatgacgctggcggtgcagaggttactgttatcaccgcactcgtcgacgaagctgacggtgcaggagatactgtggttaccgcaccagtcgaagacgctggttgtgcggatgttgctgttttcaccgcacccgtcgaagacgctggctgcgtggaagttcctgtttttaccgcaccgctcgatgatgatggcggcgtggatgtggctgatttagccgcacccgcggatgtggcagcggatgaaggcgcagacgtcacgttgtctatcgcattccctattgaagctgagggtgctgtcaccttttcaatggctgccggatcgctgacctgaacggcgtcactttcagcgttctctttttcaatcgcggcttcggtatcatggttcaagaccagcaggctaatacggcggtttactgcatcatcaccaccgcggtttttcagtttcatcgtgtcagccatgccgacgatacgaagaatttttccgccatccaggccaccaatcaccagctcacgacgggaagcattggcacggtcagccgacagctcccagttactgtagcctttatcgcccctggcatactgaatgtcatccgtgtgccccgcgatactgattcggttggggatatcattcaaaaccggtgcaatcgcacgcaaaatatcgcgcatataaggttcaacttcagcactgccggttttgaacattgggcgattctgactatcgataatctgaatacgcagcccttcttccaccatattgatgatcaaatgcggacgcagtgctttcaggcgtgggtcggcttcaatcagctggtcgagcttttcacgcaaccggttgaggcgaatctcatccagcttgcgtttctgcgcatccatatccacaacctttttaacttcgccatccttcttggtcgcatcgtcaccgccgccggggataggactgctgctatcgctgcttcgctgtccacccgtcagcgccacttttaatggcgtctgaaaatattccgctatctggatcaactgctgtggactggcgatcgacagcagccacatcaccataaaaaatgccatcatcgccgtcataaagtcggcataggcaattttccatgagccatgtcctccttcatgttttttatgtttgcgctttctaatcagcacaattgggcgattgccatgtttcatgaggtctgatccgaagtctgtttagccgggttcttcgcgttgcgaacgtgctcttccagttcgctgaacgaaggacgttcggctgagtaaagcgttttacgaccaaactcgacggcgatttgcggtgcgtagccattcaggctggacagcaatgtcactttgacgcactgcatcattttggtcgtttcagcacatttctgacgtaatactgacgccagaggcgaaacaaaaccgtatgccagcaaaatcccgaggaaggttcccaccatcgcatgtgcaaccagcgcgcctaactctgcagctgggcggtcggcggatgcaagggcatgtaccacacccattaccgctgccacgataccgaaggctggcaggccatcgcctactgctgagatactttgcgcaggcacttcacactcgtgttcgtaggtttcaatctcttcatccatcaatgcttcaatctcaaacgcattcatgttgccgctgaccatcaggcgtaaataatcagtgatgaaatctactaactgtttatcggctaagatgcggggataattagcaaaaatttcgctctgcgcaggatcttcaatatcgcgctccagcgataacatgccttgctggcgagatttcgccattagcctgtaaagcagggccattaaatccatgtacaccgctttgttgtatttggacccgcgaaacagcatcggcagggctttcagcgtctttttaatcgccttaccgttgttccccaccagaaaagcacccagacctgcaccggcgatcatcaacagttcagcaggctggtacagcgcgccaagatggccgcctactaaagcgtatccgcccaacacggaacctaatacaacgatgtaacctataattatcagcacaaaaaatccttacgtccgtaacgtgttggtcgacgttaagccagagacccaggtgatattcaccacgtggaggcaaaaaaaaagcagcgggattaaccgctgctggatgacttccacattgcgaacaaatttaaacggcttgtttaacctgttcatccagcagttgtggaaagatatcggcagtatctgcagaaagtttacgtctttttacggcacgtgatggcggctggcacaggctgcaaacaaaactgccaatgggctgatgtgcatgattaataaagctaccattgcagcttttgcagtcagataattccagcataccgctttcaacgaatcgcaccagggtccaggcgcgtgtcagcgccaacagcgggccctcgtccgattgcgggcactgctcaagatagagacgataggctttaattaccgcatcaatacctttgctcaaaccggttttcagtaagaaagtccaggcgttacagaacatggaagagtgaatattctgttcccacgtcatgaaccagtcagtagagaaaggcaacatgccttttggtggcggactaccacgcaactctttatacagtttaatcaggcgaccgcggctaagctgggtttcactttccagcatttgtaagcgcgcacccagtgtgatcaactccatcgcgagctgaatatcacgtgcttcctgaacaatacttttttcacccattataccgccctctttttagtaggcgcggcgtctttagacgcgctgcgtagtaaacggctggataacagaatcccggtgtggatttgttgtaaatcatccacgcgtgattcctgcgtcaggcgattaataacggtgctatcggtaaaacgaaactgacacacaagttgattggtctcagctaattttaccatttcaggtaaggttaattcagacaatgcgtctgccatcttttcatcaatcccgaggcgaaacattgccgaagctttttcctggttaattaatcgctgcgcgagcagtaaatatgacaagttgatatcgtaaatatgttttagtaattcagatgtacccatttttccatcctgagagacgcgacgtaacttaccgcagataacttctctgcgtatcgagctgctggttggtaaatctaaagatggcaaaataattaatcataaacagccaatggttctgagcactgcttctttttgtgacccttttacgtccgggtcagaagtcatttttcagtccactttattcttaagtcgttaaccttcttccgtgaggtcttttcacattttttaagactaatccgaaaacaaggcaaatctatatcgtctgatcctcacatacaacgacagttaggttaaattttagataaagtgtgacgcaggtcacacttttgcccctattttcttcagaaatactttatgatcacactttgcatggctaatttttgaacaaatccgtgtttttttgtagggatttgtcctgacaaggacttaattggcaacaaaaccaagacggaattgaaacagggtggttgagctcacgtttatgttcgcgaatgcaatttgcgccctatttagaaccagccaaaaccataaaaccagtggaatactctgtcaccagaaacaattattcgtattcaaattagacagttagacgtttactggcccctgaagacaaccagtaatgaaaggcagctcagaaggattaggcgctttctgacaatccggtataaaggccgacagcaaggtgtttaggaggcgatcgtcgatgtaacaaggagttacattaagaacgtgaatgaattgcaggcaggatacttttgtgcacttagactatcggcagaattgaagagaactttagcttaaccaggtaaaaatagtgttttgccatttttgttactcatcctgaggtcaggatggcgtcataccgtacagccgcaggtcaggtgaggctttgcgttaaggataacctattagaaacctgagtcatgggactggcgaggccagacgcgttttgtgggggtgagaaaaggttttgcgaggtaagggataagtacggcaaacagcaagccatccgtggcttgctgaggcatcaggcgagtttaggaaaggttgccactttattcgctattccatgatctgcgctacgtggcgcaatcttttccagatcgcgtaagaagctttcacgccaggcggtgatatcgtttttgcgtaataccgccatcatgtcgttatagcgtgaaatcctttctgtacggggcatggtaatggccttatccagcgctgcggccacttcatcccgatcataaggattcactatcaatgccgaggtcagctcattagctgcaccggcaaaacgggacagcaccagtacgcctgggtcatccgggtcctgcgccgcaacatactctttcgccaccaggttcataccatcacgcagcggtgtgaccaaaccgacgtcggttaggcggaagattttcatcagcaagcgacgatcaaagtgctggttgaggtaatagagtggtgtccagccaagcgtaccgtatttaccgttgatgcgccctgcttcggtttcaagctgatggcggatgtcctggtaagcctgcacatcaccacgtgacgttggcgcgatctgcgagtagcggattttaccccgatgttgaggatagttttccagcagcgcttcataagccaggaagcgttcgggaagccctttggagtaatccagccgttcacaggcaatgatattacgcgcatcgccgagctcttttttcatcgcggccatcttcggtggcaacggcccttctgccatctctttaatgctgtctggttcaatcccgatagggtaaacctcagtcataaaggtgttgccgtaggcgcgatgtttcttatcacccttgttctgcaactgggtcagttggctgacgctgtcgagaaaggcgacgcgatctgattctgtctggaaacccagtaaatcgtattcgcacagcatctccagcagttcctgatgcggaggcagcgcattgaaaatttccggcgtagggaacggaatatgcaggaagaaaccgatacggttgttgatgcctgcccgacgcagcgcggcggcgaacggcaaaaagtggtaatcatgaatccacaagatgtcatccggctggatcaatggcttcaggcgctgtgccaccgcatcatttacctcgcagtagccttcccaggcttcacgctggaactgcactaaatccaggcggtaatggaaggcaggccagataacggtgttggagaactggcagtagtagagatcgtactcgttctggctcaaagggaaagaagcgtactcaataccgtcgtgctccatgaccgataccgggttttcttcctcgcctgaaaactcactaatctcaccgttccagccaaaccagagtccgccagtgctcttaagcgcatccagaataccgactgcaaggccgcctgcactggttttgttcccatttggcatggcgatacggttagatacaaccactaaacgactcataacctaaactccttaccaacgttgtctttctctaattgtaatcgtgttctttcaagccaggcatggacatccgtaacgtcatgtaaacgataacgtgcctcgcttgggccttctccgacttttatcgagatcccctgcatcgcattcactgcagcgaatcctttttcatctgtgaggtcgtcgccgataaatacggggatacggcctgagaatggcgcttcctgcataaatttatggacggctgcgcctttatcaataccggtaggtttgatttcaacgacgcatttgcctggctgcagcgcaaggccatcaaaacggctgactgccgcctctgccagctgcatgacatcctgctcgtactgcggtgcgcgacgaaaatgcagcgcaaacgccatgcctttggcttcaagttgcgtgccgggccactgcgccatcgcattctcaagcatgatttttagcggacgttcaacgtcgtccggcaaggtcacccggtgcagctcgcctgtcgcatcgcgccgttctgcgccatgaacgcccgctgctggtgcacgcagaggagccgccagtgcgtcaagttgttcaacgggtcgacctgagaccagcgccagtgcgccgtggcataaagatgagagccgttgcagttgtgcgacgacattttctggaatgaaaacggcatctggctgggactgaatcgctgccagcgtgccatcaacatcaaaaaagaaggcatacagaccgccgctcaatgacgggaatgaggcatcactatctgccgtctgggtcacgtgtcttctcctgtaaataggttcatcatcaggacattacagcagagggatttcagcaagaggttggctcaaggccatatgaagtaaggagagtgcgtggtaaaaccctgcaattctataacgttatctccaaaaacaaacgcgtttcaatgctgataaacccgctgactgtcattgtcgccacataaagtgtagtcgctatcttctgttctgccagaaatatgcatttcccgtgccagccgtctcgctttaacagggtcgtagaaaatttcacttgcatttcgcgattactggatcgtttttgcgcaaatccagacgaaacataaatgtaataaatggacctgtttaaggttttcctaatctttcacaggcagactcgacaatattattgtcggcaaatatgtcctgtctgttctggacattttgatcccggcttttgcttctgggttaaatgaatattcctcaattgataataagggtgattaattgttttttcttatagcgtatggctaccctctttttctgatgattcctttttaaattggcgcactgtccttttttactgattagattatttttaccaatgctgaacgctgtatttgccgaaagggatgcgtgctttacgataaacgtgcacgttaacgcgctttctggtcttagcaaatgcgggcaggccgccggcgtaaacgcggtatcattcaggcattgagtacgggatgcctgtaacagatattcgtcgtgcgatgtaaaagtcgcatttccccggattcgataggcggccttctggttttcggtcaaaatgctcaacatgcatgtcctgagaaatccgagtctgttgaggcggaggcgctgcaacctctcttccaataacctgcgctggttggtaaaggtccccaaaaaacgattatgaagatattgattgttgaagacgataccctgctcttacagggactggtactggcgctggaaggtgcaggctacgtttgtgatggtgtttcgacggcgcgttccgcagaagcgcatctggctaatgggctctatagcctgctggttctggatatcggcctaccagatgaagacgggctgcatttgttgcaacgtctgcgtcggcaaaagcagatgcagccggtgttgatcctgaccgctcgcgataccatagaggagcgcattgcgggactggacgccggggctgatgactatttgataaagccttttgcactggatgagttgctggcacggattcgtgcgctgatcaggcgtcacgttaatcagggtgactcccgcgtcgaggtgggtaatctgtcgctggatatgactcaccgccagattcatctggacaatacgctactggacctcacaccaaaagagttctccatcctgtcccgcctgatgcttaaggcgggccatccggttcatcgcgagttgctgtatcaggacatctacaactttgataatgaaccttccaccaatacgcttgaagttcatattcataacctgcgtgacaagattggcaaaagcatgatccgtacagtgcgcggtttcggctatgccttatcgccgtcgcgtacagaaaaagagtcgtgataaccatgaatccttatcgctctggcaccacgatgcgttttcggctgatgctcacgattggcctgatcatgctgttttttcagttgatcagcgttgcgtggctctggcatgaaagcaaagaacaggtacagtttttggttgaagcccatctgcataaccgcaatatggataagcacgttaataaagaagtgcgcgaagccatcgtcagccttgccttgccaagcctggtgatgattaccctgacgctgctgctgtgctatcaggcggtaagatggattacgcgcccgctttatcaactgcagcacgaactcgaaagtcgcagtgaagtgaatctggaaccgattgtctttgaaggctcggtgcaggagattgacgcggtgacgcaggctattaatcggctcgtcgcgcgcttaaccgccagtctggaacgtgaacgactcttcactgccgatgttgcccatgaactgcggacgcctttggccgggctgcggttacatcttgagctgttacaacgtaatcaggcggtcgatactcagcctttattacagcggctggatcagatgactgcaaatgtcgcccagttgctgcaactcacgcgtgccggtcagcagtttacctctggcagctaccagaatgtcgcgatggtggatgaggtgatcctgccgatggaagccgagctgagcgcgatgcttgaggcgcgtaaccagacactcactctggacgttgaaaacgctttcgtggttaaaggcgatgccatattgctcaggatgctgctgcgtaatctggtcgagaacgcccatcgctatagcccacccgaaggcaacattacggttcggcttgaaaacgccaccggcatgtcgctggttatagaggatgaaggggccgggattgatgagagtatgagcggtgaactgagcaaagcgtttgtgcgcatggatacgcgctatggcggcatcgggctgggattgagtattgtcagccggattgtccaactgcataacggaaaatttctgctggaaaatcgccctgaccgttcaggctgccgcgccagggtaaacttcgctggcgtgctttagccgttgaaccagcaggccaggaaggcaatcactgtgcagacggcaatcatggtagcaagatattcgctgctgctgcgcgacgaaacagaactgacggatacgctagtggttttcattggtctctccgataacgttttatgcagtatctcttccttatattaaggaaacattaaaccgcactgccctcaggtttcccttcaggcacaggcaagcaatccctgctacgctaagtcattcgcctcacgtcatttcctgaccctgctacaggctgacacggagtgaattgccttgtggcgttgaaaacgatcgatcccatccccacctctttccttcagaccagacaggagtaactttatggctatcgaatatgcagtgatcgcaggcggctgtttctggtgtacagaagcggtatttaaagatgtgatcggcgttgagtcagtggaaagtggttataccggtggcgagcgccctaatccgacctatgagcaggtgtgcagcggtgccaccggccatgccgaagccattcgtattggttttgatcctgagaaggttagctacggtgatttgctggacatcagctttgcaacccacgatccgacccagcttaatcgtcagggcaatgacatcggtacacagtaccgttccgctatttttgttgagacgccggagcaggaagcagaagcccgggcggccattgcgcgcgctcagcaggatcacaatgacccgatcgtgacaaccattgagccgttaaaagcatggtatccggcggaaggttatcatcaggattattgggaaggtgccggtcagcgcaacggttactgcatggcggtgattccacctaaactgcaaaagctgcgtaagagttttgctaaccgggtaaaaagcgcgcagtaagcttacgcatcctggcgaatcttcccgacaaatgcgctgtgcactgtcgcgttttttgcactaaaaaaccgacttttgcgcagccttaatgcgattcgttcagagcttaagcgaatagaacaaaagagaaaaatagtgcttgaccgtttcaggccgactccctatagtagcgccccgttgacccagcgcggtcagcgacaatttgcggtgaggtgtccgagtggctgaaggagcacgcctggaaagtgtgtatacggcaacgtatcgggggttcgaatccccctctcaccgccatcttcaaagaagagcctgaactcacgttcaggcttttttttacctattctccgctgagggggatgagaagccccgaccggggttcgacaaaacggccccgccgttttgcatggccgcaggccacccgcagggcgagcgcagcgagtgaatccccctctcaccgccatcttcaaagaagagcctgaactcacgttcaggcttttttttacctattctccgctgagggggatgagaagccccgaccggggttcggcgtctacataccttgatgcttagaggtaaagagctcagggccgttatcgcgaagaagttgcagcatccgcatcactggcgggctcggtgtgatttcacctcgctcccatttcgatacgctatcgaccgtcatgccaaatgagagcgccacaagcgattgcgacattccccaacgcatgcgcacgtctttaatttcagttgccgtcatgggctttactgctgcaatacgcgcgcggagttcacgattttttgcgcgctttgctatggactccacttcttcatctgttgccagtcctaacgcgtgaaacgctttcgcatcttcaagtagttcgctcaattcggcgggttcagttttcattacatttaacctctctgaccattccgcttctgacgagcaggctcatcacttcactgtttgcacggaaaaacattcttgccacatccctgtaggtatccagctgatcttgatcgatttccctggcgtatttcctcgacaagtttttaacccatccatcgtaataaaccaggttggtgccttgtctgaagaagatgaccgttcgcgcgccgccacgcttgccctggcgaagagcaaggcgctttttaataacgcccccgcctaagtcagcctcaaacacgccagtaataacgtcacctgctgcgtaacacaggacgctgtctgtcagacgcgtttttttaaacactctgtcaaaacgtttatgaacataaagcgtaaaacccatgaaaagtcccttttcgttatggcgagaattatagtaatgattactacacttcacaagcctgaggctcctggtcttacgtccaaatgggtctgaagctattcgtgaaaaagcaagaaatccaatcggtgcgcatcgccattaccgctggccatgaataacacccgcccacactatcagcgattcagattcccccctcccctgttcacgccttgcgtacgcgaagtgcgagccgctccccaaaaaattacacgctacgaaatgtatcccccaccaatacaaaaggcctaccggtctacccggcaggcccttaacacatccatcccttattttttatccagtgaccatgtcgcgctgctgacatccaccttcaccggcaataatccaatctgcgtaaatttatccgcaagtgtctgctgctctttaaagacatccggcgtcattcgctcggcccctaagggcattcttgccagcgcgcgctgccagataggttcgggcaggcccgtcgagccagacaaaattttagcggcttcgccctgatttttattggcccagctgctcagcttttcaagttctgaaagaacctgttttgcggtgtcgggatgaccgtcagcaaatttgcgactggccagataaaaagtgtagtgcggcaccaggccttcggcatttttgagcagccgcgctcccgcgttggtttctacttccgccaggtaagggtcccagatgacccatgcgtccaccgcgccacgctggaatgccgctcgtgcatcagccggaggaagataaaccggcgtgatgtctttgtagctcagccccgcctgctccagggctgataccagcaaatagttcacatccgatcccttgttcagggcgacgcgcttgccttttaaatccttgacactttttatcgtcgaatctgcgggcaccacaatggcttcggtttgtggattcgccggcgagtgccccagataaaccaggtcagcctgtgcggcctgcgcaaaggttggcggcgcatcaccggttgcagccagatcgatactgccgatgttaagcccttccagcatttgcgggcctgccggaaactccacccagtgcaccgcaatcccctgctttttgaattcgctgtccagcgtgccacggtatttgagtaaggcaaaaatattggccttctgaaaaccgatattcaccacgttgagcttttcttctgcctgtgccgtcacgatagtgccaatgtgcgcgaccgcaagcagcgcgctaaataagatttttttcatgtctctttcctgagtggtgttgtcatcagcgcaacataacaaatcaggcgcaaacagcttaatgcgtaaaacgtctatctttagtcataaaacgtcattgcggccataccctgtcacgcacgttaatcgctcggggaaacaggccgagcgcataaaagcgatcggcgattctctgctgctcacgaatgatagccaggttcatcgactgtgtttgatggcttcgccgggctaacgcacgtcgcagcgcgctatcggacatgcccagctctccggccagcagcccggcggcctcttgcgggtacgcatcaatatagcgtcctgtctgctccagggcggtcatcaatatctgcagcaggtctggcgaatggttcgcgaagtgatggtccgcaaggtagaactgatggttattcactcgcccgacaccgtcggcaatgacccgaagctgatccccgctttccgcctcgctcagtaaagggtcccacatcatccatgcatcaacggcattcagatcgctgggcgttaacggatatttaggcggtgcataaacaatccgcacgtcctccggcgtcaaccctgcctcatccaggatttgcagtagcagaaaatggacgttggaacctttattcaccgcaatacgtctgccctttaaatcggcaatctggtttattgggctgtgctttgccaccagcagcgccacgctttgcggcgcgggcggttcccaggcaacatagaccagtgcgcagtgactggcctgggcaaacaaaggcggcacttcacccgtggtgccaaaatctatttcccggtggctcagcgcgtgtaacaactgaggcccggcgggaaactcgctccacaggacactgacgttttgcccggccagctgctgttcaagttgctggcgcgctttgaggatgccaaggttgccgaacttttgataaccgatgcgcaactcgcgctcctgcgcgacggccgttgaagcagtgcgggggcttgacatcaggctacggcgcggcttgatgatgccgaaatggccaaggtgggtacgcaggctgttacggctgattcccagcagcgccgcggcctgtaactggttgccctggctcagttcataggcatttctgaccagcgcctcaatgacgcggggataaagtggcgactcgctgcactggatctgctggcgaataaacgcatcaagcgcatcctgcttttgtacctgtcccgcgcccgtcaccgtgcccagccgcagctgctggggttctatctgcggtgtttcgcagagcaacaccgcgttgtgcaatgtattttccagctcccggatgttccccggccaggaataggctttgagcgtttccatcgcctcgtcgctcagacgcaactgcggtcgccccagtcggcgcgcataccgttgcagaaaatagtctgccagaaccgggatatcctctgaccgctggcgcagcgggggcaaggcaacgctggcgacgttaagccggtagtagagatcttcacgaaaccgccgctcggctatcgccgttgtcagatcgcggttcgtcgcggcaataacccggacatcaaccttcacagcctgagaagatcccacgcgggtaatttccctttcctgtagcacgcgaagcagtttgacctgaaggggcagactgagttcgccgatttcatccagcagtaacgttccgccctgcgcggcctcaaaccagccacgatggcgatcgcccgccccggtaaacgcccccttttcatgaccaaagagttcagactcggccaggctctccgtcagcgcaccgcagttaaccgccataaagggcgcatgacgacgctggctgtgatgatgcagatagcgcgccatcacctctttgccggtacccgtttcaccgatgatcaagacggtggcgtccgtgggtgccagctgatccagaatatgcctgaacgccagggaagcggggtcaattaaatcggggccagcgtgctgcatagcgcattcctgcagagtgagtgaacgctaaacatatcccttgttgcggtcagaaacgagccggtgccggtcgtgaattgctgcaaacgcaacaacagctgtcacacattgctgcatttgcagcagtcattaccacaccgatgaaaatccatctcattgatattaatagataaaaaatacaacaccggttggcacgcattctgcttaaggctatataaccgaaaatgatttttctaattaccaatttcaaatatcgttataaaggaatctgctaatgcgtgatgccgctgaaaaaaacattaaccttttttggttcttaccgacccatggcgacgggcgttatctggggactacccagggcggcagagcggtagatctgccctatctgcaacaggtcgcccttgccgccgataatctgggattttacggcgtactgattccgaccgggaaaagctgtgaggacgcctggctggttgcctcggcgctggctccgataaccaaacagcttcgttatctggtggccgtccgaccgggtttacagccaccgagcctggccgcgcgcatggctgcaacgctggatcgtctgtctgaaggacgtttacttattaatgtggtgacgggcggtgacccggttgaaaacaaaggcgacggcatttttctcagccacgctgaacgttatcaggtcactcgtgagtttcttgatgtctattctcgcctgcttaaaggggaaaaggtggattatcacggggaacatattcacgttgaaggcgctgagatcctctttcccccagttcaggccgaaggcccgcccctttattttggcggctcctcagatgaagccgttgaggttgcagccagccaggttgatacctatttgacatggggcgagccggtagaccaggttgccgctaaactggaaggggtgcgcaagcgtgccgaggaacgtggccggacgctctcctacggcattcgtctgcacgtgatcgtgcgggaaaccgaggaagaggcctgggccgcagccgataagttgatcgcgcacctggatgaagaaaccattgccgcagcacagaaaatctttgcccgcatggactcgaccggtcaggcccgcatgagcgccctgcacggcggttcacgtgatggactgcgcatcgggcctaacttatgggctggcgtcggcctggtgcggggcggcgcaggcactgcgctggtgggtaatccgcaacaggtggcggaacggatacgggaatatcaggcgctgggcattgataactttattctgtccggttatccgcatcttgaagaagcacatcgggttgccgatttactgatgccgctgttgccgctttccacccatgccgataaaaagcagcgcagtgtgaataccggtcctttcggcgaaaccatcgggggcgatcgtcgtcccgaaaaacaggccagtgcgagctaatcagagaggcagtgtatgtccgagcagcatattgtcatcgttggtggcggattcagtggaacggcgctggccgttcatttgggtcgtcttggcagttcaggattgcgcgtgacggttatcgaaccccgggcgcagctggctcagggcgttgcctactcgacaaccgatccggcccatcgcattaatgtgcccgcctcgcgtatgcaattagccggtgatgaagaaggcagttttgaccgctggttccgtgcttccagtgcgtttatccgtgattcggctgcccactggcatgacggcaatgtctatcctcaacgcaggcagtttgcacactgggtgaatcagcagtttgaggcggtaaaggcgcattccccggtcgggctggtacatgtgcaggaccgcgccgtagccttgcggcaaggcacggtcagcaccgcatccggcaagcgtattcaggcggatatcgtggtgctggcgatcagtcatcccgcgccccagcttcccgcagccttaacaccgctggcaaatcatccagggcttatcgccaatccctggcggcatcaagccctgtcacagattgcgcctgacgaccgtgtcgcgattgtcgggtcgggcttaaccatgtccgacatggttgctacgcttgaacggcagggacatcgtggccctgtcaccgtcttttcccggcgcgggcagcttccccggcccaatctgagtgaggcaaacctcagttggcagtttgatggtgatcttaccgtccccttgagcacccgcgcctggctacggcgaataaggcaggacatccgccaggccgaagcaaaatcgattccctggcaggtggtgtttgatgaggtcaggcgcaatggccaggcgatttggcagcgcctgccgttgagtgaacaacgccgctttctgcggcatctgcggccatggtgggacgtacaccgctatcgcatcgcgcctcaggtcggacaggtcttacaggaccgacaacgccgtggtgaattatgcgtgctcgccgcgcggctgactgtggctgaagccctaccgtccgcccttcagcttactctgcaaccccgttctggcaatgcagtgatgctggaggttgagcgggtcatcgtgaccactggccctgcacatggtgctttaaccgagcgcgatgcgctgttaaaacagctttccgacgacggcgttatccagcccgatccgctggcgctgggaatacatgtcaatgcgcagtcacaaacgctcaaccttcagggccagcctaatccccatctttacgtggtcggccccgcggcgcgggggcggtttggcgaactgatgggcctgccccaggttgccacacatgctgaatccgtcgcccgccagttgctgaacctcaccgccgaaacgctaaatgagcgatgtcccctttcgctgactgactaactcaccccttttcttcaccatcccaataacgtgggcggcctgacagtgccgcatccgctcaggagtttgctatgcctaaacaacgtgaaattcgcttaaatgcgtttgatatgaactgtgttggtcatcagtcccctggcctgtgggcgcatccccgcgaccgctcatggcaatacaaagatctggagtactggacggacttagcggtgctgctggaacgcggtaaattcgatggcctgtttatcgccgacgtactgggcatttatgatgtgttcaacggcaataatgatgcggccattcgcagtgccgcccaggtgccggtgaatgatcctctggccctgattacgccaatggcgatggtcacaaaacacctcggttttggcctgaccgcatcgctctcttttgagcacccctatccgtttgcccggcgcatgtcgacgctggaccatctgaccaaaggtcgggtcggctggaatatcgtcacctcctacctggaaagcggcgcccgcaatctgggacaggccacgcaaaccagccacgatgcccgctatgactacgccgacgaatatcttcaggtggtttacaaactgctggaaggcagttgggaggatgatgccgtcatacgcgatcgccagcgccatattttcagcgatcccagtaaggtgcatcccatcaatcaccagggaacctttttccaggtgccgggcattcatctgtgtgaaccttcgccgcagcgcacgccagtgctttatcaggcgggtgcatccagccgcggtaaagccttcgccgcgcagcacgccgaatgcgtgtttgtcgccgcgccgtctaaggtgctgttaaagaaaacggtggccgatatccgacgtcgcgcagaggaagccggtcgcgatccacgcagtattttgattttcaatatgcaaacggtgattgtgggggaaaccgacaacgtcgcccgggctaaatggcaggattacaaacgctatgtcagccatgaaggggcactggcgctgatctccggctggaccggcatcgatttcagtcagtaccaacccgatcaggtgtttaagcatctgcataccgatgcgattcagtccgttgtggagagcttttccactgccgatccgcaacgtgaatggaccgtacaaaatatggctgaatgggtcggcatcggcggctttgggcctctgctggtcggcagcactgaaaccgttgccgatgaattacaaagctgggtagaggaaaccgatgttgatggctttaatctggcctatgccgttacgcatgaaacctttgcagatgtcgtcgatttgctggtgccggaactgcaaaaacggggcgtttataaacaggattatcaacctggtacgctgagagagaagctctttggccagggcgcgcgccttgagcatccgcacccgggcgctggctatcgacgcaccacgtcggaatcaggtctgattgtcccggcggaggcatcatgatgaggtttgttccgccgcctgaggtctgtccatctggcctgtcagcctctggtcaggcctgaactatttcctctgacgctctcttttcaccggatgcgcgataacgcttccggtgtttctcatgcgaaaaataaatgaaataacttattgaatttaaaataatagttatgactttttgttgtttgtttacggctcaattccttcatataaaggcattacctgtacagacaataacgaggacaacatgagcacactgaatattgatgaggatgtggcgatccccgcctcgcctcactccacgcctattcgctccgtcagtgatgtcgcgaaactgattaatacccaaagtgagaaaaacagctatgcgcgctggatagtgtttctggcgctgggcggggtatttctggatgcctacgatctgacgaccctgtcttacggcattgatgatgtggtgaaagcgtttagcttaacgcccacgttaaccggattagtcacgtcatccattatgattggcacgattttgggcaatctgatcggtggatggctgaccgacaaatatggtcgctattccgtgtttatggctgacatgcttttctttgtggtgtccgccattgcagccggtctggcacctaacgtctgggtactgattggcgcgcgctttctgatgggcattggtgtgggcattgatttgcctgtggcgatggcttatctggctgaattctcgaaattctccggcaaaggcaataaagcgtcccgtctggcagcctggtgcccgatgtggtacgccgcctcctcggtatgctttctgattatcttcgccctttattttctgttaccggcgcagcaccttgactggttatggcgtgcctcgctgctgtttggtgccgtgcctgctctgcttatcattgccgtgcgcagtaagtttatgaacgaatccccactgtgggcggcgaaccagggtgatttaagcggtgcagtgcgtatcctgcgcgattcgtacggcatccgcgcgcatgaagacaccagtattcctgcggcaacaaaaccagccgcaccggcggtcagttttcgcgtgttattccagaaaccttatcgggagcgcaccgtggtggcagcggtgatgaacgcctgtatttcgtttgaatacaccgcgattgccttttttctgccctccattctggcgcagtttctgggggcgggcatcttcgaaaccatttccgcctcgctgggactcaacgcattgtttgcctttaccggcggcctgcttggcatgcgtttggcctggaaatttccgtcacgccatgtcgccattgccggatttgccctgcagtttattgccctcacctcactggccttgattggccatcccgatgcgacaaccggcgtggtgtttgccattttgatgctggggctgtggttgtttgctgagggctttggaccgggcgcgcagttaatgatctatcccgcactctcctatcccacacatattcgtgccactggcgtcggttttagtcgttccatctcgggcatcggaagcgccctggcgctgttcatcctgcccatcctgcaggcggcttatggcaccaacatgttctggattgtttcactggccgccattattcccatcattttcttgttagtggtccgttttgagccgactcgccacgatattgatgacccgtcaacacacggagaacaccatgtctgaacctgattacaccttactggccgcgcgttttcgccctctttttgcccgtatcgccgaaggcgccgtcgagcgtgaacgtgaccgtacgctgctgcatgagcctttgcgctggctgaaggcggcgggctttggcacgctgcgtattcctcaggcacacggcggttttggcgcgtccctgcctcagttattccgcttactgactgaactggccgaggccgattccaacctgcctcaggcgctgcgagcccatatggcctttgtcgaggatcgccttaatcaacccgacagtgacgatcgccaacgctggtttcgtcgttttatcgatggcgatatcgttggcagcggctggagtgaaacaggcagcgtcaagttgggagacgtcaacacccgcgtgtctcctaccgacaaaggctggcagctcaatggtgagaagttttacagcaccggctcgttgtatgccgactggatcgatgtttacgctaagcgcactgacaatcagcgtgatgtgattgcggtagtcagtacacatcaggatgcggtggtgcgggacgatgactgggacggatttggccaacgcctgacgggtagcggtacgacccgctttcgcgaggcctgggttgagcctgcgcacgtctatgatttcagtgagcgctttcgctatcaaaccgccttctatcagcatgttttactggcgacgctggccggtattgggcgggccattgttcgcgacgtgtcacagggcgtggcaagcagaaagcgaatctacagccacggtaatgcccgacaggttagccaggatgtgcaggttttacaggtcgtggggcagataagcagttgggtgtgggcaactgatgccgccgtgcagcaggcaacgcatgcgctacagctggcttttgatgcgcacattcagggacgggacgaaaaacagattcatgcggccaacgtgcaggccgaagtggaggcggctaaggctcaggtggtggctgttgactggattacgcgcgcagcaagcgagctgtttaacgcccttggcgcatcagatacgcgcgtcagtaaagccctggatcggcactggcgcaatgcccgtactattggttcgcataatccggtgatctacaagagccgcaacgtgggtgactgggaggtaaaccaacgtgatccgacctttatctggcagattggtggcggcgaataacgcgccgggagaatataaaaaacccggccgaagccgggttttggtcgctacatggctcaatcgaacgctagctgtaagcatgcaaagtgcgctgacacagcgcggaacgcacacaatcctctttgccgaaacggacaatgcccaccatctcgtcctcttcgaaacgcgccagcgcgtctgcgagaccagaaggcaccccagcgggcaaatcgcactgggttatatcgccgttaacaatcaccgtgacattttcgccaaggcgggtcagaaacattttcatctgcgcagctgtcacgttctgcgcttcatccagaatcactaccgcattttcaaaagtacgaccacgcatataagcaaagggagcgatttcgactttgccgatttcgggccgcagacaatattgcataaaggatgcgccaagacgtttaaccagaatgtcgtaaaccgggcggaaataaggggcgaacttttctgagatatccccgggaaggaatcccagatcttcatccgcctgcagcaccgggcgcgtaacgataatcctgtcgatatccttatgaatcagggcctctgccgctttcgcagcactaatccaggttttgccgcagcccgcttcaccggtggcgaagataagctgttttgattctatggcgttaagatagtgcgcctgagcttcatttcgggcttcaatcggtgcccggtcacgcacatcgcgcgccatgccaatcgagtccaacccacccatttgcaccagcgaagtgaccgattcttcttcacgctgacgatgactgcgggagtcattacgaagcactcgtcttgcttctcgacgcgctttgatcactgctttctgtcttcccatagtggcaccttacagttggtttcatttcccgctcaggcaacaagcccgatgcgattacgtgaacgctttagaggtttcagttggcttcctttagagccgtgacaggccatgacgattgatatccggcagcaaaacagccttgccgtttaccggtaaaaaaggaatgaggttgaagagagaaaacacgttgaggtgtaaaagcgattgaggaagaaacgtcctcacgggaaagtgcgatattgtttactgctatacggctgtaaaaacatctatccatgcgcgaactccagtgtgagacatcaacacgcccgattacgctttcatagtaaagtgaaccatcttattggtattttgcaacagtattttcactttaatgaaaaataaatattcaaccgaccgttaacactgaccttacttaaattaaattacgcttgtattacagcgtgttagtttatttttcgtcaggtgaataaacgttaaaaacggagcgctaaaaaaacaggcaggagagaaaagagacggcatcctgtgctgtcacacacaacatgccgtgactaaaatttaatcaactctcaagtaaggactggcctaaataatgtttttcactgataacgccaggtaatacaaaaaagtaccccccgccaaacggacgtatatactcttccagcgcctcaccattcagacgattttgtacggtaagaaagcctaattctaaatcatgctgataacaaacaaacagcaatcccatttccaactggcccgacgctgaaatacccgctgaataactgtatccacggcgcagcatcaaactgctttcggttgctgcggtgcgtgggttcgccagacgaatatgcgcatccagcgcaataatgtcgccatcagggtccttgcgataatccggcacgtcgtgctcgttctgcatgcccagcggtgcaccactcagtttctctcggccaaaaatcgtttgttgctcacctaacggcgtgcgatcccacatttcaacatggaagcggatcaaccttacggcctgataactgccgtgacgcgcccactcgggttcagcctgttcttccgttacccacagcagcttatccatcaacgccgtgttatgcgtgtccgggttagccgtgccgtctttgaagcccagcagattgatcggcgtttctttgcccgcgctgcgtgcggcatgatcggaaataaacccctcccgacgccagcgaatgcctaacagatcgggtgtgtgtttgaccacatcacgcagcgcatgaatcaccgtgtcctgggtgttcgcacagatttgcagcagcagatcgccgtggcactgatttgcatccaacgcgtcgttaggaaaacgcgtcattgtctgcagtttcaccggtttcagcgccgacaggccaaaccgcgcatcaaacagcgagtggccgaccgaaacggtcatggtcagattatccggggcaatctctgccccgagaatgcctgagtcgagcggcggcaactgcgggttggtcactgcgggtgccgtgccgccccgggtcagaaaggcgatgcgctgcgtcagcaaccggaacaaacgctgcagttcctgcttgtcgctggtcagcacatcgaacgccaccagcatcatcgacgcctgttgcggcgtcgtaatgccagcctggtgcacgccataaaacggctgcgtctgctggcgcgcgttcggcgtcactgtgcccggcgaaaagctggcgggattgtcggcggccccggcatgaaacgggcatccggcactgacggccgccgcgccaccgagcatccccaggccttttaagagacggcgacgcgatggctgggtcaactcctgatccttatccatgattaatccaggcctaaggtgccacgcagcagggaaagatcttcagccagggcggtgatcgggcccttcaacgcggtgcggtcggcaggcgtcagtttttcataagattcatacccctgaccgctgcggtatttatccaggatcgcgtcaactttagcgaaattcgcatccactttcgccagaagctggggattcgcctgcttcagaacaggacgcaacagctcgacaattttttgcgcgccatcgacgttagcccggaaatcccacaagtcggtgcggctgtaccgatcttcctctccagagattttactggaggccacttcttcgataagccccgccgcgccaccgaccacttttgccggtgggaaagccagctcgctgacgcgtttttgcagatcgtgcacgtcgttgttcaactgttcggcatagcccgccatatctttggtgctgttatcagcaaacagggctttttccagacggtggaaaccggtgaatttcggatcttgtgcttttttctcataatcatcttcacgggcgtcgatgcgaccatccagatcggagaacagctcagcgatgggttctatacgttcataatgctggcgcgtcggcgcaaacagcgctttggctttttctacatcgccggctttcaccgcgtcagtaaaggcctgggtgcccgtcaccagctgattcacttcatcagtcacataggctttataagcgttgatcgggccggccagttgcatcagttcgctcttccctttctgcgcacttttgccgccgctgccctgcacaatcaacttaccttttggattggtcagcaggccacaggtcatttcatattcgccagcttcgaggttggcggtcagtttttgactgaaacccggtgcaatattttcgcgctcctcaaccaccatcacacctttgaggatttcccattccagcgctttttgactgttatttttgattaaaaactgagtcttacccgcctgaaccgtcagcgacacaggctcgcactgcttgtcagtgacactcacgctaacctgtgggatcgcggcggccagcgtagaaccggaaaccgccagcagcgaagccagcaccgcattacggcgaaaacgcatcatcatatttttccctataaagtcagaggcgcggcgaacgcgccaggtaaacgcgttagcgcgcagcggctgagggttcagcgcgtgcaggcataacaaacagtaataacgcgggaatcaaataaagcagccagacggccacctcactgatgctgggggcttcctgatagcccagaatgccctccagcagcgtgccaaacagcgagtgcgtcgataaggtattactcatatcgaacgccacctgctgaaaatggttccacagaccagcctcatgaaaggcgcggatagcgcctgccgccagccctgcagcaacgaacagaatgaaaatactggtccaacggaaaaagtgcgccatgttgaggcgcacgccgccccagtagatcgccatgcccagcaacacggcagtggctaacccaagcagagcacccagcggcggtgcgtaacccacatcctgcgtgaaggcggccagcaaaaagaacaccgattccagcccttctcgcgctacggccaggaagaccatcaggaccagcgccagaccgcccccggcggatttctgcaaggcctgatcaaccgcctgctccagttcccgtttgatattgcgcgctacccggcgcatccagaacaccatagaggtcaggatgacgaccgcaaccaccgccacaataccttcaaacagctcttgctgtttctggggaaactcgcccgtggtctggttaataaagatgcccaacgccaggcaaagcgcggcggcaataaacacgcccgcccacatggccggaaaccattgtgtgcgctgcgtccgtttcaggtagctggcgatgaggctgacgataagtgccgcctccagaccttcacgcagcatgatgagaaaaggaacaaacatcgccaacctcttaaatgttaagcagcgtcaataagacgtaaatttacgtaaaaacgaacgataccgattatcattaccactcagaaaaaaacaagttccttggtgaaataatttcgtaactgtctgtgccaaatgccaggcaaaaaaaagcccgccctcaataaggcaggcttttcaacacgtaacgcgttttatttggtcaggaattcagcctcggcagcctcaaagcgttcgacggcctgcgcagagggttcacgactcgccaggctaaagatcacgatggcgatactcgcaaagataaagcccggaatgatttcatacagtcccagccagccatactgtttccacaccagcaccgttaccgcccccacaatcatgcccgccagcgcaccgttgcggttcatacgtttccagcacacgccaaacagaaccaccggcccgaatgccgcgccaaatccggcccatgcatagctgaccaggcctaaaacccggttctccgggttagacgccagtgcgatagcaattaatgccaccaacagcaccatcagacggccgacccataccagctctttctgactcgcatttttacgtaaaaagcctttgtagagatcttccgtcagcgcactggaacagaccagcagctgacagctgagcgtggacatgaccgccgccagaatcgcagaaagtaagatgcccgcaatccagggattaaacaggatgcgcgccagctcaataaagacacgttcgccattctgcgaaacgcctgcggcctgagaagggttgttctggaaataggcgataccgaagaaaccgacggctaccgcacctgccagacagagaatcatccaggtcataccgatacggcgcgcggtgcgaatagatcgatgtgagtccgccgccataaaacgcgccagaatatggggctgaccaaaatagcccaggccccagcccaataacgacagcacggcaaccacattcagtcctttaaacatatccaggttttcagcgcctttggcctgaataaccgccacggaatcgctccagccacccacggcaatcaccacgaaaacaggcgtcagaatcagcgcgaaaatcatcaggctggcctggaccgtatccgtccaactcacggccaggaatccgcccaccagggtatagagaatcgtggcggccgcaccggcccacaaagccgtggcgtaatccatcccgaaggtactttcaaacaggcgagcgcccgcaaccacacctgacgcgcagtagatggtgaaaaacaccaggatcaccaccgcagaaatcacccgcaaaattttgctgcgatcttcaaagcggctggtaaagaagtctggcagcgtcagggcgttatcatggtgctctgtctggacacgtaaccgccccgccacgattttccagttaaaccatgccccgataatcagaccaatggcgatccagctttccgagataccggaaagaaaaatggcaccgggcaatcccatcagcaaccatccactcatatcagaggcaccggctgacagcgcggttacgacactgcccagactgcggccacccaatatatagtcgtcgaagtttttggttgagcgccaggcgataaaaccgatgagcaccatcccgaggatataaattaaaaaggtcaccaacattggcgtacttactgtcatttgtttctccgttattatccgatctcttaagagaaatctttttcctgaaccatcggaacgtgacggcgtcagggtagtaccgcatcaagagaaagcgatttcccttaaggcgcggtatcctgccgtaaaggcacggcgcacacaatgcatttaacacatccgtcacattggtttcacctcccaggcctttttaaatgttcacaggttgcgcccgctcacaattaagttgcacctttgcatccctttcaccctttatcttgaatggggttgcaacattggcgagtttcttgcagcaagatttgtgccgcttttaaatgttaataatgaaaggggtttcaaagtgtgcaactgaggtcacatttaacacggttgcacaaagttgcaacatgggtaatagtgcagcccatgctctggtcaaaaccgttttaaggaagagaaaatcatgggaacaaccaccatgggggtgaagctggatgaagccacccgcagccgcattaaactggcggcacagaaaattgatcgcacgccgcactggctgattaaacaagcgatctttaattatctgacccagttagaagcgggtgagacggtggaagagattccattgcagctgagcgatgcggccgccgatgagcttgcccaggaagagatagttcagcccttccttgaattcgcagaaaacattctgcctcagtcggttgcccgctcggcggtgaccgccgcgtggcgtcgtccagagaccgatgccgttcccatgttgcttgagcaagcccgtcttccggccgcgctggcagaaaaaacccatcagctggcgtacgcgctggccgacaagctgaggcaccaaaaaggggcaaccggccgcgctggcatggtgcagagcctgctgcaggagttctccctctcctctcaggaaggcgtagcgttaatgtgcctggccgaagccttgttacgtattcccgacaaaccgacccgcgatgcgcttatccgtgacaaaatcagcaacggcaactggcagtcgcaccttggccgcagcccgtcactgtttgtgaatgccgccacgtggggattactctttacggggcgtttggtctcaacccacaatgaagccaacctgtcgcgctcgctcaaccggattatcggtaagagcggcgagccgctgatccgtaaaggcgtggatatggcgatgcgcctgatgggcgagcagttcgtgaccggtgagaccattgccgaagccctggcgaatgcccgcaaacttgaagagaaaggcttccgctattcctatgacatgctgggtgaagccgccctgaccgccagcgatgccaaagcctatctggtttcctatcagcaggcgattcacgctattggcaaggcctcgaacggccgtggaatctatgaaggcccgggcatttcgatcaagctgtctgcgctgcatccgcgctacagccgcgcccagtacgaccgggtgatggacgagctgtatccgattcttaagtctctgaccctgctggcccgctcttacgatatcggtatcaacattgatgctgaagaggccgaccgcttagagctttctcttgatatgctggaaaggctctgttttgaacctgagctggaaggctggaacggcattggttttgtcattcaggcttatatgaagcgttgtccgtttgtcattgatgaactgacggaccttgctcagcgcagccgccgccgcttgatgatccgtctggtaaaaggggcctactgggacagcgaaatcaaacgcgcccagatggaagggctggaaggctatccggtttatacccgcaaggtgtacaccgatatttcgtatctggcctgcgcccgtaaactgctggcggtgccgaacctgatctacccgcaatttgccacgcacaatgcgcacacgctggcggccatctatcagttagcgggaaataactactacccagggcagtacgagttccagtgtctgcatggtatgggcgaaccgctttatgaccaggtcgtgggcaaagtggcagaaggtaaactcaatcgtccctgccgtatctatgcaccggttggcacgcatgaaactttactggcttatctggtgcgtcgcttactggaaaacggcgcgaatacctcgtttgttaaccgtatcgctgatacgacgatgccgattgacgagctggtggccgatccggtggcccaggtcgaaaaaatgggcatcagtgaaggcacgctgggcctgccgcatccaaaaattccacttccacgtgacttatacggcagcgatcgggtgaactctgcgggtctcgatatggccaatgaacatcgcctggcttcgctgtccagcgccctgttgagcggtgccagtgagccttacgccgcacaaccgcttatcgacgcaccgctgagcagcggggaaagccagaatgtcgtcaacccggccgcaccgtcggatgtggtaggtacggtccgcaacgcctcagaacaggaggtttcgcaggccattgaggcggcggtgaatgccggccctatctggtttgctacgccaccgcaggagcgtgcggcgatccttgaacgtgccgcgcagctgatggaaggtcaactgcagcaattgctgggcattctggtgcgtgaagccggtaaaacctacagcaatgccattgctgaagtgcgtgaggccgtcgatttcctctattactatgctggcatcgtgcgccatgattttgacaacgaaacgcaccgcccgctaggcccggtggtctgtatcagcccgtggaacttcccgctggccatttttaccggtcaggtcgcggccgcactggctgcggggaacagcgtactggcgaaacctgccgagcaaacaccgctgatcgccgcccaggccgtggagattttactgagcgccggtgtcccggctggcgtactgcaactactgccgggcctgggcgaaaccgtgggtgcgcaactgaccggagatgaacgcattcgtggtgtgatgtttaccggctccacggctgtcgccacgctgctgcagcgtaaccttgccggcaggctggacccgcaaggccgtcctaccccactgattgccgaaaccggcggcatgaatgccatgattgtcgactcttccgccctgaccgaacaggtggttatcgatatcgtcgcctcggcctttgacagtgcaggtcaacgctgctctgccctgcgtctgctgtgtgtgcaggaagacgtggcggatcatacgttgaaaatgctgcgtggcgcgatggcggaatgtcgtatgggcaacccggaacgcctgtctaccgacatcggcccggtgatcgatgaagaagcgaaagccaatattgagcgccatattcaggcgatgcgtaataaaggctttaaggtgtaccaaacggcgcaggataatccgcaggacagcaaagagtgggcaacgggcacctttgttaaacccacgctgattgaactggataaggtcagtgatctgacccaggaagtgtttggccctgtgctgcacgtggtgcgtttcacccgcagcagcctgccgcagttgattgaacagattaatgcatcgggttacggtctgaccttaggcgtgcacacccgcattgacgaaaccattctgcaggtaacggcgggggccaaagtcggcaacctgtacgtcaaccgcaatatggtcggtgcggtcgtcggggtacaaccgttcggcggggaaggtttatccggtaccggcccgaaagcgggtggtccgctttatctgtatcgcctgctggcgaaccgtccggatgacgcactgagcattaccctcgcccgtcaggatgctgaacgtccggccgataatgcgcagcgtcaactcctgctggctccgcatcaggcattgaccgactgggcaacagataaacctcagctgtcttcactctgccagcactatgccgcgctggcccaggcgggaaccgtgcgtctgctgccaggcccgaccggtgagcgcaataccttcctgttgttgccgcgtgagcaggtgctgtgtctggcggacaacgagcaagatgcactgattcaactggcggcggtgaccagcgtcggtagccaggcactgtggccggacgatgaactgcaccgcaaagtgctcgccaccttgccgacggcggtgaaagcccgtatcacgttggcgaaagatccgctggctgggcattttgacgccgtgatctaccatggtgatgccgaccagctccgcagcctgtgcgaacaggtcgcggcgcgcgaaggggccattgtatcggtgcagggctttgcccgtggagaaaccaatctgctgctggaacgcctgctgattgaacgatcgctgagcgtgaataccgcggcggcaggtggaaatgccagcctgatgaccatcggctaacgatcttcagactttctctctgatcgctaatgaataaaggttcatgcccggcatgaaccttttttttcgccttacacatggcgtaatttatttctggcatccgtcatcgttaaataaaaacagcgttaaaaacgaatatttccccagaaagaaaaaaaaccttattgcagcgaccaatgctgtcaaaagcgttgacagaaagcgtcaggttgataacgaaaacgcacgccctcagcgctattctcagcccttttctgctgatgactggcgcacgacaatgcgacagaaacttattagtggcactaacaccttattccatcctgtcaaaacaagcccaatctaataacctgatttaaaggcagtaattttatttaaaatttcaatatcccattattaatacaattttgttaatccttattttagccagccttctacccctttaggcgtatttggggatgttcttgatatttatcaaaatccacaaccgaaacttaatcataatttaaccagcaaaatttacgttaattgacatttcatcacctttgccctcaatgcaggcagatgccttcacgcctgcctgcgcgtaacgtttatcctgacccggagtacattgtgaataaaaaagaaaggctattacgggaatggcatcctgaagattctgatttctggcaacggcgcgggcagcatattgctcgtcgaaatttatggatttcggtttcagcgttgctgctggcattttgtgtgtggatgttgttcagcgccgtttcggtttatctgaatcaggtgggttttcatttcaccattgaacagctctttttattaaccgcacttccggcgctgtcgggtgcccttttccgcattccctactcctttatcgtgcccattttaggcggccgtgtctggaccacgttcagtaccgctatcctgatcgtcccctgtgtctggcttgggttcgctgtgcaaaacccgcaaacgccctatgcggtcttcatcattattgcgctgctgtgcggactggcgggggcgaacttcgcgtccagcatgggtaatatcagcctgttcttccctaaacgtcagcagggttcggcgctgggcatcaatggcggcttgggtaacttaggcgtcagcgtgatgcaactcgttgccccttttatcatttttgttccgtttttatcccacggcgttccccacggcgaaggatcagccatctggctggcaaacgcggcctggatttgggtgccgctactggcgctgaccgctattgccgcctggtttggcatgaatgacattgccggaatgcgttcgtcacttcgtgaccagttgccggtgttgaaaaatgcccacgtctggatcatgggcatgctttatcttgccacctttggctcgtttattggtttttccgcgggctttgccgtgttggcgaaaacccagttcccagcggtggatatcacgcatttcgccttttttggcccgctgcttggcgcactggcccggtcggggggcgggatgatctccgataagctcggcggcgtaaaagtgaccatcattaattttatgctgatggtgatgttttccgccctgctgttcctcaccttacccggcagcggcagcggctcgttcctgggtttctacctggtgtttatggggctgttcctgaccgccgggctgggcagtggctccacctatcaaatgatagcggtgattttccgccagctaacgcaaagcaaaatgctggcacaaggccacagtctggacgccgcacagcatgccgccgtgaccgatacggcggcggcgctgggttttatctcggcactgggcgccatcggcggtttctttatccccaaagcctttggcagttcgctggccattacaggtacgcccgccgccgccatgattgtgtttttgcttttctacatcgtctgcctgctcgtggcctggcttttatatggtcgtggtaagaaaaccagcgattaattcacccgattattattcacacatcagctcatgattgagttgaattcaacgggtcgttgacccgactggagaagtgttatgagtaaacttcttgaccgttttcgctatttcaaacaaaaaggtgaaagtttcgccgatggccatgggcaggtttatcacaacaaccgtgactgggaagacggttatcgtcagcgctggcagtacgacaaaattgtccgttcaacccatggcgtgaactgtactggctcctgtagctggaaaatctatgttaaaaacggtctcgtcacctgggaaacccagcagacggattaccctcgcactcgcccagacctgcctaaccatgagcctcgcggctgtccgcgtggtgccagctattcatggtatctctacagcgccaaccgcctgaaatatcctctggtgcgaaaagccctgcttgagctgtggcgtgaagcactgcgtgagaaccgcgatccggttgcggcatgggatgcgttgatgtctgacgcggaaaaatcgcgtcagtacaaatcgcagcgcggccatggcggcttcgtgcgggccaactggcaggagatgaatcagctgattgcggcagccaacatctggaccattaaacgctatggccccgaccgcgttgctggcttctcccctatcccggcgatgtcgatggtgtcctatgcggcgggtacgcgctatctgtcgttaatcggcggcacctgtctgagcttttacgactggtactgtgacctgcccccggcctcgcccatgacctggggcgaacagacggatgtgccggaatccgctgactggtacaacgcgggctacatcattgcctggggttcaaacgtaccgcaaacgcgtacgcccgatgcgcacttctttaccgaggtgcgctacaaaggaacgaaaaccgtcgccatcacaccggactacgccgaggtcgcaaaactgagcgatcaatggctggccccgaaacagggcaccgacagcgccctggccatggcgatggggcatgtgatcctcaatgaattccacctgaaaaatcccagtgattacttcctgaactatgcccgtcagtacaccgacatgccgatgctggtcgtgcttgaagcccgtgaagacggcagttatgcgccgggccgccagctccgtgccgctgacctgatggacaatctgggtgaagaaaacaatccacaatggaaaaccgtggcctgcaatgccgatggcgaactggtggtgcctaacggctcgataggtttccgttggggtgaaaaagggaaatggaacctggagcaaaaagcgaatggctccgccacccaactggcactcagcctcatcgatcagaacgatgcgctggtggacgtggcgttcccttacttcggtggactggaaaacccacagttccgccatgttaagcaggacgacatcctgctgcataaactgccggtgaaaatgctgacgctggcggacggcagccgggtgcccgttgcatcggtttatgacctgaccctggcgaactatggcatcgatcgtcagctggatgacagcaactgcgcacaggattacagcgatattcgtgcctattcgccagcctgggcggaacagatctgtggcgtgccacgcagccagatcgaaaagatcgcccgggaattcgccgagactgcccataaaacccacggccgttccatgatcattctcggtgccggtattaatcactggtatcacatggatatgagctatcgggcgatgatcaacatgctggtgttctgcggttgtgttggtcagagcggcggcggatgggcgcactatgtcggtcaggaaaaattgcgtcctcagacaggctgggccccgctggcgtttgcgctggactggaatcgccctcctcgccatatgaacagcacttcgtttttctacaatcatgccagccagtggcgatttgagaaattgcaggtcaaatccattctgtcaccgctggccaatccacacgattacaccggtcacctgctggactttaacgttcgggcagaacgcatgggctggctgccttcctcgccacagcttaacgtcaacccactggagatctgcgcccaggcccgccaggccaacatgacgccagaagcctggaccgctcaggcgttgaaagccggtaccgttcgtatggccagtgagcaacccgacagcggcaccaaccatccacgcaatatgtttatctggcgatccaacctgcttggctcatccggcaaaggccatgagtatatgctgcgctatttactgggcaccgatagcggtattcagggccagccagtggatgatccggcgctgatgccagaggacgtggagtggcagaccgaggcgctggagggcaagctcgacctgctggtgaccctcgacttcaggatgtccagcacctgcctgttctcggatattgtgctgcccacggcgacctggtatgaaaaagatgacatgaacacctctgacatgcatcccttcatccatccgctttctgcggcagtcgacccggcctgggaatcaaaaagcgactgggatatttataaaggcctcgctaaaaccttctcggcactctgtcagggccacctgggtgaggaaaccgatgtggtgctccagcctgttcagcatgactcgcccgccgaactggcgcagaccggcgatatctgtgactggaaaaaaggccagtgcgacctgattccgggtaaaaccgcgccgcatatcgtgaccgttaagcgtgattatccggccacctatgagcgcttcacctctgtcgggccgctgctggaaaaactgggcaatggggggaaaggcatcagttggaataccgataaagaggtcgaactgctgcgcaaactcaattacgtgaaagcggacggtccggccaaaggacagccgcagatcaacagcgccattgacgctgctgagatgattttaacgctggccccggaaaccaatggtcaggtcgcggtcaaagcctggaatgcgctgagcgaattcaccggccgggaacatgcccatctggcccgcaacaaagaagaggaaaaaatccgcttccgggatatccaggcgcaaccgcgcaagatcatttccagccccacctggtccgggcttgaagatgagcatgtctcttataacgccggttataccaacgtccatgagctgattccctggcgcaccctgagcggtcgtcagcagctctatcaggatcacccctggatgcgggcgttcggtgaaagcctggtggtttatcgtccaccggttgatacccgcagtctggaaggactaaaacatatcccgtccaacggctttccggaaaaagcccttaacttcctgacgccgcaccagaaatggggcattcactcgacttacagtgacaacctgctgatgctgacgctgtcccgtggcggaccgattgtgtggatgagcgaagccgatgcgcaggaactgggcatcgaagataacgactggattgaagtgttcaacgccaacggtgccttaacggcccgtgccgttgtcagccagcgcgtacctgccggcatgaccatgatgtatcacgcccaggagcgactgatgaacattcctggttctgaagtaacaggcatgcgcggcggtatccataactcggtgacccgcgcctgtcctaaaccgactcacatgatcggtggatatgcccagttggcctatggcttcaactactacggcacggtcggttccaaccgggatgagttcatcctggtgcgcaaaatgaaacaggttaactggctggatgatgaaggccgggatcagattcaggaggcagcaaaatgaagattcgctcacaggtcggaatggtactgaatctggataaatgtattggctgccacacctgttcggtgacctgtaaaaacgtctggaccgggcgtgaaggcatggaatatgcctggtttaacaatgtcgagaccaaacccggcataggttatccccaggcctgggaagaccaggagaaatggaaaggcggttggatacgcaaaatcaacggccaactgacgccacgtctggggagccgcagcaccgtgctgactaaaattttcgccaatcccgtggtgccgggcattgatgattattacgagccctttacctatgactaccaacacctgcataccgctaaagcaggtaacagtcagccgaccgcccgtccacggtcgctgatcagcggcgaacggatggataaaatcgtcggcggccctaactgggaagagctgctgggtggggagttcagcaaacgcagtgccgataaaaacttcgatgccatgcagaaagagatgtatggccagtttgaaaacacgttcatgatgtatctgccgcgcctgtgcgaacactgcctgaacccaggctgtgcagccacctgccccagtggcgcgatctataagcgtgaagaagacggcattgtgttgatcgatcaggataaatgccggggctggcgtttatgcattagcggctgtccctacaaaaagatctatttcaactggaagagcggcaagtcagagaagtgtattttctgctatccccgcattgagtcaggcatgccgaccgtctgctctgaaacctgcgtgggccgcattcgttatctgggcgtgctgctctacgacgccgataagattgccgatgccgccagcacggaaaatgagcacgacctgtaccagcgccagtgcgacatcttccttgacccgaacgatcccgccgtgattgaggaagccttacgtcaggacattccgcaaagcgtgatcgacgccgcccaggcttcaccagtctggaaaatggcaatggactggaagctggccctgccgcttcacccggaataccgcaccttgccgatggtctggtatgtgccgccgctgtcacccgttcagtcggtggctgatgccggtctgctcgaagcggatgccagcgttttacccaatgtggaaagcctgcggatacctgtgcaatacctcgctaacctgctgacggcgggcgataccgcgccagtattacgcgcgctgaaacggatgatcgcaatgcgccattacaaacgctcgcagaccgttgacggcgtgacggacacgcgcgcgcttgaagaagtgggcctgagtatgcagcaggcagaagagatgtaccgttatctggccattgccaactatgaagaccgctttgttatcccctccagtcatcgcgaactggcccgggatgcctttccggaacgcaacggctgcggcttcagttttggtgacggttgccacggcagtgatactcagttcaatttgtttaacagccgccgcattgatgccattgatatcggtaataaagcgggaggggaatgatggatatcctgaaacttattggcatgttgcttgaatacccggatgaatcgctgtggcagcaccaggatgaggtgcatgcactgatcgcgcagcactatcctgcactttcgtcctttacccagcattatctgacggcagcaccgctggataagcagagcgactggtgcgccctgtttgaacgcgggcgggcaacatcgcttctgctgttcgaacatgttcatgctgaatcgcgcgatcgcggtcaggcgatggtggatctgcttgctcagtatgagcaggctggtctggaactccactgccgggagttgcccgatcatctgccgctctatctggagtacctgagtcaacaggatgagaaagcggcgcgtcagggcctggaggatatcgctccaattctggccctgctgggcggacgactgaaagcgcgcggcagtgagtttagccagctgtttgacgcccttctcaacctcgcgcgtagcccgctgcacagtgagagcgttgcccggcaggttgccaccgagccgcgcgatgacacgcgcgaagcgatagatgcggtatgggaagaagaacaaattaagttcatcgatgataaagcctgcgatcgttctgaacggcaacagcatcaacgccgtttcagtcaggacagccgtccgcagtatcttgaactgacctctggaggtgcacgataatgcactacctggacgtgttattttttgatatctatccctacctgtgcggaacggttttcctggtaggcagttggctgcgctatgactacggacagtatacctggcgcgcctcatccagccagatgctggacaaaaagggcatgcgctttacgtccaacgtctttcacatcggcattattgggatcttatttgggcatctgttcggcctgctgacgccgcactggatgtacgaaccctttctgtcgattgccaccaagcagaaactcgcgatgatggccggtggcgtctttggcttgatgacgctggttggcggctttctgttgctgaaaagacggctgctcaatccacgcatccgggcgacctcgacgcgcgccgacattgtgattatgggtattcttgtggtgcaggtttccctggggctgatttccatcatcttttcgctgcagcacatggacggccttggcatgatgaaactggtcggctgggcgcaggcggtggtgacattccagggcaatgctgcccagtggcttgacggcgttgagtggatttatcgtgttcacttgattctgggcatgacgatttttctggtcttcccgtttacccgtcttgtgcacgtctggagcgcgccagttgagtatctcacgcgtcgctatcaggtggtacgcgcacgtaaataagacggacgtgaacccggccacctcatcgctggccgggttcatgtctctttttcaaaccgctgatatctcgcccggccagacgttatgacccaaacgcgtggtcaggtgccagggtaaactggccgttttatcagggttggaaagataaacagcgcgcgccctgctccccgattcgtcagcgaccagacggcaatggaacacagtgagcagagggccacaatcaccagcggatacaggctggcccacagccaggaaaaccacgctaattcaaacagctgatgacgctgtgccaataaaatggccgtcataccgaaatactcaataaagatacgatggagaacgtaaatgggtaaagtatgacgccccatccagttgagccaggccatgctgctgatctgatttaaccaacggcaggcggcaatactgatgaggatggcaaggacagatacgaaaaggcgcttatccacaccgaacaggccgtgcagacctgccaccagcgccagcaacaaccacggcaagctattttcccgtcgccactcgctcaaacgcagcatctgcgtacaccagaacgtccccagtatgaagaacacaaaatactgcgccagactctgtggcccccagaaggggatcaccttttcaacagccaggtaattgagcagcgttgccgcgaccagcaatagcaccttataacgctgaaaaagtttagcgcacaggaagtagatcgctaaaccatataagtaccatgaggtactcatcgccagaaatgtcagcgtaagaaactccgccagcgatcccgcataggccgcattaagattttgtgaaatacgctgtccggtgatttctgttgaaatccccacgattgaccaccactgaatggctccccatacaaggtacaggtaaaacaaattagtgattcggctggtcgtgatgtgcttccaggggcgattaataatggcattgctggccaacaaacctgaaacaaagaaaaaagcaggcatacgcagtggggataataatctattgaactgcccccacatctctgcgggaaacacgcccgcgctcaggtcttttagcgtattttcaaagccgggcaacaccgtatggtacagcacaacaagcaggatacagatgcctttgagcgtattaatccatgcaatgtgttctttttcattgtgcttcatcagggaatttccgccgtggtgtcattccagaaaaaacgaattcgcgctgctcatatgatcgttatgtggaaagtattccgtatgtcctgttacctgaatgtagcgaaagtcttaaagttatctgtcggaaacggtttagaacccagctttacaataaagggtattctttgacatttatgccggctttaatttgacgtcggtaacattcattgagcgtcagagtaaatcaggatcgcccatccacaatggaatatgactttactatgaattttctctgtcggtacttgcttaacgctatttttgccattacgttaactgtactttaagacaggccactcaacgtaagtgcaggtgagcgttttcaatgcatccgacaatcgcgagtgagtcagtcctccaggtaaaagagtttaccggaaaaacatttttccctacgtcgaaacgtattaatcatgttgccctttctcctgccgcctttggggtaatttcaggtccggatatcacctgaataacagagaggacgcacgggtcgtgaggataaatgccgttaatagcttattcgtctttttgtttatttatgctctgcggaataacgcagacaggctaaaaaggccatttggcttttacggattcagggttaatttttcagttttccattcggcacgcgctgtctgaatggttgttcctgatttactcacaaatggaatgtcatcatgaagcagacgcgttttacgcccgttgccactaccgctaccgttaacgaccagcagatactggcaaacgactggggcaccctgaccaaatacgatatgacctatgtgcgcaccgatggcacagaacagcgctttacccgtgaagcttatgatcgcggtcacggtgcgaccatcctgctctacaaccgcgacgacaggacggtcatcctgaccagtcagttccgcatgcctgcttttttgatcggtcatcactttgagctgattgaagcctgtgcaggtttgctcgacgcacgtgaccccattcaggccatcagaagcgaagcggaagaagaaacgggatacaagctgaatgacgtcactaagattggcgagatattcatgagccccggttccgttaccgagcgtctgcacttttttatcgccccttttacccgtgagatgcgaataaacgcgggcgggggtattgccgccgaaggcgaagatatcaaggtgattgaggtgccgattaaagaggcgcttgccatgattgatgcggggaccatcattgacgcgaaaaccattattctgattcagcatctggtcatcaaaggcatctgcacgccagactaacgtagacaaaaaacgggccagtaagctggcccgtgaattcaggatgatgaggtttgcgtttccgcctgatgcttactgagtaaacgcgggtggataaacagtatccgtccgggtccacggttcaacagcgtccagaccaacagcgaaagcaacgtacacaccgccacgccggttaacggcatcaacagcgcccaaccccagctaaagcccgcattgccgaaccagccataatgtagcgccagggaaatggcgctcagccccactaactcgataaaaattcggtgtaagacataaatctgcagcgtattgcgtccgatgtaattcaaccaggccatattgaaatgtgcgttaagaaaacggcacagcacaatgccaaagacgatggtcaacaggctgtaaaacggatttttataaatgccgcccgcatgatgaaggatgccgatcagcgctattgtgcccagccacagccagtgacgacctttcagaccgctgagctcaattaatgccgcgctgaaaaagacgcccagtaagaaatagagatagttttgcgcgacgctggccggtccccatccgggaataaggctaaactgcgccgcatagttcgccgcaatcgcgaatacgaccagcactattttctgtcgatgaaaaagcttggtcaccaggaagaatccggccagcgcatacaagtaccacaggctggtcatcgacagcattaacagcttgataaactccagcggggaatcagcataggcggcattcttactgctcgacagccgctcgcccagatgggttgagatgtagtggatactcagccattgaatcacgccccacagcaggtagaggtagacaatattgctgaacttcttggtaaagaccgctttccagcttttcttcacgaccgaattggcggccagcagtccggacacaaagaaaaatgcaggcatccgcaggggcgaaagccaggtattaaatgctacccaccagtgagccgggaacagaccggcagtcagatgagggagcgaaggtgcgaacgtggtgatgatggagtgatgcaataccacaagtaagatgcatcctccttttagggtattaatccagaggatttcctttctgtcctgactcattatttcgtcctgatcgtgcgatgaatttgtgaagaattatttatattttcacgcaggtctcaatcaggcggctcttaaaagttacagtctgttactcgcgcagaagccaatccggtataaaaccataaaaatcaaaccattaaaataatactaaatgtaaattttcagaagaaactgagaggataaaagcagaaggcacggcaagaaacgccgcctgtttccggcggcgttggcgtttattgattaagaaatttatcgagaaattgtcgagtccgcgcttgctgcggatcgctaaacagcgctttagccggtccatgttctacgatgcgtccctgatccataaagatggcgcggtcggcgacgtcgcgggcaaaactcatctcatgcgtgacaatcaccatagtgcgcttttcctgcgccagcgcgcggatagtgttcagcacctcgcccaccagctccgggtccagcgcagacgtcggctcatcaaacaaaatcacttcgggtcgcattgccagcgcacgggcaatcgcaacacgctgctgttgaccgccggacaaacgccttgggtagctgtcttctttaccgtgaagcccgactttttcaagcaggctccgcgcgcgggcaatcgcgtccgcttttgcttcaccttttacaatcaccggcccttcaatgatattttccagcaccgagcgatggggaaacaggttgaagttttgaaagacaaagcccacctgctggcgcaacaggcgcacctgctctttctgcttgtggatgccctggctggcatcaatggtgatatcccccactttaatgcgaccggcgtcaggcacttcaagcaggttaatactgcgcaacagcgtagttttgcccgagccgctggggccgatgatggcgacgatttcaccgggcgcgacgtcaaggtcaatgccgtgcagtaccgtttgtccgttaaactttttcaccaactggcgaacgtcgattgcactcatttcgcctcctgatcctgacggttaacgtgggcttccagacggttttgcaatgctgacagcacggtggccatcacccagtagatcagcgaagccgccaggtacatagtgaacacttccagggtacgcgaggtaatcaattgcgcctggcgaaacagttcaggaacctgaatggtggcggccagtgacgtatctttcaccaggctgataaagctgtttcccaggggtggcaacgcggtgcgggcagcctgtggcagaataacccgacgcagggtttgccacggcgtcatgccgatactggcagccgcttcccactgaccacgctcaatcgctgcaattgcgccacgcagcgactccgatgcataggccgccatattcagcgataacccaatcatcgccgacggaatggggtccagctcaatgccaaactgcggcagaccgtagtagatcataaacagctgcgcgatgagcggcgtgccgcgaaagatggacacatagatacgcgccagccagtttaccggccagaagcgcgataaacgcatcagggccagcaaaaagcccagtatcaacccaaagaacatcccgccgatactgagctgtagcgtgaacaacgcgcctttaagtaaaaaaggtgctgaatccagcaccagttgtaaactttcctgcattatttcgttacgtccgcgccaaaccatttctctgacagctttttaagtgagccgtctttctgcatgtccgcaatggcctgatcgatcgctttcagcaagtcttcattgcctttgcgcattgccacgccggcttccagacgagagaatgccggaccggctaccgccatggtatcaccggttttcttcaccagatccagggctgccagacgatcgaccagaatcgcatcaacgcgaccagaacgcagatcctgatacttggttgggtcatcatcgtaagtacggatatccacgcctttgacgttggcacgtaaccactgttcgtagttcgtccccaggcctacaccgactttcttaccggccagatcctctggtttggtaatgctgcccgcgtttttcttcaaggtcagcgcctgcacacctgaaatggtatagggcgtagagaagtcatacttctttttacgctcatcggagatcgtgacctgattgatcaccacatcaatacgtttagaatctaacgcggctaacataccatcccacttggtcggtttaagctcggctttcacccccatgtgtttcgccagttcctgggcgaactccacttcaaaacccgtcagcttgcccttttcatcctgaaaactgaaagggggataggtgccttccaggcccacacgcagctcgcctttgcttttaacctgcgccagtaaattctccgccgcaaaagttttaacgctgacgcctgcaaccagcgcaacagccatcattcccgtcaccagctggcgacgaatctgtgaaaaagccatgtttaccccatttattatttatcagtgtggtgttaagcggctaaacacggtttgccgctctgtcattatgggcgttatttcgcataagacgtcaaaataacgcctgaattataacccttttttgcgctgcgtctcagaccgaagggtgataagcaaataacgccggtgcaccgcctgtatgcacaaacaacaacgggccttcacggcgaaaacgattctggttaatcccatcaataagaccggccatcgctttaccggtataaacgggatcaagaaaaatgccttcaagacgggccagcattttcaccgccgccatgccctcttcattcggctcgccatagcgcggagaaaaatactcatcccacagcgttatgggtgcctgcgcctgcacggctaactgcgccgccagcgcctgacgcagttcttcaaccttaggcaattgctcactgactttacgcgacacggttacgccaaccaactcggtctctggcaggagctgctccagtcctatggccaggcccgcatgggtcccggcgctgcctgacgccacgaccaccgccgcaaaatccactacgccttcactttggtgcgcaatctcctgggcacattccacgtaacctagcgcacccagtgcatttgagccgcccacaggtagcacgtaaggccggaaaccctgcgcctccagacgttccgcctgttccgccagctgcgcagcgggatgggtcagggcatcgaccatcaccacgtcaacatccatcaggtccagcatcaggcgattaccattggtcaggtagttttcgctctgagtcgcaatcggattttccagtaacgctacgcatttcaggcccagtttcgcggcgaccgccgccgtctgccgcacatggtttgactgaatggcacccgcagtcagcaacacatctgcgccttcacgcagggcatctgcggccagaaactccagcttacgcagcttgttgccgcccatcgccagcggcgtcacgtcatcacgtttgataaagatgtcgcggccaagatggtctgataatcggggcaggtattctaacggcgtcggtgcgcccagaagttcgatacggggaaactgatgaataagatgtaaagacaatgcggcctccagttgggcacagagcagtgatctttacagtgttacagaagatgcagaaaggatcatcctgaattcaaactcaggtgatgaacggagaagcggtcgggcaagtatccaccggctgttacacaacttccccattttcctcctgtggacagggggaaaatggggtgggagacagaatgtcagaggaaaacctgcctgacacttttacccgatcccttaacgttgctgccagcccaaaaactggtcgtacttacgaagcgcaatacgataattgttattacctgcatcgggtaagtcttcttccaggcattgatgccagctattgcctgtgagtttttcagccggaaaatttctggccttcaacatatcgtcaagccgacgtaagcgaaccacatattcacgaatggtgcttgggctcatttcagtctgttcaaacagatattgtttgaaggccatgatgtcaaaataattaggatgcgtattacaaaaaatatcgctgcaaaaacgacaaagtgccgttaattctggctgcagttttagccaaagcggctcatcaatcatttggtccatccgtgcgatggcctctttattgatgatctggccacgaaagaccagcgccatacggtctaatactttgccacagtgtgaacaattgttttggctgtgtttgtagtctttaagataacgacttaaaggtctggctttggttttggctcccactgttgagtccccgatttcttattatttatagatcgccaggaactgagccttctagcgcgctcccgtaagtcgggcacgcaagcgttttatcgcctgactgtgcagttggctgactcgggattcccccacgtcaagtaccgcgccaatctctttcagattcagttcttcctggtagtacagtgtcagcaccatcttctcgcgctcgggcaacgcctcgatcgcttcaatgacgcgttcacgcagactcccttccattaactgatgaagtggattggcctcttcgtgcccttccgtcaccagttccgcactgtcaccgtgttcttctcgatactcatcgtacgaaaagagctggctgttgttggtatccaacagaatctgccggtactcttctatcgaaacattcaactgttgcgcgacttcctgttcagaagcggcccgacccagcatctgttcgacctgatgcatagccccggctacctcgcgagcatttcgtctgacgctacgcggcgcccagtcccggctgcgaagctcatcaagcatggccccacgaatgcgctgtactgcatacgtggtaaaggcggtaccctgaagcgcgtcatagcgctccaccgcattcaacagaccaatgcccccggcttgaagcaggtcgtcaagttcaacactggctggcaggcggacctgtaagcgcagtgcttcatgacgtaccagtgggacgtagcgctgccagagcgaatgtttgtccatcacgccatcggcggtatagagatcgttcacgttgactaccctgcgttaatgaagttatcggcatgattatgcaattctgtagggcttttgattggctgaataggcgggataaaccaaggttatttcaaatttgtgatgtttcagagcggaaggttccgctctgtacagacagactaacgtaatgacagtaaacgctggcgggttgcggatggcacgttttcccacagtgcacaaacctgcccttccatctcctgataaaacggaccaatgctttcacgcgttttttcatccgcatgaaaacgcacctgcccggaatcaccatcaatgcttatcattttgttgacaaaaagccgctgtaaatcgctgcgcaggaacaacccgttatccacactgttgtctgccagaaaaccctcatcgttttctcgtgtgtcgatatggcaggcctcaacccacggccacagatgcgggtcgagaaggctggttccggtaataatacaggcaccgtagcgcgcttttaccgccgccataaattctgactggctggctttctgcaacactttggctttgactcgccgccccacttcagtaccaggcataactgcagccggaatcttgtgttcgggcgtgctcagtaccacaataaactggatgcgacgagactgcgggaaacaggggttagactgcacgttgaacagctgccaccaggcatcttcttcatcttcacgcatcaaaaccagtttataaccccggctgttgatcaggttttgcgcctgcgcagaatggggatcgaccatggcatagacatagcttttccctatcaccttccagcgattatcctcatcctcttttccacggcgaaaatagtgaaaaggctgctgctgtttaaggtagtactcaaaacggcgcaaatagtttttccgttcattgtcgttagcaatgaacaacaggtcttccagaggactgttactctcttcctgagcaaagaccgcacgaatttttaacgtccgatagctggttgaaggactcagcagcgcacgcgccgtcagttctttctcatcagggtattgctgtgcataacgccgggcgatctcttcaaaagaaaggcgttcgcccggaagcaggtcatagttaaagcgcataaccaccccagaacatgaaaagttatatcaaaatgagagtcattctgaaggggattatcggcatagttgtaatgaactgtaacgctgcgatgacttttttattatttccctgtccggattaaaatcctgccgttttagtacgccacatttgccttattgcgcgagaaaacaggtattttcgtcgcggatgcccgggtgttttttccgcttgtgcgctgcgtctttagcttatcctttactttacctgcttttttatcggttattcttgccattagtttcacttgcaagctcgtattctttcatcatcactctgcaagcgcagaccggttctagaggaagtgaatagcggggacgtcatacatgcccatcgtaaatgggttgattgtagaacgggtgacaatttccagagagttaaggggcatggcctgagatcagggcttccaggaaaccttgctgaaacaattacctaaaggaccacacctgccaaatgaggaataaccgcaaagtgacttttctatcgccagtactgctgttgatactgtgtgcaaatgatcatcaaggaacattaccgcaggagtcgctctgatgcgcgttttactaacaggtgcttatggtcaactgggccgctgcatactggatcgctttcccacagactggattaccctggcgtgtgggtcagcggaacttgatattactaaaagatctgcaattgaactgattgtaaaaaaattccggcctgatgtgataatgaatgcagcggcctatacagcagtagacaaagctgaaaccgaccgcgtcagagcgatgaaaataaatgcgcttggcgccgaaaatattgcacttgttgccagacaatatggttcacgccttatccatatctctacagactacgtattcgatggcagaaaaaaaacgccttataatgaagatgactcaccctgccctattaatttctatggtttaagtaagtgggaaggtgaaactcgcatattaaatattttacctaatgctgtaattttgcgggcttcatggatatttagtgaatatggtgacaactttgtccaaaggatattaaaactggctaaatcgcacggcgaaattaaagtcgttaatgatcagtttggctgcccaacttatggcggagatgtggcactggcaatgataaaacttgccgagcgcgttgaaagtcagggaatttatcatttttgtggcgaccaaaaagttagctggtgtgaatttgctcaaaccatcttcatcattgcccaatacgacgtaattgtaaaaggcattgatagcggtagttatcctaccaatgccttaagaccaacgaacagtgttctgagttgcgataaaattcgtgatcttggtatttccccatcaaattgggaagctgcgcttcgccttgttgttccaactcctgcctattgttagtatgaccagtcaagcctgcataacatgacaggcttgaaaactggagatatccaacacctgtacatatccgatgcgaatttgaatattaaaaacaacctgacatcaaatcccttgaattaaattcgcatttaaaaaaacactattcttgattaaaaatcatcgcttcacttttaagaatatcggcttgctccagatatttttgcagagcatatttccattcagacgctttgtttttgataactttaatccctgtcagagaatcgtattgcataacatcactggcaaaacatggtacacccaaagcctgccaggctaatacatcaaaggcacccttatgtctgttaaaattccctctttcgagtggtgctaatgctaaatcagcattgaggtgcaagagcgtgccaaagaagtctttttttacgactttccggtgatattctttaatatttggtttaagttccgcggggcattcaccataaataatccagtcaattctctcagaatagtgctgaataacaggtaataaaaaacgccaatcactctctcgaagtgaatgtaaagcaagggcaaccctaggcttgttatgtattgttttttctgtaagtaaagactcaattacaacatcatcaggaatattaatcacgttttcgttcattgtagagaagaactgttcggcttcaatgttacgtacaataaccatatcaagcttgcagatgatttcttttagatttaatagattatgtttactgtaatcgtagaatactgttgcatccaatataacaaatcctgcttgcttctgtttttttagcgagagatgttttatcaactctggagccataatatcgttataaatgaaatagcatgcaccgagacttgcaatttcattagcagtcaatccattactaactgaggcgaatccatttataccctgtgatgaaaacgcacgagataacgtatccccgcggagttgggtctcagtgttattaaccgtatcgagataaacaacgcctttacgatgaagtcgcagagggtagagagagagatttttttcaagtctgtaatgatcatcgtggaagttataagctttacaagcaaaaggatcgacaccctcagccagaaagaatgtttcatcaattagcgcactgtcctgatgcggaaggtggatgacctttgctatatcatttccttcgtatgtcattactgcctcatgagccaccacattaaaaagaccatgctgacagaaacacattaaaagatgactcacagccgattgtaacagttgaaagcgtgcgtcgagtttgcctgccataatgaaactacgggttttaaacaaaatacaggccgcattcaaactcgaaacattacgatcaacgatcaacttcatccaggggccctgagcagaaagcgcttcaccatatccctgattgtaaattcctacatgcgatataatttcctgaccagcactataaataaggttattttctaacgtcaatttcccacccactgcagcgatagtgtcacgcttcaagtgtttaagcattgtccgaggccacccattattacaaaaaatcacgcctgcactgaccaggagaaaatgctcagtctcacattcagaaataaccaaatttattttttcggaaatggcaatatcatttttcgacttatgaattttgaaccttgctgaatctacttcgattaaattatttaaccataaatcacactctggataagtcttgtcttcatgaataacgatgaattgataatcgatgccatcaagtgtttccaggcatgaaagaatcgttttctgcaagctatcaagattattgtatccataaacaataatagtatatttatccacacagcattgttcatccatcattttaacagtcgcaaaattatttttcacgacactaaaatttttactacctgattcatgatagtgtttttttatcgtcgccaaatttgattctgtaacctcaacactatttgtttgagcacaaacaatcgcgagcggaatatgtatcatgcttgacgttagattaagtctgattaagacagataaaaagcgtagttctgcgtcagcaaaaattgttccgggttcaagaaaacgttccaaaagtttgccattacgaagcaaaaaatgctttcccattaatcctggcatttgcaaaatcaaatcaggattaataccgggtgaaaaaaagggggcgttttctccggatggaaaacggtagctcttatcaaacataccaatttctgctacactttcattgaatacagaaagtgcagataaaaacatgttagtgtgcagcatgtcagtatcatgcattatgaaagtagttgcgtcaggaaaagcaaagtaatcctctaactttccactaaactcattttgcgcattcacaaaacccacatcaatattttgcaacttattcaaacccaggcttttattatccggacctttccactcagcattatcatcaacaattaccagaaaattaattttctggcttatcagatcttgtgaaatctgactatcattgtagtgttgatgaatattttttaaccaactcacttcatcataaatacgtaaagcagatttttcttgtgccctacgctgtgttttttcaaaaaaaacattgagttgagcaatgaattcatcatcaaatttttttatatgcagatgaactttatataactcacttcgcgctttttccagactgttcgaatcatcagcccaggcaacaccaccaccacccatatcaactatcgcagcgttaccaattgctaatttctcgtatccttttgctatttttgcaacgacaggagccccgcacatagccgctaaattgcaggtccctgaccactcataggtataaaaaaccttagcctgtcgtaatttattagcaagttcatctaatggcagtgggttttgaatagagattatttcgatatcgtcaggaagttcactaaagtttatagcgctttcaggaaccctgtttagatataataaatttagtgttttctctctaccatcatcaaagaaaagttctttatcagggcctactaaggtcaaaaaatcgacatttatttcattcactattaattgagaactgtaccagaaaatgaaatcctcaacgccctcatccatcttatttccgttaagtaaagcttcatgattcaacatgtaacgcactacaacttcggcctgaagaggattacctgattgtatttctggatatacagcgatcccgggacagttctcattaacatgccgtgcataagacgcttcatcaaggagtggcgtattccaacgggggtttgtcaattgacaacctaccatataggcttcccccccctcagaattaatccgatggcatagtttgtgcagtacctggatgccgcctgacgactctctgtaatcaggagaaagtatgtagtaagggtgcgttaatgtcatggtgttatttcctttatcccaaattcagatatataaatttgcatcctgtgaatgcggcatcatcatttctgcttactttaacgctcattaaatttagctccatgcctctttccagtcgtgaaggccattaccgcgtaagtaccattcgttatgaattgattctcttagttgatcgcctaagcggtaagttgtttccatatcatgcagatgagcattgattgctgccatccagtctttaaaacgattttcgaccagcgttacaggcaagccgcagcgataaggtgctatatctgttgcaataattggaacaccacacgtgccaatctcaagcagacgtaaattgcttttgcactcgttaaaatggtttattgtcaaggggactaaagcaagatcaagattcaggctcgccagtttttctgggtacatattaaatggaacgcctggatgaaattcgcattgcactcctcgcggtttcattcccatgaagacccattccactttatcctccattgcttttattagaggcaacagaatctctaaatcaccggcatgcgttcccccgcccgcccatccgacgcgaatttttttacccattcctcgttgactaagcaaatgcccccactgtttttctgcaagcctgttttgagcgattcgaatatccgaatgaaagcgactgtaggcatctgcaagtggtgcagtcgaaacaacaacccagtcagcacactccatcacacgtcgaagattttttataatgtgctggggaaaatgattacgatttccattttttagtgggacgtttagtaagtaatcgtcatactcaacaacaatttttgcatcacaaacgtcccggtactgactcattattgaaggaaaacggctaccgctaagtgactccagtaaaatgacatcaggctgtaattgcgccacttccatgacaccgggaatatcctgtgtcatgcccccttctatcataaaatgactttccatggctttaaaaggctgcaaaattctgtggtttccacacccctgccaatctacatgatgagccaaaacgacaggcaatggacggccaggtaggggttgctgaaaacgcgctgttcccggacccaacgtaaaggcttttcccatgcgctgcatgtgagaatgatagcagggatcgtttaaaaggtcggagcgccactggcttcgaagcatgatgtaatcttgcaggagcggcctttcctgaatatgaaacttctctgtcattagcctcgttgccccgcccatgtggcgaacacgcgcccatggagtccatacattcaggtagccttgttgctgcgcacgtagccctaaatcaacatcagcaaagtagagaggatagttttgttcgtcaaagccattaagattgaagaaaacgtcttttcgcaccatcatgcatgcagcactgacggcgccaaggttatgctcggtctgtaaataacgttgaaatcctttggcttcaccgtcagccccatcccagggattatcgacgccattttgtgtgccgaggagataaccaccatgttggattcggccatcgtgatactcaagccttgccccgacaagcgcaatttctgggcgaagtgcatgttcaattagagcatcaagccagtcagcttcaataatctgacagtcattattgagaaatagcagaacttccccgtttgcacgttctgcagccctattattcattgcagcgaaattgaagggtgagtcaaagcgcaataatttaatttgttctaattttagcccttccaactccgctaaaaattcacaggcctgaggatcagtcgataaattatccacgatcaataattcgtaatggggatagcgtgttttttccattagcgaatcaatacaagctcgcagtagcgtcaaatggtcacgagtggggataattattgatactaaaggacgttgttcccagtgataccttacacgtgaaaagcccgcgtttttgcccttttcaattacagcaggtacaccaagacgatccaggtgggccttgacaacattctgatatgaaagagttgacacctcattttcgtaccaaaagcgattagactcatctgttttgacaataacctcggcaagatgtcctattgcctccgtgccttgctgctcaacagcgcgccacatgagttcatagattcccatgccaacactgatgtcagacataccacccagtttacttgccttgagacgatcaaataacacggttcgaccgacatatggcgtacagcgaagcaaatcaatgttaggggcgggacgcaacacaacacccggctcattcatcgcatcattataggtttcatcgccataccaaaaaaatcgatttggatgacgcaatcgttgttcagccaatagcagaagagcatctgacaatagttcatcgccagccataaccaataatattgctgcgtgtccttctttattaattattacgttcacctcatcaaccaaagaggttttgcaacgttcaatacgcccttcttccaggtcaatgtcgataacgctgatgagatctatgagcgctggagctaatgtttgttttttgatagcatttaaagatcgaatacaagcctgactatcgccttttccatcaataataactacggctatatcgccactctcgggcacagaggctataaatgagagtaacgcctgacgacgtgcattagtaatgcatcgctcttttagccactgttcaatagagtacgttttatctacccaggacaaaacagactggctgtgaaatcgtaaagcatgtcgagaactttcactcatcttccagcagcgtgcttccatcgggatggataagagcgcctgaatggccggggcaagctgccattttttttgaaattctgactggttttctagtgtccaacttttagctgcgtcgaaacctttcttgagcagttcaatccactcatcagtatctggacaaaagcgtaaattaaggacattaaaatgagacgattcaaattcattgatattgtgttcaccaagatagccctctacataatttgttgaggcaaggaaaacagggatgcctagcatcagcgccttgggcactatctcatcactaccgatgatgacatcataggtatccagccagtctgcatagatacgactgaccggattgctgcagtcaaaccattccatcgataccgatagtgatttgagttgctgctgtaattcatacatttctgcagaaatgtcaggagcaaagtagagaattttctttatctcagttcgagatcgcaatgagcgagaaaaactgaattccgctgatgcggtgtagggtaaaaggtgtagatttttttccagcaggccattttgtatcagtcgttcagaaattacgggggataagcttaatgacacagatgcaagttggttctcgagttctgcgccccaaggcatataaacatcattgtaatcataaaaatggcggaatatgactggcgtagtgcaagttaagtcacttagaagtgacaaaagcttttctgatacaaagccacgatatatccatatcagatggtaactctttgtaatttcgccttgtttatcactaatgatgcggaatgcctgatgttgacgaagtcgttcgagttcgaatgacagtgctttaccatgagaactggttacgacatcaacctgccatcccatagaaagaaagacatcgataacatcaagcgattcgcttacggacatggtgaaacgctcgaatttatcgatgctaattaaaagcctgcccatttgtatccctcttattgtaacgcgtcagtactaatcagagcgcaactgtggcactcatatcagactattgtgttacggttagaggcgaatcaagggaggaaatagctaccataaatcggcgcaattatatcgattaaataaaaacgccctcacatttgaggcgtttttagtcatacgtggtttgcggcgattaacgcagcagagacagcatggtctgtggtacctggttggcctgcgccagtacagaagaaccggcctgctgcaggatctgcgcgcgggacatgtttgatacttccgtcgcgtagtccgcatcctgaatacggctgcgggccgcggtcaggttggtcacggtgttgttcaggttgctgatggtggactcaaaacggttctgagacgcacccagcagactgcgctgattgtcgacggctttaattgctgcatccacatctgccagcgggctgccatcggtgccgcctgtcgcgttaaccgttccgctcaggacatcgaagccttccgctgatgtagtacgtgcgttgccgttaatggtctgaccggtagttgaagcagtcgcacctgtagtgttaaacaggttgaagccgttactggcactgatagtgataccgattgtttcaccatcttttgagccgacctggaagttgtaagtgctgctgcctgaaccggtgttcagcactttgataccgttgaaatcggtctgctgagtaacacggttaatctcttccatacgctggttaacttcagactgaatcgagtcgatgtcagaggctgagttagagctgttctgagcctgtacggtcaggtcacgtacgcgctgcaggttgttgttcacttcggtcagtgcgccttcagcggtctgcgacagagaaataccgtcgttggcgttacgggccgcaacggtcaggccgttgatgttagaactaaagcggttagcgatagcttcaccggctgcatcgtctttagcgctgttgatgcgcaggccggaagacaggcgctcaatagcagtacctaatgaagactgagattttgtcaggttattctgggtaaccagtgacagggtattggtattaataactgccatgataagtatccttcataaagagatttaggtttggtttttggcctgcggcttaattgccttcaataatgttatcgcccgctatgagcaaaactttaagccttgtggtgattttttatcttaataaaggaaaaaacagctttgtgagaaattaattgaccgagtcttagaatcgtccttactggcattcagcgccacccaaaaaccccttaaaattatgtttttaaacaattatctaaaaatacacatagcaaaatcacagtatctgactagtatataaacctctaacactaccgcatttctgttgaagagaaagatgctaagccattgaattaccgtaaaaccatatgaatgtaatagtattagtaatgaaacggacgcaataatactttatcgcgcaattgaaaccctcaccgccctattccgtctacgcatcaccttttttatgcatgttataatcacgccaggttaataagtgcctctctatcagttaattaaaacaagctatctttacgaaattataacgataatcaacgaaagtaacgcacaggatgacagtagcagactatcctctgaaaaatctttgccacagtaataaatccacggatgggaatatgagatagctgcatgaggtttcaagcgccagaagacggagctcacgttttgcagcttccttcacgcaggcccctatctaaaagccacttagcatagtcagaacggttgaaagccttaaaacagtactgcttcacttcagctaatattcggccgtcgtaaaactgtgattagcccagtatatgctggtataaaataaaaaaacgccctcattactgagggcgtttttagtcatacgtgatttgcggcgattaacgcagcagagacagcatggtctgtggtacctggttggcctgcgccagtacagaagaaccggcctgctgcaggatctgcgcgcgggacatgtttgatacttccgtcgcgtagtccgcatcctgaatacggctgcgggccgcggtcaggttggtcacggtgttgttcaggttgctgatggtggactcaaaacggttctgagacgcacccagcaggctgcgctggttgtcgacggctttaatcgctttatcgatatcggccagcggcgtggtgccggtagctgaaccggttgcgccgcccgttactgcacctttcagcacgtcaaaaccaattgctgaagtagtacgggcgttaccgttaacggtatcgcccgtgcccatagcacgggtattctgggtggtaccagactgaccggcagccgccaggtcaaaaccgtcgcttgcgctgatggtgataccgatagtttcaccgtcttttgcgccaacctggaagttgtaagtgctgctgcctgagccggtattcagcactttgataccgttgaagtcggtctgcttggtaacgcggtcgatttcctgcatacgctggttaacttcagactgaatcgagtcgatatcagacgctgagttagagctgttctgcgcctggacggtcaggtcacgtacgcgctgcaggttgttgttgacttcggtcagtgcgccttcagcggtctgcgacagagaaataccgtcgttggcgttacgcgctgcaacggtcaggccgttgatgttagaggtgaagcggttagcgatagcttcaccggctgcatcgtctttagcgctgttgatgcgcaggccggaagacaggcgctcaatcgctgtacccagtgatgactgagatttgctcaggttgttctgagtaaccagagacagggtgttagtgttaatgactgccatgataaatatcctttaataagaaagacagggtcaggtatttggcctgcggctttatcgccttcactattgttatcgcccgctgtcgttgaaactttaatttttccttagggtttttgatcattttgcagtaaaaacggccccgtgctggtaaaccggattccatatttcatgaagaagacatctgcacactacatgaggtatctgccagacaggcattgaaacctccaatgcagcctaaaacctgtcaatgttgtcagccgttgatactttatagatgaaaaaacgccctcaataatgagggcgtttttagtcatgcgtggtttgcggcgattaacgcagcagagacagcatggtctgtggtacctggttggcctgcgccagtacagaagaaccggcctgctgcaggatctgcgcgcgggacatgtttgatacttccgtcgcgtagtccgcatcctgaatacggctgcgggccgcggtcaggttggtcacggtgttgttcaggttgctgatggtggactcaaaacggttctgagacgcacccagcaggctgcgctggttatcaacagctttaatcgctttgtcgatatcggccagcggcgtggtgccggtagctgaaccggttgcgccgcccgttactgcacctttcagcacgtcaaaaccaattgctgaagtagtacgggcgttaccgttaacggtatcgcccgtgcccatagcacgggtgttctgggtggtaccagactgaccggcagccgccaggtcaaaaccgtcgcttgcgctgatggtgataccgatagtttcaccgtcttttgcgccaacctggaagttgtaagtgctgctgcctgagccggtattcagcactttgataccgttgaagtcggtctgcttggtaacgcggtcgatttcctgcatacgctggttaacttcagactgaatcgagtcgatatcagacgctgagttagagctgttctgcgcctggacggtcaggtcacgtacgcgctgcaggttgttgttgacttcggtcagtgcgccttcagcggtctgcgacagagaaataccgtcgttggcgttacgcgctgcaacggtcaggccgttgatgttagaggtgaagcggttagcaatggcttcgccagcggcatcgtctttagcgctgttgatacgcaggccggaagacaggcgctcaatcgcagtacccagtgatgactgagatttgctcaggttgttctgggtaaccagagacagggtgttagtgttaatcactgccatgatatttttcctttaaaaattgagccagattaaggcgtctgaattcggtttgctcaccgacaacctgattatcgtcagcacctactcaacctttagaaaaaaaacacagtaattttcagatgggcaaatccatgaagacaattaaagaaaggctgcttatccagccatcgattttgtaaaaaacaggctaatcttttaccactcgctgccgatactcattctacttagcgtaaacctcgtaaaggataaactatggcaagtgtaagttcactcggtgctggtacgagtctcgacctcaatactctgtacacgagtctggaaacagctgaacagactaaactgacgccaattactcaacagcagtcgtcttataacgctcagcttaccgcctggggcgtggtaaaaaccggtcttgcgaaagtgcaaaccgctgctgcggccttacagaatgcgtccgctatcgcggcaactaaagtgaccagtaccaatacggcatttaccgccacgcttgccagtaaagcctctgccggtaactactcgattgaagtaagtcagttggcctcttctcagtcactgctgtctaaatcagcaaccagtaaagatgccgatctgggtgaccagagcatggcatcccgcaccattactatctctcagtctggtcagaaaacgccgcttagcgtgacgttgacgaaagaccagaccagcctgtctgatatccgcgatgcgatcaacaaacaacaaggtagcgttaacgcgagtattattaaagctgatgacaatacctattatttgtccctgaccgcacgtgatagtggaacggcgaatgcgatgacggtcagtaccaatgacagtaccctgtctcagtacattaactacagccagggcggtagcagcaatgctatgaccgaacaggttgccgcgaaggatgctcagttaaagattaacggtgtgtccatcacccgtagcagcaataccatcactgatgcccctgaaggcgtgacgcttaatctcagtaaaacaactgcgacgggatcacctgaaaccctcactgttgccaccgataatcaaccgatgacggcagcgatacaggcttatgtcgatgcttataattcgcttcagactaccattggtaatcagacgaaatatactgctgtcaaagctggcacagctcaggactccggtaatggtgatttattaggtgataacacgttgcgcaatattcagaccagtttgcgtagccaactttcatcgcctcagtccagcggaaacctcacaacactggctcagcttggtattacgcaggatgtgaatggcaaactgactgtcgacagcactaaattgagtaatgcgttaacgaatcagccttccgatgtgttgagcttcttgacaggcgacggtaaaacgacaggttttgcaacgcaggctaacaacactctgacgcagatgctctcaagtagtggtcaggtacaaaatgccactaacgggattaatacctccctgaagcagctttcagaccgttacactgaagtgaatgatcagatcaccgcaacgatggcaaggtacaaaactcagtttaccaatctgagcaccctggtttcttccatgacgcagaccggtaactatctgacccagcagttcgctaaattataacaggagtagtaagcatgtacgctaagtccggtactcaggcctatgcgcaggtgggcgtggagagtgcagtgttgagcgcaactccacaccagttggtcgtactgctgtttgatggcgcaataagcgccatgaaaaaggccgctattttaattgaacaaggcgatatcccgggtaaaggaaacgccttatcaaaagccattaatatcattaccaatggcttgcgcgcaggcctgaatcatgaggtgggcggtgaaatttctgccaacctcgataacctgtatgagtatatgactcgccgtctgttacaggccaatctcaataatgatgttgaggcgattactgaagtcgaaggtttactgaataacatcgcggatgcctggaaacagatcggtcctaactatcagccacagcaggatacgttttaatgagtaatccactcgagctgctaaaagggtatcagcaattgctcacgctcagtaatgctatgctggagcacgccagacaagggcaatgggatgagctgttgagttgcgaatcaacttacattagcagcgtcgagcgtgtagcgcgtgataacgatgccgacattctttccgcactacagcgggcacaaattcgcccggtacttgagcaaattctgcgtaacgaaaccacgctgaaaaccttgttgggcgagcggatgcatgaattgcgctcgctggtgacgacctcaacgcaacaacaaaatgtcatgacctcttacggcaatatggcgggcaatattctttacccaaaaagccaataaaaagccgactttcgcgggtggaaactatatttttagttcacccgcgtaatttcttcactcttatcccatacttccagttctctctcctttgactggaagcacgttatgcagaatccaaccttattgcagtttttccactggtactatcccgatggtagcaagctgtggccggaagtagccgataaagctgccctgcttaacgacataggcattaacatggtatggctccctccttgttataaaggcgaatcaggtggctattcggtgggttatgacagctatgatctgtttgatttaggcgagttcgatcaaaaaggcagtcaagccacgaaatatggtgataaacagcagttgctggatgcggttaacgcgttacgcagtcacgatattggtgtgctacttgatgtcgtgcttaaccataaaatgggggcagatgagaaagaacagattcgggtcaatcgtgttaatcccgataatcgtgatgaaatctatccagaagtggtggagtgcgaagcctggacacgctttaattttccggtacgagcaggacaatactcaaaatttgtctgggactacaagtgtttcagcggcgtagatcatatcgaaaacccggatgaaaacggcgtatttaaaatcatcaatgattacaccgccgaaggctggaacgatcaggtagataatgaattaggtaatttcgattacctgatgggtgccaatatcgattttcgcaataatgccgtcagagaagagctcaaatactgggcgcgctgggttatggagcaggtgccctgcaccggattccggctggatgcggtgaagcatattccggcgtggttttataaagagtggatcgatcatattcaggacgtcgccagcgatccattgtttatcgtagcggaatactggtcttttgaaaccgataaactgcaggaatatattcaccaggttgacggcaaaaccatgctgtttgatgcccctttacatatgaatttccatgaggcatctaaagccggtagcgcctatgacatgagcaaaatctttgataattcgctggttctggccgatccctggcatgccgtgactatcgttgctaaccacgatacgcaacccttacagtctcttgaagccccagtcgagtcctggtttaaaccgctcgcttacgcgctcattctgttacgggagcaaggggtgccaaccgtcttttatcccgacctgttcggtgccagctatcaggatgaaggcggtgacggcgaagtccatcaggttgatatgccggttattcctgagctggaaaatcttattcgtgcccgtcagctattcggctggggagcacagaccgattattttgatcatccaaactgtgtggcatttagccgcagtggcacggctgaaaaccctggctgcgtcgtcatcatgtccaacggtgacgcgggagaaaaacatatttcgatgggtgaaggctatgcagggaaagtctggcgtgattatctgggacacaagtcagaaacccttaccgctgatgacaacggcagtgcgttgtttagctgtaacggtggcagcgtgagcgtgtgggtagttgaagcgtaaaatgtgtaagatccattttatcgacgctttcaacctgacttacaggctgtaaggtcttgtaggaatgcggtccattggaccgcgttcagcaatttacttcgctaatgccgggcgcattaattgaggttcgatattctggataaccgcaacgccgggctgctttgccacttcagcaatggcgttttgacaatcaagagtcggtcgctcgaccttacgcattgtgaggccgtcgtattccagctccccattatctacatccagagtcatcacccgcatctgacgcgtaacgttgacgtaatccccgttcagcagtgtcagtttacctggtttcgcaatcacccgctgccactggcgacaatccagcgtactgccatcggcatggataatgaggctggccattgccttgtcactgatcagatcgctttgtggccctaccgtctgccagttaccttgtaaatttgccggagcaggcgtttgcaccgcactctcataactattgatttgcgcgcaaccactcagtgccagtgtggcaatcagcatccagtttttcatctttgatccctacaatccggttgatggcggctacgttataatttttacggtaaggtgcgcaagctatctgaatacggtcctcgagataaagcggcattttcatgggtatcaggcgctggcgaacggggtttatccacgccatctgcatgaaggacgacgtcttgccctgccccggctatgcctgacaagcctgatgtaacaggctacactgtgccgctgcaatagatatcaggaaacctgcaatgaaaactccagaagcgtattacgctcaggcgcgaaccctgttcttcactgcccatgctgacttccaggcagcattagatgagctgacggaaagcgatgcacgcgccgccaacatgtcgttgcgagaattacgcgaatggcatgccgagcgcatctacgccgcttttttacgtcaaaagaatctcgatggcattattttctcaatccagctcgcggaaccagataaagccgttgccgccgaggcgatagaggcgtacctcagatcgcatgcggaatcactgggaatgagctgggaagagttctgtattaagaatgaactgtagtgactcagccctttgcaggcgagagggcaagacgcgtgatgcgaacgacagagtaagaaagtgagcacgcgcttgccgatcatcatgttgaccggcttcgctggcgacagaccacagacttatcgccagcgaagccgttactcttcctctgccattttgcctcttacttcaacatatttggcgacggccagcagccggttgatgtgagtcagtagcaaatcgatgtccgactgcatgaactcagaggatgaacgtgaagccgttactatcgcatcctggaccgtttctgaaatggttaacgcattgtcttgcttcgcctggactaataaagctgcaaccaacaacgactgcgcttcgatctgcgcagtcagttcctttgcgtcgacatccatttttgctagtttgagcagaatatctataaccaattgtcgcattgcacttctcctggtgagtgagcgcacatattgttgtgaacgccatcagagtaaaccagatgaaagtgcttttctacgcagctcagaaaaaacgaattaacccgaacatcagcttgatactgtttttatttacagtaaaatggcaaagcgattttgcccttaagggattgttaacatgtttgtagagttaatttacgataaacgtaatgtcgcgggcttgccaggcgcgcgtgaaatgatcttagaagagttagaaaaacgcgtacatcgtgtttttcctgatatcgaggttaaggtcaaacccatggaacgtaatgcgattgaaaccgatctcagcaaaaacgagaaggcgacgatagcgcgtctggtggaagagatgtttgatgaggcagagttttggttggtggctgattaatcccttaatcgccaccacatcagttagcgggagataacttaactctcctgctcactgtggttaatttcaatttcgatatcctgaatcgccttctccagatcttccagcaacgtaccctgcttgttgagcagcgcatcaatgcgggctgcattgccctcatctttgtattcaccggcatcaaaagctaaccaatgggcggaaagtgtctcggtattggtctgtgcatagtgacgcatttctttcagctgtgatgccacgtcacgcaggtaatctgttttgcttttggtttcgattgaatcagtcatgctgtctttccttttggtggtttatccaatgaaaatatcgcctggagatttaaagataggacaatatagcgatattgcattaggaataatcggaagtggctgaagagcctggtgagcgaagtctgagtaagcaggtcaaacgcttagcgtcagcgtttaagcgtagtcgcaatagcgcaacaatgctggctaatgcacagcagcattcatccgtgtcacggcggtttctcacgaaattgttttgctggtctaaactaaacagactgaagaaaggagcaaacaatgcataaacatcagagtaacgaacaacgtaaacatgaaggtgatgtcagcaaaggattacccgaagctgcgccgaatgcgggtaatgcgtacgaggaagacgatcatcctgctaccgatgcgccgaaagatcatggcgaagtcccgagaaaaaatgatgacagccaggatgataaaaaagatccgtttaaggcttcctgattttcctgatcttaagcatgccccaattctgagggcatgctctgcttaagaatgaaggctcgttaaccgccactctcaactgaatatttttatctctcattttcccaggccgaaaagaagtctgtacaggcgttttatcctgtaaatcagacttaacgcacctgccattaatgccaggtatgatgacatgatcagaggcggagaagcctatgctcaaaaacgccctgcacaaggcgtgaaccaccttaacgaaacagcatcagcaggccgtcaggcttatttattcaggaagtctatcagcatttccaggctgatccggtgaggcccatcagaataaaacgtattgtgagcgggtcgatttgcatcaaataaagcctgcagatccacgtcattactcaactggatagcgtccccaaccagtttatacacgatcactttacaagaaccttctggaatcttgtctgaataatctacttttctgttgtcagaataaatttcgtatttaagcatttcgccgctattagaggtagcgagaagcgtttgaattaagtatcgcatttttccctaagcgttagcgggaagagaataaatattaacgctatgtgatttttttaaacagttaaatattttaattaaatattaccacccgtattgtcgccagtcctcgcctgataaccagcaagcacgccccgcctctaccttcaccataaaaactattgattacatacttttttgatgcaggaactattttacaggcttaacaatccgtagcggattacctgttttcatactttaatcacttttagatttgcgcgtagcagtcaaagtttctcgattaattattagatagcaacccactttatcgttaaaagcacgttcgctatgcacagataatatctcactaaaatccatacagactctgaatgaggttataaaaagtgaagtattcgttttaaggcacgcacggaggatggacaataattaaaaagaggaataacagtaagaactgtcattaccaacactggcgtaataatacatcgatatacgtttatgcttctgacgtcaggggtaagtcatcatgatgatattctgaagctggcgtggtaagcgggggacgattcaagaggaatgcaggcctgacttatttaaacgttgttagtcacgccaaaaagagacaggttgcctgtcggcagtgaggcaggtccaatcccgttcttccgtcaccaaggctttaactcccctgttaaggggttatcaggaatacgattgcatgaacgaagcttaatggtgagagcaatagcgcttttcaatgaaaattagcagcgatttgccccactcacgcctcacaccagcgtccagtaagcataaacctgatattgcccgtgagtacgcgccactacacctgcatattcatgatgtcggtataagccgataccagcttgttcctgacctgaatgcccatctgcatagaaattgatgatttttgcagatcgaccatcacatcattgagcgcgatacctggcttacccatttcaaaatcctgggcctgggtacgtgctgtcgtctgggtttcactaattttgtcgagtgcggccttcatggtcgcgccaaagtcgatatggctggtgacgtcgttgcttttgttgttggcctgaagcgacgtcatctgtagctgctgtaaaacaccgtcgattgcctgaattgacattgctgttacctcattgaaaagagatgaagatttttgatgaggagagaagttaacacattgtcaataagacaaagcccctaaatgacactaaaaaccgtggcttattcacccatcgaattttgcgtttcatcaaataatgccaggcattgaagtggaaattttatttaagcaggtcagggagtctgttttgccaacacaactaacccggtcaattacgtcaggcaggaatcggtcatgaatgcgagtgcagccgccacacaagatcaagataagaaaggcttcggtgaccttctcgctcgcctgcgtgctaatccacgtatacctttaatcgttgccgccgccgctgccattgcagtggtgtttgcgttagtcctctgggccaagacacctaactacagcgtgttattcagcaatctctctaatgaggatggcggtgccattgtcacgcagttgacgcagatgaatgtaccttatcgctttgccgataacggtggcgcattgatggtccctgatgacaaggtgcatgaactgcgtctgcgcctggcacagcaaggtctgccgcagggtggcaacgttggctttgaactgctggataaagagaagttcggtatcagccagttcagcgagcaggtgaactaccagcgcgcactggaaggtgaactggcgcgtaccatcgaatcactgggtccggttaaaagcgctcgcgtgcacctcgcgatgcctaaacctaccctgttcgtgcgtgagcaaaaagccccttctgcttcggtaaccttaatgttgcagccgggtcgcgccctggatgaaggccagattcaggccattacccacatggtttccagcagcgtggccggtttaccaccgggcaacgtcaccgtggtggatcaaagtggtcacctgttaacgcgttctgatgcagttggccgtgacctgaatgatgcacaacttaaatatgctgccgaagttgaaacccgttatcagcaacgtatcgaagcgatcctgaatccgattctgggccagggcaacgtgcatgcacaggtcaccgcgcagattaactttgatacccgcgagcagactgacgagaagtatcagccgaatggcgatccgaaaaatgcgtctatccgctcacagcagaccagtaccagcgatcagtctggcagcccatatcctggcggcgtgcctggcgcgctgtcgaatcagccagcgccagccaacaccgcgccggtgaatgcacctaataccaacgcggctaacggtcagaatgccaatggccagaacgcaaatggtcagaatacgaacgcgaatggtcaacggaccagcactgcggccgccagcagcgtgcccaccaactctcgccgcgatgacacggtgaactatgagctggaccgcaccattcgccataccaagatgaatgtgggcgatgtgcagcgcctgtccgtcgccgtggtagtgaactatcgcgaagacgataaaggcaaagcgctggcactgaatgatcagcagctgaagcagattgaagacctgacacgtgaagccatgggttattcacaacaacgtggcgacagcgtcaatgttgtgaactcgcagttcaataccaccgaaccaacggtcagtgaactgcccttctggcaacagcagacgttctttgaccagttgatgaacgcaggtaaatggctgttggttgcgctgattgccttcatcctgtatcgcaaaatggtgcgtccacacgtactgcgtaagaaagaagctgagaaagtggcagcagaagcgcaggccgcacgtgccacacagcagaacgatcaggaagcgtacagcgtccagctcagcaaagatgaaatggaccaggaacggaaaactaataaccgcatgagcgctgaagtcatgagccagcgtatccgcgacatgtctgaaaacgatccgcgcgttgtagcgctggttattcgcgaatggatgagtaacgaactatgagtctgaccggtactgaaaaaagcgccattctgatgatgaccattggcgaagaacgcgctgcggaagtgttcaagcatctgaaccaacgtgaggttcagcacctgagtgcggccatggccagcatgcgtcaggtgtcgcacaagcaactaacagaagtgctgcgtgagttcgaatctgatgccgagcagttcgcggcgctgagcctgaactctaacgattacctgcgttccgtcctgacccgagcgctgggtgaagagcgtgcatccagcctgctggaagatatccttgaaacccgcgataccaccagtgggatggaaacgcttaacttcatggaaccgcaggcggctgccgatcttatccgcgacgaacatccgcagattatcgccaccattctggtgcacctcaaacgtggccaggcggcagatatcctggcgctgtttgatgagcgcctgcgtcacgacgtcatgctgcgtattgcgaccttcggtggcgtacagccagccgcgctggcagaactgaccgaagtcctgaacagcctgctcgatggtaccaacctcaagcgtgcgaagatgggcggcgtaagaacagcggccgaaattatcaacctgatgaaaacccagcaggaagaagcggtcatcgaagcggtacgcgacttcgacggcgagctggcacagaaaattatcgacgagatgttcctgttcgaaaacctggtggaagtggacgatcgcagcatccagcgcctgttgcaggaagtggagtccgagcagttgttgatcgcactgaaaggtgccgagcagccactgcgcgagaagttcctcaaaaacatgtcagcacgtgcggcagatatcctgcgcgacgatctcgccaaccgtggtccggtgcgtatgtctgcggtcgagaacgaacagaaagcaatcctgttggtggttcgccgcctggcagagtccggcgagatggtaatcggtggtggcgaggaaacctatgtctgatgcattttccgcccgtccatggcagctgtggcagccggtagagctgggtcgtactgaagaacctgccatggtgacggctgagccaacagacgttgaggtcttcgaatctgaagaagatgagcaacaacaacagtttgaacatatgcagcagcagctgcgtaaagaagcccatggacaaggctatagcgaaggccacctgcagggatttgctgaagggcagaagaccggttacgacgcaggctttcagcaaggtctggccgatgcacagcagcagcaggcgccgttgcaggcccgtatgcagcagttggtgactgagtttcagaacacgctggaatcactggacagcgtgattgcagcccgcctgatgcaactggcgcttgaagccgcccgttcggtgatcggtcaggcgacgacggtggatggtagtgccctgcttcgtcagattcagggcctgcttcagcaggaacccatgttcagcggtaaacctcagctgcgcgtgcatccggatgatttactgagaattgagcagaccttagggcccacgcttgatctgcacggctggcgtttactggcggataacacgttgcatccaggtggctgtaagctcagcgccgaagatggcgatcttgacgccagcgttgccactcgctggcaggaactgtgccgccttgctgcaccgggagagttttaatgaccacacgtctgaaccgctggcttggctcgcttgatgcctttgagagtcgtattgcgcaggtccaacccattcgtcgttatggacgtctgacccgtgccaccggcctggtgctggaggcaaccggcctgcagttgcccctcggttcgacctgtgtgattgaacgtaatgacggtaaaaccattagcgaaattgaaagtgaagtggtcggctttaacggtcagaagctgctgatgatgccgctggaagaagtggacggcattctgcctggcgctcgcgtttatgcccgcgctacgggtgaacacccacaggcgggcaaacagcttctgcttggcccacaactgctgggccgcgtacttgacggtagcggacgtcctcttgatggcctgccgtcaccggaaacgggctaccgcgcggcactaaatacgccgccgtttaaccccttacagcgtacgcccatcactgacgtactggataccggcgtgcgtgctatcaatgccctgcttaccgtcggccgtggtcaacgaatggggctgtttgcgggttcaggcgttggtaagagcgtgctgcttggcatgatggcgcgctatacccaggccgacgtgattgtcgtgggattaatcggtgaacgtggtcgtgaagttaaagactttatcgaaaatattttaggtgctgaaggccgtgcccgttccgtggtaattgccgcgccggccgatgtgtcgccgctgttacgtcttcagggcgccgcctatgccacacgaattgcagaagactttcgcgatcgcggtaaacatgtcctcttgatcatggactccctgacgcgctatgcgatggcgcagcgtgagattgccctggccatcggtgagccaccggccaccaaaggctatccaccgtccgtgtttgccaaactcccggcactggttgagcgcgccggtaacggcattgatggcggcggttccattaccgccttttacaccgtactgaccgaaggcgatgaccagcaggacccgattgccgactctgctcgcgcgatacttgacggacacatcgtgttgtcacgccgtcttgctgaagccgggcactatccggccattgatattgaagcgtcaatcagccgtgccatgacatcactgattgatgagaaccactatgcacgcgtacgccagttcaagcagttgctctcgagtttccagcgcaaccgtgacctggtcagcgtcggcgcctatgccgcaggcagcgatcccatgctggataaagccattcagctttacccgcagatggaagccttcctgcaacaaggcatttttgaacgcagtgagtacgacgatgcctgcctgcacttgcacgccttgttcggctaagccgcgcgtttaatacgaggacatcctaatgaaaacagctaatgccattgacacactgcgtgacctggcggaacaggacctggaacgcgctgccgttttgttaggcgatatgcgccgtggtcagcaggcggctaacgagcagctcaccatgctgcttgattatcaggatgaataccgcaacaagctgaacagcgacatgtccagcggtattgccagcaatcgctggaccaactatcaccagtttatccagacgctggaaaaagcgattgaccaacatcgcagtcagttacagcactggaatcaacgactggagcaggcgctggttaactggcgtgaaaaacagcagcgcctgaatgcctaccaaacgctgattacccgggcagaggaaaatgcattacgacaagaaaaccgtctcgatcagaaacggatggatgaatttgcccaacgggcttcacagaggaaaggcgaatgattacgttgccaaacaccgcgttgacgaccaaagccatcggcaccgctgaaacatcaggtactacagatttgctcgccagtggtggagaagctctgccacaggactttattaccgccctgggaaaccagttgctttcccttgctaaactgcacggtaaaacctcgctggctaccgataaaaatgttaccgctgacactgagggtaaaacggccacgtcattgaatgccctgctctcttcgcttgaaacacccgcggcgctcagtgccttgtttaaaccggaaaatattaaagccggtacaaaatcagccgatgataaggatgagttaactggcgctgtccttaataacagcgacatgcagaatattcaggcgctgtttgccatgttaccggcaacgggtctgcagcaggcggtcaaagagagcgtggcaagccgtgacgccgatagccttcgggaagctccacgctcagcattgtcagcactgacccaggctgttaatacggcactgaccggtgatgacaaagaaacgaagaacactaaggtgcaggacggaaacctggcgagcaaagtcagccagaccaatctgcccgctagcggcatagcctccgcggcaagtaataaccccgcggctgcgcctgcgacactgaccactgacggcagctttcagcaaatactcagcagcgttacgaagcaggatgaccgcccgttaacggcaacggccagtgataatcaggccattattagtgcgcccctgagcagcgccagcagtttactgcagtcgcctggcgcagcagcgccaatgaactcaccgtcgaccccgatgctcaatgcgcatctgggcagtaatgaatggcagcaggcgctgagtcagcaaattgtgatgtttagtcgcaacggtcagcagaacgcagagctgcgtttgcatcctgaagatctaggtgcgattcagatcagcctgaaactgaataacgatcaggcacagttaagtatggtttccagtcatagccatgtcagagccgcgctggaggccgcgcttccccagttgcgtagtgcgctggctgaaagcggtattaacctgggtgagagtcaggtaagcagtgagagtttttcgcagggacaaggcttccagcagcagcaggaggcgcgtcgcgacggacagcacggcagcttctcccttactcaggacagtgataacgacatcacgcccattgccgtaccgcagtctcttcaggcccggttaaccggcaagggcgcagtcgacacatttgcctgacagcgacaaacgctgaaggtaagcgtaaaacccgtgtcttttcttgccattgtttgacttaagacacgcgataatctgttcaggcgagccgagaggcttgcccataattcacaggaagttactgcaaaaatgtctgataacgcgaaagccaaaggccgcaaacgaaaactcttaataccagtgttactgatcgtaacgctggccgcttgcagcgtggcaggctatgcagtctggcgaataatgaataaacacgagggtgataagccggaggtcgcgaaagttgaaccgcctcccgccccggtcttttttgcacttgatacatttacggttaacctggtcaatcccgacaacgacccagaccgcgttctgtacgtaggctttacgctgcgtctgccggatgaagaaacacgtcgtcggatgagtgactacctgcctgaggttcgcagtcgtctgttactgctgctgtctcgtcagagcgcagctgcgctggcgacggagcaaggaaagcaagcgcttgttgagcaaatcaaacaggcgctggcaccaccactggtaaaaggtcaacctccgcaggctgtagacgacgtactgtttaccgccttcattttgaggtgaatcaatgggcgacagcattctctcccaggctgaaattgacgcgctacttaacggcgacagcggcagtgcggaagaagaaaagaaacaaaacggacctgagggcgacattcgcccttatgatccgaatacccagcgtcgcgtggtgcgcgagcgtctgcaggcgctggaaattattaacgagcgttttgcccgtagtttccgtatggcgctgtttaacctgctacgccgtagcccggatatcagcgtaggcgcgattaagattcagccttaccacgagtttgcccgcaatctgccggtgccaaccaacctgaatctgatccaccttaaaccgttacgcggtacggcactggtggtgttttcgccgagcctggtctttattgcagttgataacctttttggcggtgatggccgttttcctacaaaagtagaaggacgtgagtttacccatactgagcaacgtgtcatccgccgcatgctgaagctggcgctggacggctacagcgatgcgtggaaagccatttacccactggatgtcgagtacgtgcgttcggaaatgcaggtgaaattcaccaacatcaccacatcgcctaacgatatcgtcgtgaatacgcctttccaggtcgaaatcggcaaccttgtcggtgagttcaacatctgtattccgttttcgatgattgaacctctgcgtgagttgctggtgaatccgccactggaaaactcgcgctcagaagacacacactggcgcgacaatctggtgaagcaggttcagcactccgaactggaattgattgcccattttgctgaaacatcattgcgtctgtcgcgcgttttacagctgaagcctggtgatgttctgccgattgaaaagccagagcgcattattgcccatgtggacggtgtgcctgttttaaccagccagtatggcacgctcaacggccagtacgccctgcgtgttgaacatttgattaacccgattttgaattcgcttaacgaggaacagccccatgactgacagcaagaaaccgtccgatgacaccatctctgcggacgatctgtgggctgaagcaatgaatgagcaggttggctctggtgccagcgcttcacagagtgacgacgtattcaaaacgtttgaaagcagtaatgcatcaggttcgttgcaggatattgacctgatcatggatatcccggtgaagctcaccgtcgagcttggccgcacaaaaatgacgattaaagaactcctgcgtctgactcagggttccgttgtctcactggatggtcttgcaggcgaacctctggacatcctgattaatggctatttgattgctcagggcgaagtcgtcgtcgtgaacgataagtatggcgtgcgcatcacggatattattacgccgtcagaacgtatgcgtcgcctgagccgttaagatgaataaccagaatcacacgctacaacctgctacgcctccggcgcagccgatttcggcaggttcagtgctgactcaagtcagtggcgtattagtcgtcattattttgttgattctggcctgtgcatggctggctcgccgcatgggttttgcgcctaagaaagtgggcagccgtgagcttaatcttacggccagtgtgcaggttggtcagcgcgagcgcgtcgtgattgtggatacacctgatgcgcgcttagtgcttggcgtcactgctcagcagattactcacctgcatacgttgccaccagcctcacccgacatgaacacaccggaaaagccagcaccgcaggatttccgtcagctgttacaaaatctggttaaacgtcccggaaaaaatccatgatgcgtcgactgcttcctcttctgccgctgctgttgctggcaccggtcgcccatgcccaactaccgggcctggttagtcagccattagccaatggtggccagagttggtcactgccggtgcaaacgctggtttttattacctcgttaacgtttcttccggccattctgttaatgatgacaagctttacccgcatcattatcgttttcggcctgctgcgtagtgccctggggacgccttccgcgcctcctaaccaggtattacttggcctgacgctctttttaactttttttattatggccccgacgttcgataaaatttatcaggatgcctacctgccttttagtcaggataaaatcaatatggatgtggcgattgaaaaagggtcgcaaccgctgcgtgagtttatgctgcgtcaaacccgtgaggccgacttagcgttatttgcccgcctcgctaatacggctcccatcgcaggacccgaagcggtgccgatgcgtattttgctgcctgcttatgtcaccagcgaattaaaaaccgccttccaaattggttttacggtatttattcctttcttaattatcgacctggtcgttgccagtgtattaatggcgttaggtatgatgatggttcccccggcaaccattgctctgccttttaaattaatgttgtttgttctggtggacggctggcaattgctggtgggatcgctggcacaaagtttctattcctgatctcatccgttgcacgggagaaatacatgacacctgaatcggtaatggctatgggacaggaagcgatgcgcgttgcgctgctgctggctgcccccatgctactggccgcgctggttagcggtttactggtgagcctgctgcaagcggctacccagatcaacgaacaaacgctgtcttttattccaaaaattattgcagtggcaaccactggcatcattgccggcccgtggatgttaaacgtgttgctggattacatccgcaccgtcttttctaacctgccttatatcatcggctgatgattactctcgatagtagccaacttgttcactgggtcagtcagtttttctggccgctggtgcgcattttggccctactgtcgaccgccccggtgctcagtgaacgatcggtgagcaaacgggtaagaatcggtcttgcggccatgattacctggatactgatccccaatttgcccccggtaaacgttaccctgttttcaccggctggcttcatgttgctgattcagcagatgctcattggtattgccattggttttaccatgcagtttgcctttgccgccgttcgtaccgccggtgagttgattggcttgcagatgggcctgtcgtttgccaccttcttcgatcccgccagccgactgaacatgcccgtccttgctcgcttcctcgacatgctggcgatgcttttatttttgacgttcaatggccacctgtggcttatttcgctgctgtcggacagttttcatacgttgcccattggtggcgaaccgctgcacgctaatgcttttatggcactggcaaaatcggccagcatgattttccttaacggcatgatgttagcgctacccttgatcgttttactcctcacgctaaatatggtcctgggtttgttaaaccgcctttcaccacagttatcaatcttcgcgattggcttcccgattaccttatcagtgggcatcctgaccatcagcctgctaatgcctctccttgcgcccttctgtgagcacctgttcggcgaaatatttgatctgctggccctgttcctgacagaactgtcccccgcctgaacattaagtatctaactatttatcacttttgatacttaagaaacccataactatcagagcatttttcaaaccacatttttcagaaatcaactaaggataatctgataagcgtgcggaaagtcttaaaattattcttattaaaccgcgcttcgcgtattttagtcaggcggttaacagagtcatcgacagggttgttttggtgataaattcggcaatacattgaatttattcaagaaaaatttttatgtgatttttcttgtcagaaaatgttttttccggcattgtcaaatcgcttatcgacatcacactttcgtgaaataaatgtttttaagacttgtcctatcagaaaactctgggttttcggcgatagtgacagcgctcccaaaaaacggtatttcgctcagtgcggctttatatcaacaaatcaggttgatacaggctcatgtgtgaggtcagagcaatacaaaatttttgcagaacgggtcagggaagaagaattttatgggccattgcctgttgcctcgctgcatcagcacaataaaaaaaagcgctttgaaatcttctcgtaccgcaacgcgtaattcatcgttgatttaaacggataacaaattggtgagggtcgctaacatgccaacgattattatggattcctgcaactacacacgcctgggattatcagattatatgtcgtcgaaaggagtgaaaaagaaaaatatcacttccgtctccgacattgagcaattacagcaaagatgtgagcagttaaaaccaggtgttgtttttattaatgaagattgcttcattcatgaaaccgactccagcgaacgtattcgcagtgttattaatcagcatcctgagacactgttttttatatttatggccatcagcaatattcattttgaagaatatttgtatgtccgtaaaaatttaattatcacctcaaaagccatcaagccttcgacgctggattcacttttgagtacctatttgcaaaagaaactcaatatgtcaccgcgtatttcttcgggtctcgatgtccacccgcttacgctaagtcagacggagtccaatatgctgaaaatgtggatgtcaggtcatgacaccatccagatatcagataaaatgcaaattaaagcgaaaaccgtttcgtcccataaaggcaatatcaagcggaaaattaaaacgcataacaaacaggtgatttatcacgtggtgcgtttaaccgataacgtgacgtccggcatctatgtcaacgtaaggtagtacctcccgtcttcaggaactggcccacaaggccggttttttttggattagcgatccagatctcattttcaagcgtaaacctttccgttcttttgccgatgttttgttcaacagaacaacctcctaagagagcaaggaaatgaacacgacgctggttaatgaaggacatcacaaactcagtatttggcaaaatatccgcctggttcctctgtttagtttgatatttggcggtatcttgtttctgttcgcgctctgtatcgcgatatcaagctatttccttatccttagtaatcaatcactaaaagacgcaaccgacgaaattcaggtacgtaatgggctggtcgacagttcctctcatatgcgttctgcgcgtttaaatattatccaggccggtgccgcagcacgtattggcgaaatggatgagttcaacgccaacctggcggcaaccgatgatcgtatcaaacaggcttcagaaggtcttaaaatctatctgaatcgtaaaagtaaaacccctgaaggcaccaaggtggacgagcagttacaggctctgttcaaagagtatgtgactaagggcctgatgccgatgatcgacgccggaaaacagggcagttttgaaagtatcattgctcaggaaaccgatacgacgcgcaaactggataacgcctataaagccgtgttgatgcaagcgattaaacttcgtgatgtgcgctccgcgcagatcaacgagcaggctgccgagcagtctcgcattggctttatcgctatgggttccgcatttattgctgcccttctactggtgttgctgacctttgtgtttttacgtcgggtggtcattaatccactgcacagttcagtggcgcatatagaacgtatcgcgcaaggggatttaacggcaccttccgtcccgcacggtcgtaacgagattggtttgttgctggacaacctgcaacacatgcagcagtcgttaatcaaaacggtaggcacggttcgtgaaggtgcgattgcgatttatcagggctcaagtgaaattacggctggcaacaccgacctttcttctcgtacagagcaacaggctgccgcactcgaacaaaccgcagccagcatggaacagctaacggccacggtaaaacagaatgctgataatgcgcaccatgcaagccagctggccgctgatgcatcaggcaaggcacgtagtggtggtgatatggtgaacggcgtggtgaaaaccatgaacgacatctccggcagttcgaagaaaattgccgagatcaccaacgtgatcaacagcattgccttccagaccaacattctggcgcttaacgccgcggttgaggctgcgcgtgcaggtgaacagggacgcgggtttgcggtcgttgccagtgaagtacgcaaccttgcccagcgcagtgcgcaggctgcaaaagaaatcgaatcgctaatcgcagaatccgtgaaattggtcagcagtggttcacagcaggtgggtgaagccggcagcaccatgggcgagatcgtagaagcggtccgtcgggtgaccgatattatgtcggaaattgccgcggcctccgatgaacaaagccggggtattcagcaggtcagccaggccgtgactgagatggataacgttacacagcaaaacgcctcgctggttgaagaagcctctgcagcagcgtcctcactggaagatcaagcgggtaagttaacgaaagcggtcgccgcgttccgtttacaggatacgccggtagcgaagtcaacttatcaacctgatacggccccaaaagcttccgcgccaacgttacgtccagccgctatcactcacggcaacgagaactgggaaacgttttaaaaaacgcttaggcttaagccgcgccgccagacattatctgaccggcaggcaggcaagtaagaaaaaaatcgccctctgcgtatcactatgcagagggcaaatttttaccggttacgcgcaggcgtcaggcggaaggatagggttcgacgaaaacgccatcctgatggctgctctcgttaaaaaaccagataccctgcgggtaatcgtccaacgcgaccagaaacattgtgccttcactaaagggctctacggcaaggattgtgccggttcgccgtggcccgccatccgttttaacactgacgcgatcgtctaccttcatttacgactctcctgatattttcctgctgaacagtttaatcgaagagcgcccgtaatgcaggcgttagcgacgtgcgataacccagacagcgtggatgatacccgggatgtatccgcatagcgtcagtaagatattgagccagaacgcgcctgcaaaacccacctgcataaaaacaccgagtggggggagtaagatcgcgataagaattcgaagtaagtccataaccattcctttaggtattgataaaaaacgttttgttatcaaatatagcccctttttgccaggttacagcaaaagtcaggtaaatctgagtaatgcgttttttcattttcctgacatttccctgcgagacgtttaacaggcagaacagataagcttcatttcgttgctttcctccccaggaaatacaacacccaaagtaacaaggattatttgcccgcgcagcgcgggcttttttttaacttccctgcccccgcattttccgctaagttgtatatttattgctcacactgaccgctggaggcatgccatgacgcttccccacttacccgatcagaacgacagagacagagaaatggacgcgctgcttaaggcgatacagcctgaaagcactggcgatcttcaggattacttttctcaacaaaagcattcatcctcgctcgcggatgatcatcgtgccgggctgtgccgtgaacccgccgagcaatgtgagatggatattcaggattgccgttatggcgagataagccgatagacgagaagccgcgcgcctgtcgccatagcgcacacaaaaaaatacccggcgcgagccaggtaagtagtcaattcgttacatcagggaagtcatagtgctcttcgagactacgcttcccataagccataacaagccttttccatgcgtgttttactcacctcattgccgtccgcgcggtcaaacccacttctctgtcttgttaattcagcaataatcgatgcacgatatgacggaaccggcttttcccctcttccggttttaggaatcctcctggttataaagcttccactgcgcaaatcaaagcctgctgtagactcaactacactaaaacgtaatgactacgctgtagtgtcaaaccagagtgaaggaaatcaggatgcccaatttgaatgaatcgctgatgatagtgaccgacctcgatggatcgctgcttgaccaccacgattacaactgggatgccgccgcagagtggctcgacaggctgaggcagcacgctgtccccttaattatttgctccagtaaaacggcggctgaaatcctgcccctgcaacgcaaactcggcgttgtgggcgcgccttttattgctgagaacggtgcggtgctctacctcgacgacagcaaaagcgttcgtatcccggacgataaaatgagctataagtcgatttgtcgggttctggccacgttacggcagcagttccgctttaccggctttcatgactttagcgatgtcgatgtgtcatccatgaccggcctgagtgaggcggatgccgccctcgcccgccaacgtgacgcatccgaggtgatcgtctggcgggataccgatgaggcgttcaatcgttttcgcgcagcacttgctgactatcatctttccctgacccagggcggtcgtttctggcatgtgatgcccgccagaagcggtaaaggtgaagccttacgctggttgctgtcgcaccagacagaccagccgtatatcactgtcggcctgggcgatgggccaaatgatgccccgatgctggatgcggtcgattatgccgtggtgataaagggctacagcaagacgcccgtcactctgcagcgcgcggatgatgaccgggttttccatacgacacatcatggcccggaaggctggcgtgaaggtctggaccattttttgactcagccatgaaaagctgttgttcctctggcaaccccataaggatgatgcaatgagtgatttttttcagaatggcgtaattactaactttcacaatcttacgcaccgcagcgttgagtcactggaaaaggaaatggtgcgctttgcccgtaagcgcaaaatgggattgatcctgccatcgctgttttccgaactggaaggcccggcattgacgaaaatcgtggatgagctggctaaggtgccctatctcgatgaaattgtcatcgggctggacagggctgaccgcgatcagtttcttcatgcccgcgagtttttttcacgactgccacagcgtcaccgcatcctgtggaatgatggcccgaggctcaaagccattgacgcggaactcgacaaagagggcttatcgcccaccaatccgggcaagggccgtaacgtatggttttgtaccggctatacgctggcgtctgaccgcaccagctgtgtcgcactgcacgactgcgatatcgtcacctacgaacgcggtatgctggcgcgcctgctctacccgctggcgaacccggctttccagtatgagttctgtaaagggttttacgcacgggttgccgatggcaagctgaacggccgcgtaggtcgcctgttggtgggcccgctgctgcgctcattgcaaaaagtctacggtcactccgaataccttgattatctgtccagctttcgctacccgctctccggcgaatttgcgatgcggacacacgtgcttaacggcatcaaaattccgggtgactggggactggaaatcggcgtgctctcggaaatttaccgtaactacaccacgcgccagtcgtgccaggtggagattgcggataactatgaccacaaacatcagccgctggcggaagatgatggcaccggcggcctgaagcgcatgagcaacgatattgttcagtcactgctgcgcaagctggcgaccatgggcgtgccgttaaccagtgactccttccgggtgcttaaagcgacctattaccgtaatgcgctggatatgatggaaatctacaatcacgaagcggccatgaacggtttgaaattcgatcagcacgttgaggaagccgccgtcgaaatgtttacgcagtcgattcttgacgccgggcagtcatttattgagcgaccaaatgacaaaccctttatccccagctggagtcgggtccagtcggcttttccggatattctgcagcgtatttataaagcggtagaagaggataacgacggcaacgtctgatgctgcgcgcgccttgtgataacggcgtgtaagccaggtagcataaaatcggccaggccagtgagtaatcacaggcctggacggcagaaatcaggacgtaaactggggctgcgattcgctggaatgactaagctcatcactgcgaaaagcttcattcctgaccgcataaccatcataccatcgacattccaccatgccgctggcatgtccggtcaccaccatcgtttgcccgccttccttatgctgtacttcatcactgattgcaaaaaccatgttgcgccctctttgagaattggctgtcattgaaaccatttctttatagcacggtaaaagagttgctgctgttaagacgcgcataaaaatggctaattcagaataacgtagaaggatatagcggaaataaataaagcggataaggcattatccgcttcgggggttgagtagattagattttgcagccttcgcaatcggcgtcgtcaatcaggtcttctggtacttctgccgcctttttttctgccttcgcttcggcctgctctaactgagcatcaatatcaaattcaaacatgtcgtcgctcatagttttctccccagaacgcgttaaagaatgcgcttttataccgatgactcacgcagtttggcaataaggttaaccactaacagcacgattgacccaatgataaaaccaatcactaagtttgcgccgttgctgagcaggcttgaaaccagcgcactgaacggtgcaatcgcattttcaatcagatgatgtaatggggtcagaccgtggacaataatgccgccaccgaccaggaacatcgccagcgtgccgaccacggtcagaatcttcatcaaccagggggcagcggccagtaataccgcacccagcgcctgcgccacgcgtgaggatttttcacgcagccagaaccccaaatcatcaattttaacaatgccggccacaatgccatagacgccaatcgtgaccagaatcgcgatacctgccaggatcacgacctgattcagtaacggggcttcggagacgatgcctaaggtgatagcgacgatttcggctgacagaataaaatcggttcgcacagcgcctttgatctttttcttttcgaaatcgcgcggatcttgtttggacaacttatccagacgtgcctgacgcgcctctggcgaattttcttgtttatcatgctgcaggctgtgcagcactttctccacgccttcatagcagaggtacgccccgccaatcatcaacaatggcgtaatcagccagggcgcaaacgcggagataattagcgccaatggcactaatatcagtttgttcaggaaggagcctttggcaacgccccacacgaccggcaactcgcggttggctttcacaccgctcacctgctgtgcattcagtgacagatcgtcaccgagcacccctgccgttttctttgcggcgacttttcccattaccgagatatcatccagcagtgtggcgatatcatcaagtagcgttaataaactggttccagccaaaatatttcccttattcggtcatcagcaacggtttctgcctgcatcagccgcaacacatcatcctcgacgatgtgcaaggcgatgcggtgttcaccgtggtgcctgttccggttcgttatgttgacaacacgggcatcgttcaatttctgtcacggtcatatcagcgatgccctcacaatcccattcgacacgcactgcttgtccggacggacccgccatatgcagatatttactgaccgggctttccgtcatcccggtaatctcttccgtggccaccagcgtttccccagcatagattctggcggtggctttggtgttcaccatgcgctcatcacgaatctgataaaggcgtttaaccgtcagttttatgctgctcattttgggctcccggtcacggaaaagcgtctatctaaccttttacgcgacggattagcaaggctggctcattcactctcgcggtaatgatgaatgccctggtgatcaatctcggcgctgtcactcatcgccagcagccactcttccaggcgttcaagcagcgcctcatcgtccagtttgagtttaccgcgtagcgcacactcccagatgatcagtaccttccagccattttcccgtaactgccggacgtaacgctggtcgcgctccacattgctgttaattttgcccgtccagaattcggtgcgcgtggcgggcactttaaacaaataacagtgatggcgatgccagaagcagccatgaacaaagataatggcctgatgcgacgtcacgacaaaatcgggccggcccggtagatttttatcctgtacccggtaggtaaatccacgatctttgagcaacaaagctatccgctgctcgatggctgtgtcctgctgacgaatggcgcgcatatttttactgcgcgtttcgctggagtgaacgtcgaccatagcacctccttaatagcgacttattcaactttagtcgccgtcctgaaaagtgaaagccagcaccatgaaagtggggcaaatatttagcttgatgtccacgcgttccgtgacgacgcgggcaacaatcgtctcttttttgaagcccgcgcacacggaaacaccgtctaaccccgtgcctgcggatttcctcattgggcaaggagtgttagcataggcgcttcactgttaaggatatttgcatgcacgccgtcgcacccgctgaacctcttctccctgctgctctgcattccgatgaactgaacatgttacaccaggtgctgtcgatctattccgtccgggatgtggtcgaacgtttgcatcaggcaggcttttcgcgctggacgccgccgctgctgaacagtattcgtcagggcaagcgcgcgttgccctctctggcctctgcggaacgatcactgttacaggcgttattgccttcacggccggcgcattatgattcacccgatttccgctttatcgatctgtttgccggtatcggcggcattcgacgtgggtttgaacgtatcggcggtaaatgcgtatttaccagtgaatggaataaagaggcgattcgtacttatcgggccaatcactacagcgatccgcaggaacaccattttaatacggatatccgccaggtgacgcagcccgccgggctcacggacgaacaggcgatttatcagtcaattgatgcggcaattcccgatcatcaggttctgttggccggctttccttgtcagcctttttccctggccggggtcagcaagaaaaatgcactgggacgggcgcatgggtttgaatgtcaggctcagggcacgctgttttttgatgttgcacgcattctggcggccaagaagccgccgttcttcgtcctggagaacgtgaagaatctcaagagccatgataaaggccggacctttgcgatcattatggaaacgctgaatgagctgggatacgacgtggcggatgcagatgccacgtcccccgatcctaaagtgattgatgcacgctattttctgccacagcaccgtgaacgtatcgttctggttggcatccggcgggatattgccggttcagaacagtttacgctgcgcgatatccgcaaattttttcctgcacaggtccccagcttacaaagtttgctggagcctcagcctgacgaaaaatacattttgtcgcctgtattatggcgttatctctatgactacgccaaaaagcacaaggcactggggaacggcttcggctttggcctcaacgatccgcaaaatcaacagtgctgtgtgcgaaccctgtcagcccgctactataaagatggctcggaaattttaatcgatcgcggttgggatcgggaaaaaggcgaagccgactttcttgatgcccggaatatggcacgacgtccgcgtcgtttaacgccacgggaatgcgcgcgattaatggggtttgataccgcagacagtcaaccgttccgtataccggtgtccgacacccaggcctacaaacaatttggtaactccgtagtagtgccggtatttgccgccgtcgcacagctactttcaccgtatatccgcgatttaaaagcctgactcacactgaaagttgcgcttaggcgcaacgattcctctcttttcctgctacccggtgggattgtcacaacatcgtcacgcaagcccagaatactgctgctttttcacttgatgggtagaatgatgtcacctctcactttattgacgctgcgcgttctgaagcaacgccccaggtttatacttcccgccatccccacctggctgaccagcctgcgcgggaattttatgctctttgtggtgctgttctgtttattgcagtccatcggtattgttctgcttaccgctcaggtcagccatacccaagtcaacctgacccaggccagcgccatgcgtgaccggctggctttgctggatcgtgcgcgcgttgagctgctgacagccagcgataacagccatcgcgccggcctttatctgatggaagatcagaaaagcggttccgttgacagctggaaaagcctggcggagaccgctaaatcgtctttgctgcatgcggaacagctttttgccaactatcacgcggcgcctggcggcgaacttcagcagggatttgtgttgctgacccagggattagaagagcagttgaaaggtctggaggcgaacaacatcgatgccttttttatggtaccgatgcaggcctatcagcagcagtttaatagcgcatggtttaacgaaatcacccagaccaataagcaactcactgccgtaaacagcctgacgctgcaaacgctgactgaaagccgcaacctgtcgctgatggtaaccgcgctgctgtttacgttgctgctcaccggcggcgtactgctgctgcgaggtgtgattatcccattacgtctggccagccgtcagttacaggatatcgcaaccggggacttaattagctgcccggttccgccccgtttgcagtcgctggaaaccgctaaactgttcaatgcggtggcggagatgcgccaggggctgcgcgccattgtggtagaaatcaataccattgcagcaagtgtggcagacggaacgcgtgaaatgcagcacaccaatgaacaggtgagtgagcaatatacagcgcaaaacagcagctttagccatatttcacagcgtttacaccgcgtgtctgaagaagttgaaaacagtaccctgttttcacagcaggcctccgagcaggcccatttcgccgatgatctgatgcagcagtgcacgcttcaggtggatgaaatggaggttcagatgcgccacatcgtggattcctcaggggaaattgccggtatcgttgcgatgctggatggcctgtcgttgcaaacgcgtttgctggcgctcaacgccgcgattgaatccgcccatgcgggggtttatggacgcagttttggcgtggtcgcgaaagaaatgggaaatctgtccaataagagtggcgaatctgctcaacaaattaatggcctggtaaataatacgcagctgcacatttcagagggcttcaataaggtgaaatcgctggaagcgctgtttaaccagatcagcgcatcagtcagcgccgtcgtggcgcagctgaaagagctacaggaaaacgccacggcacaaagtcgacgcgtcaccggcattgccgcagaggtggtggcgctggataaacaacttcagacgaatgaagggctcagcgcccgacagggccgcacggttgataccttacagcagcaggctgcacgcctggccgaaagcgtccagcagttccgtatcacgctgtagccataaagcttgagccgtaaaaaagccgcctgtattaaaggcggcttttatttattgtcttaacggcattcacgtcggatttttgttatttctttttcttgctctgcttcttaagcagcgtacggagctgcttaatttcgcttgagtttaatgcatccgaggcttcttcctctgtgttctggctgtcaatgatgggctgagaaggcgcattcaggctcgcctgaagccgttgcacgatttcctggctcattgacacctgattttcgagcgccagctgtttgatatgttctttcaatgcaggatcaattttaatcgttaaattaacagtttcggtcatttcatcactcctttttgttattactcccacgctaccggatgactgtatcgattcctatactgtcataaaaatttaatattcagcatgtaagggactaaaatcgcgaagcaccgactcatccaggcccactaaattgccttgcagctccgcacacagcttggccatgtagcctaccaggaagtcagcattgtgttctgccagcatgcgccccgcttcggtttgcatggtttctggcaaccgcagtaacttggtctggaagtgatccagcgtccactttacatcattgagttcccgatctttaccaagcgggtccgcactgttaaataaggggcgattcatcgtacctgccgtgtaaaacacccgcgcaaggccgattgcaccaagcgattccagcctgtcggcatcctgcacaattttcgcctccagggtttttggcgtaatggccgcgctgaagctgtgtgcctgaacggcatgcattacctgctcgatcagttcctcaggaaaatcgatgaagtcctgctgtaaaatgcgctgcgtttcactggcggcataggtggatgccttatgacgctcaggatgatttttcggtaaattcaccacatcgtggaaataacacgcggtcagtaccaccagcggatcggcctgggtgccggtcataatgcgctgagcgctcatccacacgcggcgtaaatgtgcgatatcatgcgcgccatcatcatgaatccagttgttttcaaaccaggtttcatagcgagcctgccaaagagtgagtgacatagtctctttcctgtcggggttgaagtgcgttctgattgacgacgatttaagcgcttacggcctaccatcatagcgaatagctaatgacattttctttacacagcggacgttaatcaccttttgaacctttaaattcttaaagaaaatgagacgctgatcatttttatagcattttgacgtaattaaaacggccatttgctgctttttcagccttgactgatttaattgcaggcaggttaattagtttaataaatgtaatgatttctgaaaggcattttatcgaagaggcacaaaaaacatgacataacccgatcgcacttatcaataaaatcggcgaaagtgacagacagattaatctgaaaaggttcctatttttgccgatataacgtactgtattctcactatcagatgtcccggaacgcgcatttacacccgcgttgttgattttttatccgctcccctttttcggggcaaaaatcaccaatgctcagatggctataagacagcaaattgttaagggtaatgatttatagtttttatgatattgccaccatttagatgcccttgttgttttagcagtaaccgggttctactaataaaaagaggtaatccatgaaagagcggccgattcttttttccgaacagcgggttcgtgccctgttagttggccaacaaacgcaaacccggcgcataatgaaaacgcaggctttcggtccggggcaggatcaccatgaaggggttcatgcttttgatgttcaggcgaaccacctgcatggcgataaaatgatgacaatgaacgacattcgttatcactgcccttatggcatgccgggcgacctactctgggtgcgcgaaacctggcgtggcccgattgtgccagaaagtgcgctggcggattatgaacgcgatcccgtgcctttccgttcgccagaattttgccagtaccgggcggacagcaatgaactggggcagcataccttgggtggaccggacgcggagcagtttggctggcaaacggcgatacatatgccgcgctgggccagccgtataaatctgctcatcacggatgtgcgtgcggagcaaatccaggacatcagcgaagatgacatcatggcggaaggcgttcaaaccgattcgcactttctgaataattttttcaccatgaatgtcaattcagaaatgccaaaagaagcctatcgcaaggcctggcaaaagcagtacggcgcaaccagctggcaggtaaacccgtgggtgtgggtgatcgagtttcagcgcgccgaacgtgagtaaacttagcctgcgctttgcgggctgaatcacagacaattttcttgctaacaggttgaatataacgtcttcattcctgaagcccgacaatgccagcatgaggttctgatgctggcattttcctgtccggtctctcaggattctgcgacagctggactcagtgcgggacttacgatgttcaaatggccatggaaaacacatagcgacactgccgtgatcgaattgccctggcaggccggtctggcacagccgatttttaccctactccgtcccgatgaacagcaatggttgattgaactggggcaacgctttctgcagcaaaagaaactggttccgcttgaaggctgtcagcttgatgcgcaccgcaccgtccgtatcgctctgctgttctgcctgccggtgctgaaactggggcttgactggctggatggcttccatgaagtgctcatctatcctgaaccctttaatgtggaagatcagtggcaggatgaaacgggtcttgtccatcatgcgcctgctgtccatgccgggcagagctggacccaaggccctgttatccttaactggctcgatattcaggattccttcgacctgtcaggctataacctggtcattcatgaagtggcacacaagctggatgcccgcggaagcggctacaccagcggtgtcccgttgatcccgctccgtgacgtcgcccagtgggaaaaagacttgcgtgaggcgatggcggacatcgaaaatgaggttgatttagtcggtgaacaggcggccagtatcgatccttatgccgccagcgatcccgcagaatgtttcgcagtgctctccgagtatttctttaccgcccctgccctgttaacggaacgttttccggcgatgtatgcacatcttcagcaattttatcagcaggacccgctaagcagaatgcaggccggggaaggctaatctgcttacttcgcgaacgctttgcattaaagctagccagttgaatgctaaccgcttttttgctgttgacacaccagagcgacctcgctaatatgcgcctcgttcacacgattcctctgtagttcagtcggtagaacggcggactgttaatccgtatgtcactggttcgagtccagtcagaggagccacattcttgttttcatgcgtcttcacgaatctttatacgatttagattcaacaagttagcgtgaaaatccttcccgatgcattttcagttttcccttcgcatcgggcaagatgggtggtcttattgggtgtcatttcagtacgattatagcgtgaccactctacgtctctgaacggcacgaccatccgcagcctaaactcatccgctcaacctttcaaagtatcctattctcatggcctgtcccttttaatcaatccaggcagttcacgtctctggtatctcaactatcggatcaatgtggcgaatcccggcctggctcaggggctatcatcagcgccaccaccacgccctgattacaggcttcctggatcgacccatgcagcgcgatggattatgccgcatcaatcgctaccactttcccgccttaaaagatcaggttttgcagctgtcctgctgctgcgcggcgttatcggcgttgacccggttggtttttgccactaacccctgcctgatgccgtcttctgctgccaggttccagacagtcatcatctgctggcaccaagtatttccggcaaacgagcggctgagtgcgatcgtggtatccgccggactggtacccgcaaaggcagaagcagagagagccgaaagcagtgacaacgcggcgatataacggttcttagggttcattagatgaacgtttttaatgttatatcgggtacgcgtttacgggtgcaggcagagcccacaccggttttcaccggtgcggtatgcccgttacttcagggtttctgggttgataacgtaaggtttcagggcgtctttctctcctttcagataattaaggatgttgttgatgcaacgctcggtgaccagcctttcagccatgcggtccataccggaaacgtgtggtgaaagcagaacattgtcgaactggcgtagcggtgagctggccggtaacggttccacttcgtagacgtccagccccacgccgcccaaatgaccgcttttcagggcctcaaccagtgcttcttcattaatcagcgggccgcgagaggtattcaccaggatcgcgccgggtttcatcatcgccagggtaccagcgttaatggtatggcggctttccggggtggacggcgcatgcaccgagaccatatccgcgttacgcagcagggtttccaaatcgacccgctcggcgttcacactggccagcagttcgtcgctggcccacggatcacacaccaggatgcgcatctccgccgcatggcagcggcgcgccatggcatagccgatgcggcccaggccgatcacgcccgcggtacgcccccaaagaccggggtggaagccgtcaaagaaccactcgccgcgcttgaccattgcatctcgctgcggcagacgacaggccagagtcagcgccatcgcataggcgaattcagccacgctttcgtggttggcaccaaacgccatcgcaatcggcacgccggcagcggtagccgctgggacgtttaccttgtcgtagccaaccccccagcgggcaacgattttcagattaggggcctgagcgaagacgttttcggtatagggttcgcccccggcaatggtcgccaccacgttctgctgaagtttgctaatcagttcctgctcattgggcaacctgaaggtttcatttacctcaacgtcatagccagcctgtcgcagcggatcgaagacaggatcgctgtttttaaactgctcggtgaatactacgattttttcaggtgttgttgcgttcataattctttcctttgatttctgatgtttttttctcttccgaaggcagtaaaacgaacagggcgacggcaatcacggcggcaattgccagcgcgtaaaggccggcagccggcgtctggaagtagatttcagcccaggtacgcaggttcggtgcaacgaagccccctaccgcgccgcaactgttgatcagggcgaaacttgccgccgccgccgcaccaccatagtagcgggtaggccaggtccagaagatgggctgggcggtcataatccccatcgtgacgaagctgagtgcgacaatggctaacagcggggaagcatgggcggaaacgatcagaccaaacgcaatgcagcacagcgagatggccccaaacaggcgagctcggcccagacgggcagccagcccaggccaggtggctccggcaaccaacgcgcataaccaaggaatcgcggtcaccaggccgaccatcagaccaatctttacgcccagcagcgcggcaacctgggtaggcagataaaatgcgacgcccaatccggtaatttggatcaggaagtagatggcggcaaagtgcagcagtaccgggcttttaatcgcgtcgataaagcgggtatgtccggcgcgagccttgtcggctttctcttcgtcgagcgcggcagtcagcacctgtttctcttccgcagtcagccaactcacctccttcggtgaattacgcaggaagaaccacagaaccacgcccaacacactcgctgccaggccttctaccgcaaacataatctgccagccttcccagccgccaaagccgtgcagatccagtaacagaccggaaatcggaccgccaataatcagcgcaatcggagaaccaaaatagaagatccccatgatgtgggccctaaaacgcgaagggaaccactgggcgataaaatagatcgccgtagggaagaatccggcttcaacaatacccagcagcacgcgcagaaaataaaaggtctgctcgttccaggcaaaggatactgccgcggaaaccagtccccaggtgaccataatccttaccagccaggcgcgggggccaacgcggtgcatcagcaggttgctgggtaattcaaacagcgcgtaggagaggaagaagatcccggcaccaaaggcaaaggccgcatcggaaataccggtagacgcctgataggccgatttggcaaagctgacgttcacccggtcaaggtatgacatcagatacatcactatcaggcagggaataatccgccattttgctttatttaccgcacggactaatacgctatcgtttatggcttgcttacgcattgaatgcaccttcattttgggcgccagagagaggcatagcctctggtgctggtacagggtggataaatcagctgattttattgttatagaattctgttccgctgcggatctggtcgagaatcactcccagcccccaaaatttttccagcacattttctttgtttacccggcaggcttcgctctcgaaggtgcccaggcgctgatggtagattttggcattcttcggatagcccagcgtttccgacacggcagcaagagacaggaatgtcgccagctcattggccagaaccggatctttcgcgtggtggtgataaagccagacgtacagctctggatggaaattggtaaataccccgctgaaaccttttgaaccggcctgcatggcgggccaggcaatagcggcgttggcgttaatgatattcagccgcgtaccttcggccagcgccacgcggcgttttaccgtgtccagatcgcagcttacgtccttcagcaccgtgaaacgtccgctgcgggcgcaccatgagaactcatcatccatcagaaggcggcgataaggtgccgggcactcgtagagccccagcggcaggctctccggaagcgcgtccagcagggtttgcagagtggcgtagaacacctcgctgccctggttcttcggatcgagatggttggtaaccagcactaacgcatcggcaccggtagaggccatcgccagcagctctttgcgctgatcgtcgatatcatcactgatatgcccggaaacaatcaccggcacgcggcctgcggttttctccacaacgaagcgtcccagctttacgcgctcttccagcgttaaaaattgcatttcgctggactgacatactgcgaacaacgcatcaacgcccttctgcaggtaccactcaatcaggcgctccaggccaggccagtcgatttcgttctgcgcgttaaatggggtcagcatgacgggtacaacaccgttaatctctttcatttttttccttacagccacagtgtggtcagaaaacaattaaactttgcttttcagtctgttaagcgcctgctggcgctccggcatatttgatgcgccttcgcgctcaacggccagcgaggcaaaggcagaggcaaaggttgccgcctgcatcagcggctgaccgtcggcaattgaagcagccagcgcgccgttaaaggcatctccggcacctgtggtatcaatactcacggcggggaaagcgggaatgtgctggaactgctgattctcatacagcagcgcgccgcgggaccccatcgtgataatgatgcaacgagcccccagttcggcgatggcagtggcagcacgacgggcgctctccagattggtgacctcgattccggaaagcagcgacgcttccgtttcattaggcgtaataacatccatatattccagcgctggaataatatcggaggaataaggtgcagggttcataatgacttttacgcccagcgcttttgccaacttcatggcattcagcgtggcgaaaaaattattttccagttgtagcaacagaacgctggcatcttccagctcttctttcagttccgcgatttctttttcactgattgttttatttgcaccggaatagatggcgatcatgttttcgccattctcctgtgaaacataaataattgcactgcctgttggttcttcttctgactgataaagtttaaaagaataaatttcagaggaagagagatgctccatagcaaactggctgaactgatctttccctactttagaaacaaaatgcactttcgccccggcacggcttgctgcctgcgcctggtttgcgcccttcccgcccggcccaagcgagctacccagcgccatcagcgactctccgcctttcggaaatcgagccactttcgccacgatatctacgttaaaagagccgagaatacagactttatttttcatattatccactgaacctttctcatatttcctctgcttgatatttttcaataaaacttcaaaatcattgtcagtttcggaaattaattttgattgcaggctcttacgaataataatagcgccaccatgacagcgttgaatatatccctgctgtgccagcattcgcagatcactgcgtatggtttctttcgttacgctaaaatactgagccagatgctttaccgttgcactattatgtttatccagaaaattaaggacattgattctcctctcgtccataaacatattcaccccccgttgctgactgaagcatagggtaggcgcattggctaaaaagtgatgaatatcctggaacaatcaaaaaaacaaaaacaaacaaaaaccaaacaataaagaaacaatgtaaccctcggttagttatagcgttaatcctgattcgcggcgcggcatgtgagaacgcgctaagggaaatcagtcccgattgtgtggtctgacaaagctctttccgttcggagttacgcgttgttctggcaggcgggtgcagagagatgacgggcttatcagaacagactgtcgcgtgatcccacgctttttatctgctcaataaacagcacgcggaataggttggcgtggtcagaataacatcacctgaccacgttacggaaagaacggcgacatcgggtatcaccgtgaatcatgccatagccgcctgctgaccggcatctggacatcttgcctgatgtttacttcgcgccgtcaaccagctgtcgcaacatctcaatatgaacgggtttatcattgagcgccggtatgtaagtaaacgacgttccccccgcatgcatgaagatttccctgttctgctcatccagttcttccagcgtttctaaacagtctgctgcaaaacccgggctgattacatgcaggcttttgatgccttcattcggcagatttttaatcgtctcatcggtaaaaggcgttaaccacggctctcggccgaatcgggactggaacgtcataatgatcttcagcgatggcatattgagggcgtcagtgagtaactgggtcgttaactcacagcgttgctggtatttatcaccctcactggaaaacctgaccggtattccgtgatacgaaaccaatagcgcatccggcacaccgttcgcctcaaaagactcaagcaccgaggtttttaatccctcaatgtaggccggatgatcggcatagtcattgacgaaattgatggctggtgtgtagcggttcttcattttttgcaggtgacggctcacgctatcccagacagatgaaaccgttgaagatgaaaactgcgggtacatagggataacaatgattttctcgacgccttttgcaagaagtcggtcaattgcccccccgatactcggttcaccataactcatccccagctcgacgggcatccccgtcgcctcttgaagcaggcgggcctgacggacgctgtaaaccatcaagggcgagccctcatccatccagatagaggcgtacagtttcgccactcgctttgcacgcaatgggataatcacaccatgcaggatcgggcaccaaatgattctgggtaaatcaaccaccctgtagtcgtgcaaaaatttcgataaaaatgttttaaccgcagcaggcgtgggttcttttggtgttccaaggttaacaattaaaacaccctgtttattcgtcattagctgggacctctgaaaacccatggaaaaaaagtgcctgaataatgtaacacactcaaggacatcatcacctccgtctgcaccgcttgcgcgcattgacgcgaaacggaggtttatatatttacgcatcccggttgatgggcaacggccgttcaaccctgagttaactgactacgcgctttgttgctgtcgcgttgaccggctttcagcacaggccgccaaaaaacgtctccgccagcacctggcgtaggctgtccggttttaaaaaagaccaatctgccagtgacacgttgaggcgtcagtgtgacgttaaaaccgtcatgcgcagcgacagccccttttctgatttttgaccgggttttacttactcagtcaaaacatcaggttgtatcttatcatcgccctgtcgacaaaagaccaatagctctgataagtcaccttttcatttcacacctgctcgctttttgtccccctgcctgacgaaaagacagccgctcaatcatcacattcataccgggtttgatatcacatcttgtcgacatttcgatttatcaaagtgaatattgagcgtgctaatatttaggaatctatgttaacagtgctctggcaggcgcatctccagcaacatctggcgaccgcttcacgccattcagcggaattcacctgccggagcctggataaagtaaaaccagatcgcagtcatgaatcaggctggtgccaccactttcgccatcaggcgttttcgggacggaaataattatgcgtacaggggtttcttcaggcgaagcatcgttgctgcaacaccggtcatttgtggcgttctggctggcccgaacctgttcttcatttggttttcaaatgttttccgtggccgtcagctggcaaatctatgcgataacccacagcgccatggcgttaggcatgattggcctgatgcagtttctgccttcggtacttttggctttgcctgcaggtcatttggccgatcaatttgaccgtcgtcgtatcgtcgtcattgggcaactgattgagtgggccgcgctgctcggcctggtggcactaacgttactgcactgggcagatcaaattgaaatttgggggttagtcttcctgatctcccttgctaaagcgctggaatggccagccattacctctatgctgcctgcgttggtcccgccgccgattctggcgcgcgcgatggcggccagttccgtcggcggtcaggccgcggtgattgtcggcccgacactgggcggactgctttatgtggcggggcccgaagtcgtttacggggtttccgccctcttctatttgttgtcgctgatcttaataagccgcttacgttacgaacgccctcctcaggtgcgcgtgccgatgaatctgtcaaacatgtttatgggcgtgcgctttatccgcgaacgtaaagatgtgctcggcgtgatatcgctcgacctgttcgctgtgctactgggcggcgcaacggcactgctccctatcttcgcccaggatattctgcacaccgggccatggggccttggtctgttgcgcggtgcgccgtcggtaggtgcgctgttggtcggcgtctggctgagtcgccacaaactggaaaagcatgtcggcatgattatgttcggctccgttgccggctttggcctggcaacgctgctgtttgccctttcgactcagctatggctctcactgctggcgctggcggcgctgggcggttttgatatggtaagcatggtgattcgcggcgcgctggttcaactggatacacccgatacgatgcgcggtcgcgtcaatgcggttaacgccatctttatcaatacctcaaaccagttgggtgagtttgagtcggggctgttagcggcatggatgggcgcggtgcctgccgccgtcattggtggcgtcgggacgctggtggtggtcgggctatggatgacgctgtttccgaatctgcggaaaaggcagaagcttgagaatgaaacggtggagtgattggaggatggggtgtaagcaccaagccgaacgccaaacttttcattggcagagtttggcttgagcactgaatgtactgcaagcaatttgaaacttaatcaatccaatatggaaatttatttgtgcctcagatagtaaggtgttttaaaggcactttatgcatattgaatgatctacagagctctaattacagttcttatacttccatttttaaagagcatagatttgagtataataaaattcattatttcaactaaaaaattttagaagaaccataaaaaaatataaaaaacaccatcaaaaaaacataagatataaaaaatcatctaaaaaactaacaacacagagttaccaataataaaaatgataaataaaatgtaaaatctcatctatttttacattaacctttttataaaccgaccgataataaataaaaatgacaaaattaattatgttttaacttaaagagtctaaataaaaaatcattggggatgacaagtcccgctcagcttaagccaagcggcactattgggaatgagtaaagatctgaacaaaaaaagcagatcatttaaacaacgccaacgcattgtggaattaatctttattcacccaaccacccttttggcagcctttccatattctttatcatcaaccagacttttaataacatcaaacgcttcagggatatctttattatctttcaataaatcaaaggccgcacttttaaaaaggatgtaactatctccttttattaacttggaagcaaaaattatttcatctttccctatatcaagaagagacaaagtatttatgcaattaacgatcaaactatcatcttcagtttcatcagacttaataatgctaattagtgattttcttataaaatagtcatcataatcacctttatacaaacccaaaactttaaccgcctcaattcttatatcatcatcgtcatcattttctaccacctttagaaaaaactcggctaattccaaatcaagcttctgatcaaattcacgtaagaattcaaactgcgactctctgcttaggttactgtattccttaatgatttcttgagtttttttcatttctaaccctatttgattatcagtcttgagctaagtttagtcacatcatcaggtaaatctaagatttgatgtgcaatttgagatgcattaccgcctatgattgagttttcacgagacagaccgattctgcttacatctgtaggtaaacctccagtccgcatatctggttcatgcagccacacatttccatcgccagctgaacctaatgctttaacatggtttcgcccttctctctccagggctgcattgtagttattgattcgtctttttaaacctgacatcccttcagccttaattattttattaaaggccctggtttgtcctcgcatttgtctccgcaactcacgtatgttactaactttattaggttttaatctatgattatacgtaattgtcgcacatttaagtcctaaggggtcaatccatccaagaggattcgatacgtaagcataaggattatctccccccaacagccctatcgggtcctgactaatataccctgcaatctccggatcatagtaccgatagcggttatagtgcaaacccgtctcggcatcaaaatactgaccctgaaaacgcagtgggttttcaatcctgtcagcaaatacctggcctttttcaccccaggcaccggttttttctgcccagacaatctcgccactcacagacgtcaacctgacaggtgcgccattgggatcgcagtgatagtgccagctttgcctgctgtcgccctgctgcgtcagcaaagccagcggacgaaacgtaccgggataatacacatactcccgcatcgtaccgaacagcgccgcctgagctttttgtcgcttaaggcgactgccggtatcgaagatactcagcgccgctaaggatgcgtgcgtgcgggtgaccgtctcgcccgccagcgcatcatcctgccagtagaaccagcgggtttcgctgtcggtttgtttgaacacccggcggccaagcccgtcgtagccatagcgtacctggctgctgcctttacgtaccgcgatcagttgtcgattctcatcccagagaaaatcttctttttcgtcctgttcgctcgtcgtctctgtcattcgacggcgctgacgcagctcgcccgcgcggtcaaagacataacgtacgccctgatgcacgccttcacgaaaccagccttccgcgctgtcgttgacctcacgggtttgcgtttgcaacgggttacccgttgcatcctgcacaaactttcgcagtgcgccgtccggggcgatatgggccgtcaacctgccaacaggatcgtaacggtagcgatcacagccccactggctgtcctcgcgcgcggtgatattcccgcttttgtcatagacaacgccgctggcgaacagcggtaaatcgttttgcagcacctgttgtgaggtgagccgtccctgatggtcgtaattcagggtgcgcgtgagtgcttcagacagctgttcatggatacagcgtcccgcggcatcgtagtcaaacgtgatcggcgtatcgccattcagttgcaccgtgcgtatacgtgcgtacgcatcgtacccgtaaaccacccggtggccgctgtcgctttcacgcacgctcagacgtccctgtgagtcgtactgatagcgcaactgaaagccgtcctgatcgtctgtcagtaaccgtcccgcgtcgtcgtagcgccagctcagtcgtcgccaggggttctggcagagcaccagccgcccgcagggatcgtaatgaaaggtcgcctgcaaggtatcaccgctgcgccgttcactcagtcgtccggccttatcgtagccatagtgcacttcacgtccaagcggatcgcgacgtgcgatcaggcggctgcccttatcccagctgtactgcgttttctgtccccaataatcctgctctgcgatcacgcgtccgagcccatcgcgttccatctgccagcgttgaccagattgattgatcacggccagcaagcggtcctcaggatcgtattcataacccagtcgtgcgccatcagaggtttcacaggcggtaagcatgccggtaccgttatagtggaaacgcgtggtctgtcccacttcatcggtaaaggcgaccggttcatcttcacggtcatagtctatccggacatcgccgcccgtcgggtcgaccgtagcgatgaggcgatctttggcatcccagtaaaagcgggtcacgctgtgaccggcatcggtccgttcgaggagattgccgcgcacgttgtgcctgaaatgcgtggtgcccgctcccgccacgctgaccgtcagcaggaagccaaagcggtcatagcgataatcggtttgcggtgagcctggctcattggcctgggtaagttgccccagacgatcgaactgatacgttgccgttatgccacccggatcggcactggcaatcagattgccgccactgtcgtagtcggcgtgccagaccgcgcctttctgatccgtgatcgctagcggcaggccatcatcgttgtaaacggcctgcaccatactgccatcgggtaaatgctcggccaccatgcgtccctgcgcatcgtaatcccaccggtgaacgctgccgtctggttcaatcacttccaccgttcggccaacgtcgtcgtaacgaaacaccgtattgccgccacagggatcgatttcagcgatcggcaggccattatcatcaaaggtgatacgtgagagatggcccagtgaatcggttacctcaacctcattgagcagcggttcgtaagcaaagtgataatcccaaacgccgccgtcgccccaggcatgaataacgcgccagtcttcattgtactggtagtgaaacccctgaccgttccgatcaaagtggctgacaagataatggtgttgatagtcaaaacgtcggggatgcgacagcgcatcaatttcggcgctcagttggccattcgcgtggtattcatagcgcgtgagtggtgtaatttcaccgtcaagcgcattgtgcaggcgcagcgtactcaggcggcctttatcgtgggtgacaagaatttctcgtccggtcagcccttcaatactgaattcacggagcagcgtcagtgctccctcgtgccagtcgaaggcccagccattgccgtgacggtcggataactgctgtatcggtagctctccatcggcaccggtgaaatgccacagactgcccccttcctgttcgacgcaccaggtcatcctgcccttcgcgctgtcccgccacagacggctgccatccggcaagcccattaccgcatgttcacgcccgtccgcctgcgggagcgtggcaaacagtgtcatcccatctggttgggtaaaaaacgcgacaccttcttcagtcaggatttcaagccgcgtgtcggcaggcgtcaaccagccataaccgcaaagccctgccgtatcaacatcggccgaggaataggtccggttccaggccagcggcaagcggcctgacaacataaaatcctgctgttcgaggctgacgctgccatcgcggatatcaacgggttcggcgcgcagtacacggcatttgagaaaaccgggctccatgttgcgaaacaatttgcgcctgtgctgggcaaagcgcttcatgaaattttgccacttcaccgacttcctgagcgtctttagtcccttacccagaccgcttaatccggcgcgcatcaataacgccatcaggttgatggtcggcgggccccccacgatcacgttgttaggaatggcaagattaaaggtcagcggcaatgtcagggaaagcggctttggcttggtggcgcgtttgaggcggaacggcgggatcatgccgatgatgttacagctcagcaccggcataccgatgcgtgaaaagggttcgccgtcgactgagacggttttactgcccatgaacagctcgtcttcaatctgcggaccgcccggcatacgcagtggcggcacccaggcgccgccaaccggaatatgtaccgacattccgcccgttccggcgctggcgcgtttgatgctgttgacatgtaccgtagtgccaatcaatggcagatagtcgaacacatcaaacacaatgccaatatgtggcgtcggtaacggccagggataggtatgaatatccagtcctagctgcggatcaaagtgcgcgccggaatgcatgggttatgcctcagaagatggcacgcagcagcgcgcgtaaaaaggttcggacctcggtcgccagaccgctgtcggaaaggctcaggaacagcagtgcgagtaccgttacgacgacgataagaatgatgcggtttttcatactgcgttgctccctgcattttcaggtgatgatggatttgcacttccccacgctggcaggctttgccattcgcctggaggtgcatcaaaaggatgggcgatatccggcaggccgttccactggggatgcaactgctcccgtgccagttggataacgcgacgaaaactgtcgtcaccgttacgaataagcgtttctctttcctcgcggatcaacaggaaggtggcctcaagctgcagttgcagacggctttctgttttcctcaccgattcggtgttgggtgggcaaggtaagcccgcctctgcctgctggatcagccgctgtttatcattctgccagcgcgtggcacaggcttcgatggcctcagtacggcgcttatcgtgcatgcgcaacaaatcctggaaaaccagcggcagtgtggtttccccgcgctccgccagcgggatgccgcctgccgcctgcacggctttgccgtacgcttccatcgcggcggcatgatgacctgacagccacagacaaaaccccgacatgcgccagccttcaagggaaaaaaccggatgcggaatcgtctgggcttccagcgcggcctgacgatagacttttgcggcctgcaaataggctttgttggcgaaccatgctccggcttcaccaaaggtactttgggtacgaagctggccttttacagcgggatcgtcgatggcgctggagacgttttgtgcctcacggtaatgtccgaccgctttgctgtggtctttgcctttaagccagccgcctgcaatcaggttgtgcaacatcgcctgctgatcgtgccagccgcgccgctgcgcgacggccagagccaggttgccccgggcggccacctgggcggcgctgcctttctccagtagcaacatggcatccgccaggtaacgacgcagcagcaaacgatcggaatcggtatcactttgctgctgggcggtctgatgcatcaccttcatgccgtcgacatcatcgacaatcagttgtacgtgttcaggatgggcctcgtacagcgactgccacaggggctgctcggtggtatcgatcagcagcaaacgcggtgcgggctcggcgtcctgccgccagctttcgagccagcgcatcatggcgcgctcgtcgctgacggcggcgggttttagcaccagcatcagataacgtaaatcgtcgggaaaatgacgggcgaagtcctgcaacaacagccgtaactgcgccgcagaatagcagggttgtagcgcatcgctgttccagtcggccacatcgggcgtggcttcgtagtgctcaataaactcccgtgccagcgcctcgctgtagccatagcctgtttcaaaggcggtcgtcaggctcagaaacaggtcagggactgaacgtccttcgggatgctgttgcagggcaagaaaggcgtcaagaagcgactcgcctgaagccggtacgcgccagataaacagacgcgcgtcacggttctcactggcggtgagccagctcagctccagctcactcatcacgcgttcggttgggttctttgcagcactcatgtcacatccctgtcaggcattcagctcaatttttttaccattcaccatcacgcctgcggcattaatggtaatggtcgatccgccagcagtgatttgcacgctgccattactgattaaaatcccgctctcgcccacattaatatggaacgtgtctgttgcgctgtccgcaacgctgccctgggtaaagcgcgtatcaccgccggtaatactaagcgtgcggcctgcgccgatcgtcacgtcttgcttttgcgcaatcgtgcgcacctcattgctgttcacggtgacgtggcgattgcccgtcacgtcgagcgtctgatttcctgtgacctgcactgcgcggttttgctgcacgctgaccttttcattgccctgaaccgtgcgggttcggtcctgaatcaccgtcagcgtttgtttcccttccaccgtgccggtgttgttacttttcaccgtcgtcgtgtgattgccggtaatggtttcatcgcgattttgatccacgctcagggtttcgttgccctttaccgtttctgtgcgattttgctggatcgtcgtggtttcattgccgttgatcgttttactgcgatcctggccgacagttacggtctcgttgccgtctaccgtgcgcgtgcggttctgtttgatatgactggtttcgtctttgcctacggttttggtccggttgctgccgacatcatgggtttcgtcgttttcaacttcggtgtccatgttgcgttcggcgtgcagccacagctgctcctgacccggtttatcctcaaaacgcagcgcattggcattgtctggcgagccgtctttagagcggctcataaagcccatttgggttgccgcagccggcagcgcccatggcggcatgctggcttcgttatagacgcgcccggtaataatcggacggtcagggtcaccattgataaagtcgaccaccacctcatcgcccacgcgcggaatctgaacgccaccgaacccctggcccgcccaggcgcttgacacgcgcacccagcaggaactcgtatcatcccctttagccagccgatcccagtgaaacttcactttgacccgaccgtagcggtcggtccagatgctttcgcccttcggcccgaccaccttcgccgtctggggcccgccggtgcgcggccagggcgttttctgctctggacgaaacaccacgcttgccggaatcaccgagaaggtcgtgcgatggatggttgcgctgtcggggccgctggcgtagcgattctcttcgaactcgtattcggcaccggtaaccaggtactctccggcatcgctgaagaaggcggcattggtgagttgaaaggtgctgcctggcacaatgcccatggcggtggcggtgccctgagtttgctgatgctccacctgccagcgctcctgacggatgcgtgcataaaactcgccatgaccgtgttcaacaaaacggcccggccagtcatagacatcgatggtgccaggagagggtgactgcgggttttgtcgcgcctggaaaagccaggcgttgggcttacggaaatcgtagtcgtccagactgtacaaccccggcgttacgctgtccgtcaatgcccactggctgatgccctcttcgctggttgtgccgcccgagggcgtttgatggtagggaataaattcgtagccgctaaagggcttgtattgtgcaacggcatcggtgagcacgatcgtgtgcttgtcagcctcatggcgaacgtgccaggcgatgccttccagctccatcaggcggctgatgaaatcaaaactgctttcctgatactgaacgcagtaatcccagttgcggtaactgcctgtcaggttattttccacattaacctgatactcgccgaataacgtctgcacaatctgtggaaccgtctgttcctgaaaaatgcgcaggttgcgatcacgtttcattggccacaggtcgggctcaagcgtgagctgataaaccgcatagcgcgtaccggataactccaccgcgctgacggcaacccgggtgatcttgccgttgagatagcgcgggcgcgccagagtttgcgttgggataatcagggtggcggatttgcccagcagcgcgctccgttcgatgcgcgcatccgtgcccaatacctgcaaattcagcgtaaaggattcggacagcgcctctcgtccggagagcttccagaacagcaggccttcaacaggtaactgaacagtaatacgattaagcataaaccagaccctaacgtcagacgaaagccacgccgggcttcgttggtgcgtttgtcgttgtagcgtagaaatagcctgatgaacagttaaagtaaataagacaatgtccaatatgttacttagatactaagaagtgtgagaggctattacattcgcggcagaagcttgcatttcctggggtgagcggcaaaaaccaggcgctgcaaagggaaaaagaccgggtgagcggcgcaggaatgcgcgcgtatagtgaaataatactacttagtgacaagttgttagcattcgtgctttctgagctgtgctggcctcgctcagcatcatgcacgcgaggcgcgggtcagcagcagaatcacaaaaacaccaccgatgcctgccgtaataatcccgatcggcaactcctggggtgccagcagcgtacggctggcgatatcgccagcgcacagcaaaaccgcaccgcccaggccacacagcggcaacagcagacggtgttttaccccggcaacagagcgacacagatgcggcaccatcaggccgacaaaaccaattaccccggtcagggccaccagcattgaggtcgtcagtgcacagcagagaaaagtttcgatgcgcacacgactgacgttaatccccaacgagagagccgtttgctcccccgccagcaggccgtccagagaacggtgtcgtagcagaacgaagccactcagcagcgccacgccggtgagcgcaacgggcagattttgccagctggccagccccagaccgcccagcgaccagaacatgaccgaactggctgctcgctgatcgccagagaaaataaaatagctggtgagcgcaccaaacaaaaaagagacagccagcccacagatgatcaggtgctctgcgctacgccgttttttaaagtggaacagcaacataaccgccgccgcagaacagagcccgcccgcaaaggccgcaaccggcaaagtcagttcccccaacctgtcaccgaaacgggtgatgaccagcaccgcccctgccgaggcgccggaagacagaccaaagaggaagggatcggccagatcgttgcgggtggtggtttgcagcagtgccccgaccattgccagcccagcaccggttaacgccgccagcaaggtgcgcggcagccgaaggtcaatcacgatacggttgaccatttcagacgggggcgcagggagtagcgccagcgcgcccaatacctgctttaatgataacgcgaccgtgcctgtagcaatgctgatgagcaggagccctgccagcagaaggacgcaaccgcacatgacccaggtataacggtgagacaccgcactcacggcgcggttccggaatacagggcatgcgccagtttttctacggctgtgatattggcgggccctggcgtcagctcggcatactgcaacttcagataacgatgatgttgtacggctggcgtgagtttcatcagcggatgatgttccaggaaacgccgtagcgcatctgccccgccgccggtctgataatccaacagaataataaaatcaggttccgttgcagccacgctttcccatgatgtggtgccccagctgatatccagaccgcccatcgcattggtcgcgccagcggctgcaataatggccgttggcatggcatattttccactggtaaacggcttatcctcgccggagtcataaacaaacacctttactggccgggccgtgctgggccgttgaggaatctgcctgaggcgttgcttccagccctccaccagggcctgcgcctcggcctgtttgccgaagattttacctaacgtcagctcatcgttataaagcagatccatgctggcctgatgcttgtctttttgggtaaaaacacagctttcacttaataccagtgtcttaatgccgtactggcttaacgacgcaggcgtcacgtcgccccctactttcatgccgtaattccagccggcaaaaaagaagtcgggatttaccgccaccagcgtttcaagagacggatatttaggtgccagctcaggaatggctcccatcgcctgcttaaattcaggcgtcattttgtaccagccactgatgcctgtcagcccgacgatacgatcctgcacatgaagcgcaaaggccatttccgacatattgaggtcgttaatcactgcccgttttggcggtgaattaaacgtgaccggctggccgcagctctgaatagtgacagggaaatcggcggcaagagcgtgcccgacaggaatgctcgccagcccgacggcaagacaaagtgctaacaacgtttcaggcacagtctggcacctcgaaaatgcgtaaatgttttccgttagcgggatgcggtacggtaaaactgtttaacccgaacaccggccggagataacgggatgacaaggctcgggctggcgtatcaaagaccacctgctcgccctgcgacagaatcagcacgcggtctgcaaagccgtcaatcagtgacagatcgtgcaacaccgcaacggccgtgatccctttgtttttgattaacgtcagcagcgcatgtcgtcccaggggatcaaggtgattggtcggctcatccagcaatatcagctgtggcttttgggccagaacgcgcgccaagatggctctttgccgttctccccccgatagcgcatgtaacgaacgtcgccgtaaccccagcagccccgtttccgctatcgcctcgctgacaatgcgctggtttacagaatgcggacaggtgcgggcatgaggaaggcgtccaagtgcaacgtaatcttcaaccgacaaccgcagatcaggcacgtcgttctgcgccataacggcaacacatgtcgctaagtcctgccgggtaaatgttttcaggcagcgcccgttgagtgcaatctcggcctgctgtagcgccagctcgcggcttatcgcccgcagcaatgaggttttaccactgccgttcggcccgataatggccaggcgctcccctgcccggaggctgaaggtaatgtcattgagcaggcaaccgccatcgggtttgtacagcgccccaatgttcacccgcagtatcgactccgtaggacgtaacgtctcaggccgcattatgttaacctatctgctatttgttatgttataacataactattgggttttgaaaaaacaagcattctggcgaaatgaaaaaaggtgccgactgagcggcaccaaaaggtggggataacgaacgacagaacagactatttaaatcggttttgaaacaggctggcggtaatggctaacatgccagcacccagagagctatgtagcatcaatgtattcaacataacctatctcctcgatttcactgtagggacaagcggttaaaccgcctcagccagcttttcctcgttggcctctttctcaatcaagcgcatcagcaacgatacccggcgatcggtacgctctggggtatccggtggcaggttataacgcagggtgtagagcttgcccttctcattgtaaaaatccaccaccagcacaggcagaattccgcctggcactttattgtaattcaccgacaagcgggtcctgcccagctgcagtttggcagccatgacggtctcgccgaccagtttaggatacaggctacgatcttcgggcacgctgatgactctcataacagcctcctgattatccgcttgataacatagtgcggagagcgctgttcacgctccccgccgtcgggtcaaactgccattaagcctgatgttcaattgcctcggaggtgcggtgttcaatcggaatgcggcgaggtttctcgctttctggcacctcatgatgcaaaccgacccgcagcaatccgtcctgcagccgggcagtggtcactttcatatgttcaggcacgctgtagctcagacggaagtctgaacgactgatgccccgatgcaaccagccgctgttctgaccttctttgtccgcctcgttatccgtcacctcctctttctggccggtaaccgtcaggcgaccgcccgccacctcgatctccagctcgctttctttccagccgggtacgctgacggtgagctcatagtgctcattgtcagtttgtctgaggtcataagagggtgaaaccgacacgggcgcatcaccggtcaactggctgaaaagccgatcgatacggttaaaccggtcagagaatgcggaatccgcgacagaaggaaatacagggaaattacgtaatgccatagtgataacctcctgaattaatggttcattcaaaagctcatctgcgtggggaccttccccgttgctcagagaaatttataggatcgtttcggggaatttcaagaggatgaaaaaaatttttttaaggtgactgtctcctgttctgttacagatgtcacggccagcaggaccgctctctgtatgacgcttcagggccagtacagagagcatcagccggtaatcagaagtgatatttgaacctgactcgggtgccgtaacgatctttatttccgttatggttatcggcatgaacctgagaccagtaagcgcccagatagatatcgaaattttgcatattcattacattgcgaaaacggtacgaggagtgaacggtgtgaatgtcatacttccctaaaatgaagtcgctcaggctggctgtagggagatgctggagcgtaaattctttaacatcgttgcgcgcatagatatagccgagttgaatatcacgccataagccattcagacccgcactgaagttttgctctttcttcgcgtccatatacgccgtgcttagattgatgactgcgccattatccgggttggcgcgctggccattccagcttagcgttgcaccgtaaccgttgcgcctggactgatcctgaaactgaccattttggtccgtataaccatacgcattgctcaccacattgctttccatggcgaccgccgccgttacatcgttaccgttccaggcgataaccggacgcagatagatcacattctttttatgctcaagcgtattgccatggtattcaccattttgaaacaatttggttccgtcattcgccatggtatttaattcaaaataaaaacgcccgattgttttgctcagctggatggcacccgccgatcctcggccacgcgcctctttcatcatgtagatatagccatagccatcttcatagagatcgttagcggtattgccggaatactcgataagcgtgtcctggttaagcgggaacatatcaaaggcttcgtaacgacccactttcaccttccagtctttttcctgaccgaagaaaaaggcggcatcgtctaactcaagcccgcctgacaggtcagccagcggttgcacgctaaagcctgcaaaggatttatccgccatgctacggtaaccatccagcccgattaaaattcggccattgatatcccagcgttccgcctctcctgccttccagtttttatcagcactggtttttaatgaggtaatctggcccgttctgcttgcaccatcgagattaaactcaacatcgccatagagtgtaagcgcaccttgttctgtatcaaatgtcatcgcggaaaaggatgctgaagagacaaaaaccaacccccagaaataatgacggtatttcatagccaactccttatgctaaataaccctgagtgaataaaacctttaagggaagtatttttttgaggtcgtaataaattcgttatagttattacactgacttatgttttctataatatcgtcatgcagaatattggtgaggaaatcatatatcaacatactgtcaatgaagtggtcttcactgatggccaacatgaaaaccagctttacccgtttgccggtatcccattcaatgccatcgggaaaaatggcaacggagaccagggtacttaacgcaatgggcgctaaaggatgaggaatggcgattttgtcatccagcagcgtggatgcacgcatttcccgatctaatacagacgccaggaaatgatcattcacccgcgcctgcgcgtttaatctgtcgcaaagaaaggtgattaacgatgacttagtataatcccccgcattgaggacaaaaaagttgtcagctgagaaataattaagcatcgcattaacaggttgtgtttcagacaccagataatattttatattctcaagctgccatctttccggaaacggtggcaatagaataatacgtttattcttttcaacgatattgaccagactgataacaatatcttcttcaacgtgagacatcagactatattgctcaacagagatctgcctgacgatgtgcaaacccggatacaggctcatgattttttgacagacaaccctcgtcgatgccattccctgatcgctgaccaccagcgcccgcatcccttgaccactctgatggcagatactttcttccagaatcgcaccaatatgcatcaccagataaccgatttcatcggcactgatggtagccgtgaaaaactgatctaattcgctgaatgcactgagcgttaattcatacattaacggatagtggcactttatttgttcgagtagcgggttaacaatcgtaatcgcgttgttgacgcgaacgcgcatggctctgatatggcttaacagcgtagcctgtgacagcgcgtcgtaattcacgttaataaaccacgatgtactcacgtagctcaaaaagtgattcatgattgtgcgttcaacagaatacgcctcagggacccaatcgtggctggaggtggtggtacaaaaggcaataaggttcatggccgtgaaatctatttcactttgcggaaacggcacggctgggttaatccataatgactgaagtaaggcttcagcaagcatcttccaaccaggctcggcatcacaaaattcaaaatccagtagccatttccctcgcgccattctctcctgggcaatagcgatgatcagacttaaaaaatgcaggttcgcgtcgcttatttcgagctttttatcgctaagaaagcgacttaacacgtttctacagtctggataagccctgaccaggtcggtattattaccgccgtcagtggcctgcgtgagccgcagttggtggtcgtatatacagcgccgaaaggcaatttcgctgcctttaagcttaaagatgtcatcgccctccgacacgatacgcaactgatagagagaaacgtgacgcttcagcaaagccatatcatttctgagactgtaaatactgataaaccattcggcttccagctcagcaagcatcacgccctgctcatcagacagcagtgcctccagcatggccgcgcgacgctccgcacccgaacgtgtttctttccagggttgttggcactgatgcagtaacagatgcaaggcatcgggatcgctaatctgtaaagagaagccctttttgcgcgtatagataagacggttaccagactgcctgacaatatcacccacttctttgaggtcagtacggatggtccttgtcgacaccttcatctcttttgccagagcggactgggtgatatcgccctgcgcgagtgtcatgaagatgtccctgacccgtttgctggtgaacagtctcatggttatatccgtttaatctgcaccgtctgcacatcatttggcctgagcatcaggcgcgtcggcatgggcgtcacctcatccagcatcacgaagtgtgcattcgggagtgatggaatgacgacgtcggtttcgagatggggattataaaatctgacaatgattccgctgtggtcttccgcacatttcaccgcactgaccagcgcatccctgaacgtcgcgggcagattcagcgcactgtaggtttcgggataatcgcgtttctcatcattccaacaaaaacgcagtcgtccgttcaggaagtcgctgtcctgataaacgggaaactcggtcagccaggttttcgacacgcgggcatgttgggcctcatcgaatgtgccgcggtaagttcgccagccaaacgcaaatgacaaggttttcaacaactgggcatcaggcgtttctacgatactttcaccggacgcgcggcccggccgataaagcaaattttctttacccataaagccaaacgtgcggaacagcgtcagcgagagcgtattgaaatcatcccctacgatttcgtattcacgaacgccgttggtgtgcagcgtaaagccgtgctgctcgtcatgcacattgacatagctttgcatcggttcaatcgagatcggcttttcctgccagcgttcttcttcccacaggtgaagcgcattagttaactgcacaggccgggttacgacgccgaacaattgatcggcacatgacacgttggcacagatatccgtggcaaagtgcacacaaaggcggtggctcagaccattgttatcaacatccagggtaaaccggatgagatcgtcgtcctgcaacctgatgtttacggacaaattgagcgttgcagatgtcactcttgccgccctttcggtcagatcacccggcaccttaagggcatacgtaagcaacagactttggctgatcgcacttttctgacgttgtactgccgtcatgctgttttcggaggtaatgatccagtcagcgcgcggcggggaataattataagaatcgccatcgtcaccattttccacaaacagcatctgccgcttatagcctttcccactcagcttatcggtaatcgtcagcaagccatttgcttctacctggatgtggtaatagtcattttcgatactggtctggttgctggtatcaggcttagtggccccgtcttcagcaaaatccatataccaacggcaatagcccagcgcgggtaagccaggacttttggcggtcagtcgcgtgcgatagactttttcgggtttgtgccagggcttgcccggatctaaacggatactctggttaagtacatactgagtgaggtcctgctgctgctcaataacgcagggaatagcctcaccgttgttgtcacgtaaggtaaaaggcaacccgggcaaccaggcctcgaaagttatttgcggagctacctgccacggcagaggattaaacacggtaaaggtaaaatcatgatggcgcggaatgcgctctgtgataagccttgtatgtaactccagtaaattctgcgccagccctttagcttctttatagcggaagaagacatcctgattggtatcatcgctgttacatccgccgatgctgtcatgcgccgcgttataaaacatgcgtttccagatgtcggcaacaatatgctttggataatcatgcccaaggctctggctgatggccagtatgggctcaagcgtgttaaccagcagcgcttcagtctcattgttgagtagcttcaggtcagcacggcaggaaaagatcgttttatgtacccgtgaatgtttggcttcggtgagttcaccttctaatgtccgcgcgtcggtacccacctcctgctccagcgccttgataaatgtcagcgggttactgatttgataatggcggctatcatcacgggcattaaactgctcaactaattctggcaagttgcggcgcacgggagcctggtcgaagccatgaggaaacagcaggtgctggcgatgactgcgcgcttctatagccgccatcttctcatcaagaaaggctttcatggtttcaggcgtttcatccagcaggccaccatagtggtatccccatggcatttgcagggcaaaaacccggtcaccattatcaccctgccagaaaaattctgtttcgtgcagcgtattatcggcgatgccgcgccagaacaaagcgtgattgagaccgaactggcgatagagttgcggcatattgccgccctgcccaaagcagtcagggacatagcccagcttcattacgttgccatgcctttgagccacttccataccgtaaaacaaattcctgacaacagactcctgatgaatcaccaactgatctgtttgggtaaaccaggggccggtcagcaaacgctcatcggcgatcagtttcgtgagtctggctcgatcctcaggagcccactgaagatagctttcgataagtgaactttgcgcatcaagtaaataacagggaaagtctggattaccctccagcacctggataaggtttttgatatggttaaacaaataaatacgcgaacgtgatgaggtaaaataccactcctggtcccagtgagtatgcgtatacagatgaaccatgcgtttcttcatgttattaaccttactaaaataaatttttagtcaaatttaatttcaatatcatcggaggcgttattgatattttcgttgatgatttccgactcattaaaatccactaagaaatttgcacctatggctataatcagagtcccgaccaatgcgccgagaaagtaagcccatgcattccccacggtaaagccaccatacaatccacccagtggcggcataatgggataggctttaaacagcgccacggtcattgagcccatggcccccgccagtatgtttaacggaattaatcgcgccggattttttaaggtaaacggaatcgccccttccgaaatacctaaaatgcccataatgaccgagccatttccggcttcttttaaagtctcactgaaattaccgggacggaggaatcgtgcagcggcgtagcctaaggggggaataataatggcgacattcactaaaatggccggtaaatacacgccactcataaacagcacatttgccgttccccatgcggctttatttaccggcccccccaggtcaaaacagatcatcccacccagtaccgcagccagcaccaccgtattggtgccgtcttcggtcatacgctggacccaggccatcagcgaactgttaagccaggacaggacatcgcccagcagcaacagcatcaccacaacctgcagcccaacagtaataaacggcaagatgataaggggcacggacgaggcggcagaaccagtgatgcggatcttccgggatacccattccgcggagtagcctgccagcaagccgcccagtacggcgcccaaaaaacctgagccggtgacagaggcaatcagacccgccgcaaaacccggagccagaccttttttacctgcaatggaataggcgacataggcacctaagacataattcattaagccaataattttaaatccgatatcctgggcaagatacagccatttctccaggccgctactgtgagcgaagctgtccagattaggttcgccaagcaggataccgataattttggccaccgcgaccactaacgatccggcaataatgacaggcagcgcaaaagagataccggtcattaaatggtttttgatattgaccatagtttttttcattttgtcaccaatatcacgggttacggcgcgcctcgacagccgccacgcattttgtaatgacctcggctgcatgtccgacgcactggctgattttcaccctgattacggtcttaccggcgaagcgctcttcttcttcaatcgagcgatcggcggcaatcaacacaaagtccgcttcagcaatatgttccggggttaatttatcgatcatccccatcgccccttgctgttcgatatgcacctgatgtcccaacttgcgccccgctttttccagcgatttcgctgccatcggtgtatgcgctaagccagcaatacaggacgtgacgcctacaatattcatgcttcctccttaaactggattcgttgcatcataaactgatgcagggcatccttattttcgatcgtaaacaacgcttgcctgaaatcgtcatcgacaatctgacttgcgagcgcgttgatgatttttagatgcagaatactggcacccgattttggcaccaacagtgcgaagattattttgatgggttctccatccagactttgccattcaattgcgtcattcagacgaataaaaatcacgccggcctttattacgttttccgttttggcatgaggcatggcgatttgactctcaaagcctgtggaatattcctgttctcgcagccagaggtcggtttttatttcctccacgctcatcgcccatccctgagcaaccgcatgtgaagcgataaaatcgaatatttcgtctttactggtaaatgctttatttaagaatatgctttcgcgatcaataagcatggtttccctcttgccggattgttccgtaccttgatgaaaagcctaacggaaacctaaggtatgtaaacacaagcggtttccgctaaggtgcggaagatgtctgcggcagagcgggccagaaatgggagcgttgtctaaataaaaaagcattatgagcgtcagatcacttgatttgataagggaaggtttaacagaagtaagtaaggtcggaatctatttagggtgacaggaagggatatatttggagatgtgtggtggattttagaagacggaagacagcgttatcgtgttgagtgtgattcaacgcgaggataaaaaggggatgtggacggaacgggggaatgagttggtctgcaaagaggataccacagaccaacctgcgggctatttcatgcgacgctgcctggcaacgctggcaaggcgttgtgtccggcagtaaatggcaaacaggatgaaagcctgcccgttaagtatccagcgagcaccagccaaagcaaccaatgccagaagcagccacaggcccgggtggctagccgtaacaacgctgtagctcaatagtaaaacggtcgatataagcaacatcgcacagacgtaagccagccccgccacaccggctgtttggcctcgtgcaagcaggtaactggccgtgagtatcgcgccaataatgacgattgagggaacaaaaaaactcaacgcatgtacctgtgggctgagcggaggtaacgcgtgcagaaatgtcagcaaattaaatgcaaaggcgaccagcaacagcatcagaactattgcaaccgggaagccgttttgcctgggaagcgacccggaaggctgtttgaaataacgttcaagctctggagtggaacgggctagtatggacttatcctgtcgtgcgattacctgatctatttcgcgaccatgctgcagtaattcagcgatattacgcccgacaagccatggtaaaaattgcattaaaataccgccaacgattgaatggttcccacaatatagtgcccggtgcgcggcacgttaccgggagcagcaatgatgcgagtgctaaaaaaatgactgaaggtggctactcgataaaaaaaaccacatcacaattttcaaattaccaatcttaaatttttaatttattccatttgcaataatcgttccatgacttttcatctttaaagcctgagcgataattacagctaatcatacctgttctgttatgtgggtcatatactgcatcaatgtgtccccacgcgccatagactggaagattacaaccagattgcacttcaaaccactctcttaattttcgcgtaactttaccctctggtttattttgctctcccatcaatagtttatcaggtgcaaagcaccaacttactactgtggcattcacatcaccttgatgagataaaaatacgatcaggtaaatatcatcttgcctattgttttttgtattaaaaacggctcgataatttacggtatcatcaccattgtcaggccatgcctcccaaaataaaccattaattagaaatagctcttgtttagctaaagtggaagaaagaaccaatccattcccaaaatttacatttccattatctttgttaaaattcattcaggctctccatgccaatagccgcactgacgccgctatagctccaagcgataaccaagcgaaattaatcatgccgctattaacagtttgttttattcctaacttgagtgagtattatcacctcataagcgtcttgcccgcttaattttgctttgttaaattcttctttgcttatctcatatttaacatctttatttgcaatcccaccagcgtcataattgatataatatttcccatcgtcttgtgtgatgaacatcccatagccactaaatatagcttttcccatcatctactcctgactttaaattttaataacaaatgctcaattcaaaggtgttggatctatagttacttacggaacccttacatattccctccccaagtagtacgctttcccagtccaaatactgaccctgcatacgcagattctgccctatcactggaattcgctgactggacccacacagcagtttgccccgggtactgtttacacctgcctaggttttatacccttaagcagcggtcagcagttccggcgtgccgttagccgcgcagtagaaccagaatatcgccgggctttctatgacatcaatacgggcaagaggctcatagctctggttgtcgttgtacacataggtaaacggagtatcgtcatgtatttcctgcagcgggcggaaggtttgagagaaaagtggatggtatgacgagtgttgcggaattgatgttccgcgataagagtaatgaagatctatgtggtttatttcatgcgatgctgtcgggcaatgctggcgaggcgttgtgtccggcagtaaatggcaaacaggatgaaagcctgcccgttaagtatccagcgagcaccagtcaaagcaaccaatgccagaagcagccacaggcccgagtggctacccgtaacaacgctgtagctcaatagtaaaacggtcgatataagcaacatcgcacagacgtaagccagccccgccacaccggctgtttggcctcgcgcaagcaggtaactggccgtgagtatcgcgccaataatgacgattgagggaacaaaaaactcaacgcatctacctgtggactgagcggaggttaagtttgcagaatgtcagcaaattaaatgtaaaggcgatcaacaatagcaatcctgtaacagggaaactgctttaacggagaagcaccgctggaaataaatcaaacacgcttcagctttagtgtgtatcggacaggacaatacagaatccttctgacatactatttactttttcttttcaggaatatttagcagcgttttaaattatcaccaatcagaattgagaccttccccttccttctctggattgggtggcaataatgacctcataagcatcactttcacttttttgagcctttaacgcctcatcaaaagttatttttgattctttttcaaacatagcaatagtaccatcgtcatatcgaatatagtaatcatcatttttctttactatatcgataccataacctgtaaatatcaattcactcatagtaaatctcgcagaagtttatttaaaaagggataaatatttgcatcactcagtgatgtttggtcaataaccgcttcaatcaccccccggattttttcctacaggaacccaatgatcattggaaacttgcctctggtttttactttcaggcgtcaggtgtaacgcatcaggttcacctttgaagtgggcattactctatgacttatctaacttatctaacttatctaacttatctaacttatctaacttatctaaccaacataacaaatctcttactattgcaacttgcttatattgattttccaactgaaggggtaaaatttaaggaagaataaatattattaacttaaaagattgtattatttaccagcaaaattagaagaaagattgatagagtgaaactccttcccatctgaatcaaaaatttatcatacgatttttttcaaaattttagaatgaatagcagatgctaagtcaattgattcgcgactatgtttatccttatcagataaaacaagactagtataatatttcaacttcataaggatctcagcggaagtggcaccgaaatcgacaacatcaatgatatcatctgcaatatcagaacgacaaactgcatcttttttaactaaggaagctagttttttagcttcggtataaatatcatttttcataattaaaaaatactggaactctgaatatcaacagcatatgcctgaaccattacttctatcccgccaccaaaattatcaccgacaccaggagcagacctcgccggggaagtaaacgagttaaagattattttcattaacaatcaaccatatattattctttacagaaaccaactcatcattagctttctttctctctttgaggtcatcacgccagatataaaaatcagagaaagccccattaccttgctccattattttccatatattacaagcttcttctaagtattcatttgacaatgcttcgtccttactcaatgctctctctatcttttcaattattgctaaaatacctcttgcccaatttttttcattttcttttataagaattttcttcaactcttcgaattcattcaagagattaatggatatatttttactatccatataattacctcaacggtcaactatcaagcacttcaatcccacttagtcgccatgattgctcaaaaaatattggatttatattctgtccaccgagataaactccccttgatagcgtacaggccctttataaatggttgtccctttaggaataactaacttgtatacagattcaattagaaagatgcctgccaaaataccatttttatctatccattgtggttttactgctaggtctatgtgtactttttctacagaatcagaagctgaattcccattaatttttgccaaagggccggggttattaagcatttcatatttgtaatcacctttacacctactcagcccccacagttcaaccatcccagcgcattcggcgcatactaataaaaacagggatgtccaagagcccataaccgaataccatatgtttctctaatctcgatgctacccaaacaatttagtattgagtactgtaaagtgattatgcatcaaatgatgtggcgacagaatgatcgagtcggttacctgtgctatcctccacatcttctagctccccaccttattaagaagcatctgatatagttaatagtttttaagctatcattggttacattaaaatcatcgataatttctaaaatttaagataagtagatactgctttctcagcatctgacattttaaaaagtaaatgattatcgtaatcattataaatttccaaataagcttttactgaattgtgtatgtcattatgatccaagatgtcagcctctatctttttaattgttaattcatatcttttaatgatgtcatcaagcttattttttccatgtactaaagcttcgcttttgattaaagtcagtgtatcttttaatatttttataacttcattcttattcatatagacagcctatggagtattaattcttctaatgtttaaaatccaactctgatcccagtctcgaggaaggattatttgatcagctttcccagcaagtattgcaccggattttgttacttgaggtgcaacctcaccaatctgtaatatagtccccttaggtaccaatattgtagcttcgtattgtctggtatttttccattctggtagcaatgcagcatcaatcttagcttgaatacgactacctgcacttgttgtagaaacgaatgaaccacctgcctcagccttccctccataaactctatataaaacaacaccttccgtagtgatgacggttttgtaatcactatttgtaaattctgagatcacttccggctataatttatttttctttatttaacttattcttaaattcagtaataagatcggtccattctttataagtaatattgttaacataataatccccaagccatttaggatgacatcgtgatattaaactatctatcgccatcattcttaaaggatcattttcattcaacattaatacttttatcattagatcttcaatgtcattagcttcatcaagataagcagatgaagccaatatatcacatatttttttgccaagttcttctaaattcataatgattctgtcgctcctgaatatctaaagctgtcagtcactatttgcaacttatcaccgactttttctactcctcattacagctgaggcgcgactttactttcaagaaaaacttgaggtcttgttagggcaaccttatattcataatttgctgagctattcggtggcaaagccaagtttgcatgtcttgccgctggggcagcacctgcacttcttcttgtgacatatgcttgtgaggcactacttggtgtatgctctgtaatagtgaatacatctccaggctttactctggatgtataaacctggccattaaaactattaatagtgttatgctgaactttcttatttaagccacaacttctaaatagttttctggctgaatttcgtgttattggtgttttatctactgaaaacctactcaactcaagcgggtcaatccacgtgaatgcattcggcgcgtactggtaaaggttaatccccccagccagccctatcgggtcctgctgggtaaaccggccactgtccgggtcataataacgaaacagattgtagtgcagcccggttaattcggcacctgcggtgcctcaccccttgcggctatcgttaaaattaaataattttgacagttactgctaaaaataaaagacttttttattattttcactccctccttcttaggcagactattcccataaggattttataatacattatgaaagaaattattattttcccacatgcaactttttatcctttcaacttacatcattcttaatgttattcttaaaaaactgaagataatctgtaaactcatcacaaaagaaagcccgatttctcaatacactcatacttcttgacaccccatcaaataccctgctaaaagcatgcagggcaagataataaatattaatttgtgtgccatcattaatatgacaccaaaataactcccacatcttaataattataaaacatgatgattttattagaatatcgtctttttacaaccctaaaaatataattaacaataaaataaaatttaaaaaaccagatcaattccattctatatatataccgcattcaaaagtattagggtttgattgaaccactacattaccccattggaagcgccatatatacccatagggaggtttttttattttaccatcatagttttcagggtattgatttaaagtccattcatatagccttttttcttcatccttcaatatatttaagtcagcttttttattccaatcgtgaagattttgaaaataatcaccacttttgctaataagataaacgctacctttaaaagaaaaaactgcaggtctgaactctatagcaaatggttcattatgccagataatttctttagcaaaaaaacaatatttaccgacgcaggtcaaatctttagagcattgaaaaaaatgagaattaataaacaaatcataagatttaagctctatctcattttcattcacccgcaaaattccagtattttcatctaaagtcatttttttcatatatctattatttttcctggtttcagtttaagtcttgcttcttctgggatatagaattgtagccctccacctttgccgtaccgtgcgttcgcctcagcacgtcccgtagccacatatatatcctctgtaacataataagctcttacctgtgaacgcatagggaatgctgggtttaacttaatttgcagggcttcatgataaccaagtggatcacctttatattgccttacagtgggatgacttacagtatatgctggcaattgatctccattaggatggagagcatagagtatagtccctttttttattactttattagtgtatacatcaatgcctggataatctctattatgtggcccctgccacttagtcgcttctttagaaggatttctacacctactcagtccccacggatccacccatcccagcgcattcggcgcgtactggtaaaggttaatcccgcccgccagccctatcgggtcctgctgggtaaaccggccactgtccggatcataataacggaacaaattatagtggagccccgtttcacgatccaggtactggccctgcatacgcaggttctgctccaccaccggaattcgctgattagactcgcgcagcagtttgccccatgggctgttcacaccttcccaggttttctgcccttcaacgtcagtcagccgttccggcgtgccgtttgccgcgcagtgaaaccagaatatctccgggctttccacgccatcaatacgggccaaaggctcatagctctggctgtcgctgtagacataggtaagcggaatgtcgtcgtggatctcctgcagcagacgatagccttcccagacaaagcgtgttgtgacggccctgccagacggcctgccctgtaacagttgctggctggttttactgatgcgtcgccccagcggatcgtagcggaagctcaccttagtgcgtggcttattgcggtcccgcggttcgctgatgacgtccgtcaggcggtgctcaccatcgtaacggtagcgccagcgggtctggccgtcatccttcccggtggtacggccatgaatgtcgtactgccaacggataccgttcagctccgtgacacggttatgcatgatgtgggaagcagtatggcgatccagcgggttgcctgcgccatcccagcgccactgctcattacccggctgtgcgccttcctgagacagcagccgaccggcgttatcgtagttccataatgtctggctgaacgggttatcgtcgcgctcttcacggatcaggttgttgccgtaatcgaagtcccgccgacgggaccagacgcgcggcgcagggcgctgtgcttcccctttgaaaacgtcacgacggcgcaacctgcccaaccggtcatactcactgcgcgtggtcaggccgccctgcgtgcggctgagttcccgatgcagtgtgtcacgggtaaactcggtgaccggcaggttgtccagcgcgatgctcagtaaatgaccactgccgtagtaaagctgtttcaggttacggccatccggcagggttaaggccgtgcagttgcccagcgcgtcgtaatcccaggccagtgcgccctgctccccctgctcacctacgatgcggcccagcgcatcatacgtaaacgtaatctcctgctcggcctgctggctccacgcggtgtcagacagcggcagatgctgcgacactttacccagttgaccaccaccgctgtagtgatagcgcgtctggccttccggcgtggtccgcgccagcagttgccctgcacggctccagtggtaacgatgggtaatggactgaggatgtccggcggcaaaggtgcgtgataccgtgcggcccgcggcgtcataatcgtatttcgtggcaacgccatccagcccgacctgggccagcaacagggaatcggcaccccactcgaactgatactgctcgccgttctcgttttgcagcgccgtcaaccggccgcggctgtcccagctgcgctgaaccgtctcaccctgggcattacggttggcgattaagcgtccgacattatcgtagcggaattcactacgtttaccatcggctgactcatgggccagtggcaggccgttgtcgctccagcgcaaccgctcttcccagccctctgcccgctccagcagaacaggacggcccgctgcatcatagtgataccgggtttcttcaccatccggcgcagtcacacagctgagccagccaaggggatgatagcggtaacgcgtcgtcagtcctgaacagtctgtttcacggatgacctggccggcatcattgaattcgcgacgatagctgttacccgccgcgtcagtttcttcgacaaccagcccaaactcatcccgtttatagaaggtactctgcccgagcgcatcgaccacgcgctcaaggccatgatggggatcgtaatagtatttcgttgtggcaccgtctgcccctgcgacgaccgtcggcagagaacggtgtgacagccattgcaccgcctgcacaccgccatccgcatctttctcttcaacgcggttgcccagatcgtcataggtgaagctcaccgcgttgcccagcggatcgatacgacgcgtcaggagttcgttttcatcccactcatagcgccacttctcgccgcgctcatcaataaagcaggtgatgaggcctgcggcattccagtggtgttcgcgctgttgaccgtcataggtggaaacgcgcgtgataccggcctctaagtcgtaatgcatatggcagccgtcgccggtattggtgcggttttcaacgacgcgccagtgatccagtttctgccagcgatattcgctttccagtccgccgggcagttgatgccagaccattaacccgtcatcgttgtaacggaagcgacgcgagacaacgcctgcggcatcggtgacgctggcaagctggccctgttcattgtaggtccagtgcgctaatggccagtgctgatcaccatcaaaatggctggctgatgtcggacgccgtgtgtgcagcctgtcgtcgtaatgcagggtgacatcaatagccagcggcgcgtcatgaatacgcaccaggcgagcctgctcatcccagcccatctccagcgcattgccgtactcatcgctcagagaagccagccgcagcacttgcggatcagcggccgtacgtctgtacagacgccataccgcaccgtcgtcgtcggcaatggcgatatcacccaattcgttgcgccgtaccatcagcccttcgctgatgctgtagagcacctctttttcaccgggaaccgcaaagctcagctcgcgcccgttgtcatcaaaccaggtcgcctgattgccatccagcgttaaatagctgtcaaacaccgtcgcccagccagaaccaaataatccgctgcgctgtgtcaggctgttatagctacgctggaaactaagcgggaagcggccaggaagggagaaatcgcgctcggcatcatcattaagaactttgacgccggtggaggcatgaaccgggaacaacgacgaaaaggctgcgttaatcgccatatccgccatcatcccgcccacggcgctcgccagcgcgcagggcatatttttcaggatctggctggggcgaccacgaatcagggaaaggccgatcatcatcacggccaggcctggcaccttgccacttttaatttctcttactgtgacggtttcaccaccaatgatgacattgggagaaacatcgtcactcaccgtggcatcacaggtggttttatcctttgcccgcaccgcaggctggccattgataaagacgcttttcgatccctgcgccagatattgcggtgcactgtgcttttcacaggccactttgtcctgctccagcggagaggtgccagcatcggcagaggcgaccgtgggttgccacattgcactgccaaactgccccaccgcagagagcagcatgccgccatagtctgcgaaactcttgggcgattgcggttccggtggcggcgtatctccaggcgtaagcatcccggccgcgcgtgcagctaaaagaccattaacgtgaacattctcagagccgctagcgatcacaccggctggagaaggcgggaatatcatgtctcccagcccatcggccgctttagtgatgtcatccgaaatgcccgcagcgttcgctaatacaccgccaataatgccgctgagcagacagctggaaccaatggctgccacgccggccgcagccattcctgcacccagcaatggtgctgctgctgttgccgccgcaccgaccgcagcgccgatcacggcgtaggctgcgccttcagcaacaatactggtgatatcagcgaaaatactggagtgaatgatctcatcgcccacacgggccgcacggttatccatagcttatgctttccgtgggttgttcagactcaggctttgtttgaaggcactccagcgctggccgtctgcttcattgaaggcgcgcatcgcggagagggtaaaaatcattaagatgttgctatccggaacccgggccgccaactgtcgctgccacacggcttgtccgttacgatcgaatgcggtttcaacttctaccgcacgcaaagcgttatccgcgccagccgtaacccgaacaaactcagtctgctgaatgtgacccatctggctgcgcaacgtgtcccactgacgttgaaactctttttccgcatcgctgtcctcaggaatcacaccccggctcaccactaatgccagtccgctggcgtcatcccgcaaaatattcatggtggtgtcctgccaggcagcaggaaacagcgcaaaagcgccctcattaaactgataattcataggatgtccgttttattgattgtttgtggcgggtggaaccaggctacgataatcgccatcagcattatcggcatttgtgagtatctgtgtgttatcacgagcaactttgatatcaaaaagccggggagaaatatccgggtccccgccgcaactgacgtcgtggttatcttcacgaaccgtaatgatgtagaacgccttctcactggtgtcatccaggtcgtatctcagacattgatcatcaagcgcggtgaggtgataagtatgaatcgcgttcgtcgctacggcgatagcctgatcagcgctgacttcatgttgctctgcactcatggtggtattcaacatgatgtgactgactttttgctggtcaatttcgaacatcaactgcttctcacccatcttatagataagccagtgctgattatcactgttgtcttcttttccgggtccataggctttctgaacctgttccatgctatcgccgacgatgatattacgagccgtcggcacgctggcaccgtccaataggatctctgccagaattgtatggctgtcgttcccaaccgccgtcgcgctgaataactcaaagccgtcatagctgtgttggtaatagttgtagcgctgctcattgatgtccacttctccggccacaactgaactcagggctttgcctgcgcgtatgaagctttgattgctccatgcgtcgccaggcgtgaaggcatagtcgtttagcaggacagagaaatcgttatcgctcagtggaggcaccgtctctgtcgacagagtatttgccagacttaaaacaggcgtgaataaaaacgccagtgtcaaaaacaacctgtttaacgtcatatattttctaatgagagaggattattcgagccagatcatcgcatacaaagacagcaattactgccgagctttgtaccagagcatcattgtatgtaagcagctaatttactcttccgtagtaataatcaccctactcaggcagtccggatttttaaccgtgaatgaaaaggtgataacctgcccgttcgtatcaggggatgatgtatagctggtaagctcatgttcagactgaccacgtgggtaatccgttaaccggatcgcctgatagtgttttttgatttcattcagtgtgatgcatttaccttgtggcgaaaaactaaaaaaaggtgccatgccgtcagaggttttactcagacgtaactcaatatcattgatcaacaaagtatctttaagcctgacctgatcagcccggtaaaaattgatatattcattctgactttgtaatgtgaacgccagtggggcattgtggatattttgtacagacaaactttttacgttggaacgcatttgcgcgacaaagctccatatatcatttgcttgcatttttgcttccactaatccgtttattaaaaaaaaacctgccagtaacattattgctagtttactttgccgggtaatttttatcataccaacctccataataatcctcgtataactcattggtcgtggaggtcttttcaccctttccgaatatacgcccgatcttcatcctcgcgtcactctcagtgatgtcccctttttgcagagagtcgaagataccattgtaatccttttggttcgcagcgttgcctgctataccaatgtctccgccctgatgggcaatgatttcacgctgtacacgaatattatttagtgtggcagcgccttcatcactgagtgtactgttcaggtaactattcttagaactcagatcaatattgggtttataaagagcatgtccactctcatgtgacagcgactgtacgacgttagcggcgttattcatctggcttttatcgactgtgatgatacggccctgacgatccgctgaagtccccttaccggcctcaccttctttaaacacccatccacgctttttcagcgtggtgatatcctgtttcatggtaggtgatttctcaaccaaattgtcgacatctttgccataaccgctaaaagatggggtttgaacgccagaaggattagctacattgtttgaagcgtcagcaggtgcgcttgccagcgcacctgccctttcaggctttcccggcgtaaatttctcctgaacagccgcgctgatatcgcctttatgccccgctcctggcgcagaggttcccggttgcgccccttcggtgttcagattcagttttccacccgtggtaatattgccgtccttctccacgaagaaattgaaatctttgccgatcagattgatagtgccattggcgttcagttcgatggcactttcacccgacacaagacgtagctgagttcccgacgccagaacatacttttcgactacggcatcaactttacctttaccggtcagaatttcggtatcgcctttaacagcctgaatctgattcacttcgacacgatgcagctcgcttttcgctacatagtggctccgttccccacccacactatgcgtttcatcatttttgacattggtatccatgttcttctgcgcctggatccacaaatgctcctcgcccgccttatcctcaaagcgtaatgcattcgcggtatccgcagtgccgtctttcgagcgactcagaaagcccatttgtgtggcggcagccggtagtgcccatggcggcatactggcttcgttataaacacggccaatgatcaacggacggtctggatcgccgttgatgaagtccacgacaacctcatcgttgacgcgcgggatctgcaccccgccgaagccctggcccgcccaggcgcttgacacccgcacccagcacgaactcgtgtcgtcccctttcgccagacggtcccagtggaacttcaccttcacccggccgtatttgtccgtccagatgctctcgcctttcggtcccaccaccttcgccgtctgcgggccgtgcgtcttcggccacggcgtgtccggcttcgcacggtacgtcaccgccgccggcagcaccgtgaagtcaatgttgtgccgcgtggtgcccacgtcgccgctggcgtagctgttctcttcaaagtcgtagtgcgccgacgtcaccaggtatttgccgttgtcgctgaagtgcggcgcgttcagcagcgaaaaagtgtaccccggcgcgatgcccgtcgccgtgccgctcccgctcaccatgtggtgctccacctgccacacctcctggcggatgcgcgcgtagtattcgccgtgaccgtgctccacgaagcgacccggccagtcgtacacgtccaccgaacccggggtcggcgacaccgggttctgccgcgcctgcagcatccacgcgttcggcttgcggaagtcgtagtcgtccgtgctgtacatccccggcgtcacgctttccgacagcgcccactggctcacgccctcttccgtcacgctgccgcccgacggcgtcacgtggtaggctatcgtttcgtagcccgggaacgcctgatgctggtccggcgcgtcgcacagcaccagcgtgtgcttgtccgcctcgtgacggaagaagtagtacatcccctccagctccatcagccggctgataaagtcgaagctgctctcctgatactgcacgcagtattcccacacccggtagcttcccgccaggcgcgtctccacgtttaccccgtactccttcagcagcgtctgcacgatctgcggcaccgtctggctctggaagatgcgcaggttgcggtcgcgcttcatcggccacagatccgactccaccgtcagcccgtacaccgcgtaacgcacgccgcccagctcctcgctgcgtacgcctatctgagtaattttgccgttgatgtagcgcggattcaccgcgctcatcaggccgtccgtcggcagcgtgaacgtgaccggcttgcccagcagcgactgacgatcaatgcgcgcgtcggtggagagcagttccgcttgcagcacgaacgactgggacagcgcttcgctgccgctcagacgtcggaacagcagtccttgtgcgggtaactggactgtaatgcgtgaaaacataaaattcatccctgtcagaaaagggttggtaaaaaggggtacgcgttaaggcgcaagcatcaatactttgaactggctgggaacaatacgcataccaatcgcattcgttgaattttgcagactcatgctcgtcaaccgcgttgccggcgtgcctttcaataacaccgtgaatgaaccggtaagatgacgcgagggtcccatgaccgttcccgatgccacaccggttgcgacgcctgggttatcaccgttagtaagtggcgttacggttgccatattatgcgcaggcattcccataaatagtatatttagcgcatttgggattgccgttggccccaacgcgatatctggatagggaacaggcaccggtgcgggcgtcggcgtcaggcacacatccgggaaagccagatccacaccaaaaagctgacaatttgcaaacatgtttactccttaacccatatgaatctgttcggaatccactttggttatcgctttcgaggtgattaccgtattgtgagcatgcaaacgtgcgtaatcttccgctttcatatcaagttgcccagcacgaacttgttcggtgttgtatgtggtacgcagcaggttatggctaatctgggtgatggtctgccacacggattctgctcgttttccaacgatgtgtgaaagactgatccatgccgacagcttgtcaccactgtaattcatctcgttgatatggcaatcaccctgttcagcgctaacgcgcagagcggcactgcttaaactcagctcacccacactgttgatatgcaaatcgccaggtatgctgagttccgccttttgcggatcggcacgctccagcacagccagtagccagatctgattttcgacactggtgattaaaactgtgtcaccggtttgcggcacaatcacgcaacttgcagcacggcgacaatgccagcctcggccttcacactcaacagtcaggctgccatcggcgaagctgtgcgtgacaacgccagccgcctgcactggaggtaaaatggcttttgccagcgtatgattgacactattcattgcttgatctcctcaactgcggctctggcgctgtgcgctccatgcttcagctgccagtaattcttcatcaaattcaataatgccctgacgaccagagaattgcgcattctcctggcgcgcccgatgcatgcgcgttcgggaaaaggtagcaccgcgtaaatctgccttgcatatatctgcgccggtaaaatcgctgtacgtcaaatcgcaacgaatgaataacgcctgagaggcctttacctgctgcaggatgctttggaaaaaacggctgcccgtaaaatctgtatgctccatgattgcaccgacaaaaatagcctgatcgaaaaggctccctttgcactgtgctccagtgaggtctgcttccatgaacagtgcctggctggcgttcacctgattaagctgagcgcctttaagcgaagcgcctttaaaattacattgtgaaagttgagcaccattgaactgtgcttcatcaagcgcgcagtccatgaactggcagccaataaaacgttgctgtgcataattcttttcacgttgatcgcacttaaaaaataccgtgcgttcaaatgcacctgcgctcatgacggtctgacgtaaatcaataccgtaaaaagtcgtgagcaaacttttacagccattgaagcggcactcattcagcggtgattcaaaaaacagactgcggtcaagctccacctgggtgaaatcgctgtggttaagcggacatttcataaactgcgtggtaaacaaacgactgtgcgtaaaatcgctacccgtgagttcacactcgttaaacatagtttcgttaagacgcgtttctctgacagtcaatccagacatttcgcactggttaaacactgtccgatcaagcttcgcattacccaggtcggattgagacagctggcattcggtgaaaacggcttcctgaagattggcacccgtaaagttggatcgggtcagtgaaacattttggaatataccacctgaaagatcgcatccgcgtaaatccagttcatccagtttcacatcactgatcagatggccttgtttgattcgctgctgtaaatcagtggcgctaagcgtggtcatacaatttctccatcacgcttcggtaacgttttaattcgtttggtccaggcgccatcgatctgagtggtgttgctggtaaatgcctgtgaaagatcggcacgaaacagattagcgcctgggaaacgagcaccacccaactgacttttttgcagtatcgcccccatcagattggcatcagtgaagtttgcttcccgaaaatcggtgcgcacaaacaggctatctgccaggttcgcacgctggaaattcgcacactggcagacagcctcactcaggtcactgttctccagtttcgccagggtaaaatctgcaccattgagtggagtctggcgcagattactttgtcgcagcgtggcgtgggtaaaatctgcgccattgagggaactcccggaagcgaccgcgcaggtcaaccaggttgatccgctgaaactggccccatctgcctgggtttcaacccatgagcagctatctaattcagcgcggttaaatatggcttgtgcaagcgtggattttaaaaacgtcgttttgctgagcttcgcctctgtaaagtcgaggcctggaaggctgagttccataaacacgcaagacgccataatagcgcgctgaaaatggcattgggtaaaccaggtttcccggaacaacaattcactgaaagtcgcttcattaaacgtacactcatcgaaaagcgtttcttgcaactgcgtatctttaaagtgtgcgccggaaaaatcactttgacagcactgtgccagggcaaaactcgcgttttcaaaattacaaccgcgcagggaagcatgatgcagttcggtgcgcgccagcatcgcactctgaaaattggcaccgtccagttggcagtgacttaaatcggcgcattccagcagcgtcttactaaagtcggctccccgaagatccataccagaaaagtcagcgccggtaagatccataccgctaaagttgccgccctgtgccagcgttcgttccgcgcgttgacgaattatcagtgccagatcgcctttcagacgcagcgctggtggctggcttttaacagacatgagatacatttgatggagagcatcacgcatctgtgccagtgtcttctcactcaggctatccttgttgcgctgcagcatttcttgcatacggaacagtgtttccggaccgcgtggctgatgctcgtcactttcgctttgcggataacgggcctctatctcgcgcttacgttgctctgcccgcgctttcatctcgtcggcctggcggttcatcttttcgataaattccggcaagtcttccagtttgggtagcccgggttcatcgggttcgttaagcaagtcacccacatccccgccggatgcctcaatacgcgcacgatgctgctctcggagatgttttgctcgcgtttgcatgttatcccgcatcggactgggggtttgctcgacctgattatcaatccagggcccaatggtttcatcagggataagatctttttcgcgaaatgaaaacagcgcgccgttttctttatccaagcgttgcgtgagcaccttacgatagtgattaactgagcgtggtgctccccgtttttccaacgcgggcatcaactgtaagacatcagccgcgtcatcttcattgatgcgcgtgttcccttgccataacagaaccatttgctccagatgaggaaagaaccataccgtggttgcgcgcagtgcaatttcctcaaacagtgtttcatcttcgcgctgacgattaataaagcagcgtgcctgccagagaggaagtttgccctcctgcatcggcttttgcggatgcatattccagattcgccaggcggcttgctcaggtaaggtatcgcgatctgcccaccattgatcaggactggcagcattaaagactttccagtcgatatcgcgcgcaaaaccgggaaaatcattttgtaaccagctggaatcgtatttttttcccatacgactaaaacgtcgtggccagctaatatccagcgggccaaaccccgcaggctctggcttttgtttaggctgcgtaagacgtccgctcatcgcttcgatgttaggtaagcggacgaactcatggccctgatgcacctcggggtgaatgccaattccataaggattgtcatcatggccttcaccgccaaaagcgcgactccagtcaagccgcatctgttcaaagggctgcggcgctgtgatgttatttccaacccagtagcgatcgccaaataccgccagcgacttgcttagcgtatcgacttcaatctttgccgcgcaggcggttttatcgctttgatgatgcgtgtaggcatggccggtcgccagaaattcggcgcacacttttggcatggctaaatcgagaacgccgccgctggtctgtaactcgctggcagccagttgccaaagctccatttccgggcggagcttcgggttatcactcatatcggctaacgccagcacggtgacgccaagatggtttttaccctgccagcgaaaaggacgattaagtacgctcaggcggagaggtttaataattttcatgcctgggtttcctttgtgtatagcatttaaaacagagacaaggcgtctcccagtctgggagacagtcaaataaatacgatgagagggcagtcaaaaaaaagacaactaaatacttctttttctctgttggaccgacgatatacagtttgacaatgtcaggctgcttttagtcataaatcatgctaatttcattaccgactttgtacagcgattcatcttccgcccaataacgctttttcccttactgttgtgtacctaaactggaagggtttaaaaacgcaccttaagataaatattcttaacacgcgctagaggaatcggttttttgccctccgaacatcatgaagaacacgctcgcctgtaataaaataaaaagcaaataaaatttgaaagcacttcatattaaatcaatttaccaccaacaagaaattataacttacttataaaacaccctgcctttttaacccttaaaacattagattaaagaaataagcatgaattcaaattgacttgacagcgtgtttattatgcattcaccgacaattgaaagatcaaagccataaataaaataccaaaagaaccaatgtgctaatataccagcaactggcattatatcattccatagttcacgaccactattaatggcatagcattgaaacagagacagaaacccaccatctcctttcgagagactttttatctgtgcagctatcggacaggggttatctctccaaaatgagaggcttatcatacagagcaatacacttgggatttttagcatcatattttattgttgtacaccgccctgctttatacctttcaacttcttcaaacgttaactctcgtaaaacactggcctcaatctctttactgtccaaagttacatatttaaagctaattttatatacaggtttaccaccactccaaaccgtagtttgctgtgcagcaataatatctgcatttaccaaaattcccgtcttaataatatgagcctgaacaaaaccgctttttataagcggccaaaactcaatggaaaaaactttagccatacgaaaaaaacaatgacagctacggctgcagcaaaaattaaccatcccttatctaatgtactcataacaacctctaaagcatatatttaccttcgagcacagctaatcatcttacgaaggatattcttttatgcccttagaatcacagggaaactataaatattcaagattgaccacggccattttaggcggttcatcgcgactgtattttacagaaattttaaccccctctcttattttatgtatttgactgaagtttaagacacacatggcatcatatctttttttgacaccattgatggtagcaataaaataaaaagtataaaaaaaatcatcaccgtatcggacatcattttgataccaactttctgcatttacggtgataacctctcctgaccaattatcacgactaatccagtttttgatgcctttcaattgtgatttatcaggctttaacatagacagtgcaagcccagttacacaaacagtaatgatcacaccaattaaaaaaggcacttcggttaaaaaagtcatattcataatctacttggttcaaccactataacattaaccgggatagaaatttgttatctacgagaagcaattaacaccaatacaattcttacgacaaaaataaggcaaccatgcataaaaagcagttgccgattgcttttcatgcacgttcaggtaaagcttcaaagaaaactataaggataaaagcccaacttgattagttgatctttattggcttcccacttccatctttaacaaagatgatggaatttgtttttgaatcgagcttaccatcatacatatcgccaacttgatatttatcaagcgcaataagcaatactgtttcttcgtgtttttcgactaaccaactttttccatgcgagtctgttactctcaaactcatttccaccactggattgttattaagaaaaagaccgttctgcttcatcgacagtatagttatctgcacatcactgccattctcaataatagtttgttcgcgctgctgtgagcctcgcactatcttattcgcaaaataataacatgcaaaaataaccagaatagttaaaacaatattcacaatacctgatatcgacataaatcctctttacataatcatgtggagagcaaacaatgctgtcctcaggcttccactgtcaacacgagcggcttcaactctttgagcattaatgatggtccgaccgaaagcaaacccttgatgtgatatattcacacctgtcatgccatagttgacacctttgaaagccacacttcctaccgaaaatgaaacatatttactaataaaatccattgcatcttgtgcaaagctatttttttggacatcgtttctttcaaaaacaggtgaatcaataaaaactttagtactactttttatagtaatatcttgcggcgattcaattttcacacctgcggttgcactctgatgccataagccatttacgttaacattaagccctccatttgtaatggtcagtgtatcaccgttatctatagtggccgctctgctaccgttaatgtgttcttcatcgttgccacttatttttctggaaaaatggccgtcgagttttaaaaacttatcacctgttacttcactgtggctcccaccattggaaatgatggttttgcgaccattttttactttaacactttcaccgttattaaaattttttgactcgagctggtcaactgttatcgtccgcttctgtttataatgaaaattcgcatcacctgttacttcgtcactctgctctttgccaatagtggtagtccgggatccatcaatggcaacggtcttatcattctctaccgaaatattcatgtctttctcagcatgcatattcagcagttcaccgcccggcttatcttcaaagaacagataactggcattggcctgatgtccgtctttactccgtgtcataaagcccattcgtgttgcatcgccgggcaattcccatggcggcatgctggcttcgttataaacacgtccagtaataattggccgatccggatcgccgttaataaagtccacgacgacctcatcgcccacacgtgggatctgcaccccgccgaagccctggcccgcccaggcgcttgacacccgcacccagcacgaactcgtgtcgtcccctttcgccagacggtcccagtggaacttcaccttcacccggccgtatttgtccgtccagatgctctcgcctttcggtcccaccaccttcgccgtctgcgggccgtgcgtcttcggccacggcgtgtccggcttcgcacggtacgtcaccgccgccggcagcaccgtgaagtcaatgttgtgccgcgtggtgcccacgtcgccgctggcgtagctgttctcttcaaagtcgtagtgcgccgacgtcaccaggtatttgccgttgtcgctgaagtgcggcgcgttcagcagcgaaaaagtgtaccccggcgcgatgcccgtcgccgtgccgctcccgctcaccatgtggtgctccacctgccacacctcctggcggatgcgcgcgtagtattcgccgtgaccgtgctccacgaagcgacccggccagtcgtacacgtccaccgaacccggggtcggcgacaccgggttctgccgcgcctgcagcatccacgcgttcggcttgcggaagtcgtagtcgtccgtgctgtacatccccggcgtcacgctttccgacagcgcccactggctcacgccctcttccgtcacgctgccgcccgacggcgtcacgtggtaggctatcgtttcgtagcccgggaacgcctgatgctggtccggcgcgtcgcacagcaccagcgtgtgcttgtccgcctcgtgacggaagaagtagtacatcccctccagctccatcagccggctgataaagtcgaagctgctctcctgatactgcacgcagtattcccacacccggtagcttcccgccagccgcgtctccacgtttaccccgtactccttcagcagcgtctgcacaatctgcggcaccgtctggctctggaagatgcgcaggttgcggtcgcgcttcatcggccacagatccgactccaccgtcagcccgtacaccgcataacgcacgccgcccagctcctcgctgcgcacgcctatccgggtgattttgccgttgatgtagcgcgggttcaccgcgctcatcaggccgtccgtcggcagcgtgaacgtgaccggcttgcccagcagcgacttgcgatcaatgcgcgcgtcggtggagagcagttccgtctccagcacaaacgactgggacagcgcttcgctgccgctcagacggcggaacagcagcccttccgcgggaagttgtacagttatacgtgaggacatagacatacctgttaactatggggatcaagtaaccaaacgccttcctgattaatggtcaacgtttgttcgcgttcgccacgctggcctgtcacagaaaaggtgtaattgccgggtgccagctgtagtgccgcaaaaccgttggctgccggaacaacggcctgcggtttaccattcacctcaacacgctcgccaggctggagcttaatataaacctgcgccacgggttcaggcggtggcgcaaccggttcctgcggtttttccggttcggcctgtgcggtctgggtttgcgctggcgttgcagccggttgttcgaccggaggctgagaggccacctgcgttgctggggcggtctctgtctgagcaacggtcgcaggctcagcagcctctttatcgccactcgccatcatcagaccgacgcaaacccccaccagcacgcccgccgcgaccaggccaggcagtgcaaagcggttacgcatcagttttttcagcggcgttgcaggtccagccgctgtctcatcctcttgctcttcctgaaccggtaccagcatggtgcccggcccgctgtacttaacttcaggcagcggttcaggtgctttttctggcaggaccattgaggccgcgaaagcatcaatgctctgcggacgatcttccggttttagcgccagcgcgcgatcaactgcggccagcaaggtctggctgtaaccggccggcgcgcgttgcaccagaggttgatagttatcttcaatactgcgcaccacactgaccggcggcggtgcgccagtgattaatgtgtgcagtacagcgcccagggcgtaaatatcggtccacgcgccctgctcgctttcatcgttatcgctgtattgttctatgggcgcataacccggacgcagcatggtttcactttcatcagaaagattaccgatggttttacgtgccgaaccaaagtccagtaataccggctcaccgttgctctggatttgaatattatccagcgagatatcacgatgcagatagcccgcatcatggatcgtcttgatggcacccaacagcggtggcagcaggcgacgaatccagttttcatcaatcagatgaggatttcgttcacgcatgttagacagcgtcgtgccactgtagaacaccgtgcccatataggccgtgtcgttttgcacccaaaagcgcagaacgtgtagcaggttgggatgattaaaacgggccagcagacgcgcttcctgaataaagctgttcaggcccgcatggaaggttttactgaagcgttcacttcgcaataccaggttcaggtcatcgctgcgcacggccagcgacgcaggcataaactctttaatggcgatatcgcgctccagctggtggtcccaggcacgatagacaatgccgaaaccgccgccaccgatgacatcttttatttcaaattcattgaaccggtaaccaatcggaagtgcattgggtacattctggtgattatcattttccgacatattcgaaagctctctgataacaaacggctttagacagcaaactggcaaacaaactcgccctgatcacagctgacccgcacgcgacgataacgttcatcacgggcatgggcgctgagcagtatctggctcatctgcggcaacagggtatttgtcaggatggcatcgaccatgcgaccgccagactcgacttccgtacaacgctgcacgatctggctgaccaccgaatcgtcaataatggcttcaataccgtggttctcttccagacgacggacaatgcgccctagttgcagcttaacaatctctgccagcatctcatcgcttaatggatagtaaggcaccaccagcaaacggcctaacagtgcaggcgggaacacctcaagtaagggtttacgcagggcggtgctgagcgcatcaggatcgggcatcagttccgggtcggcacagagcgcactgatcagttgcgttcctacgttagaggtaaggatgataatggtattgcggaaatcgatatggcggccttcaccgtcttccatccagcccttatcgaacacctggaagaacagctcatgcacgtctggatgcgctttctcaatctcatccagcaacacgacgctgtaaggacgacgacgaacggcctccgtcagcaccccaccttcaccataaccgacataacccggaggtgcgcctttcagggttgaaacggtgtgcgcttcctggaactcgctcatattgatggtgatgatgttttgctcaccaccgtagagtgactcggccagcgccagcgcggtctcggttttccccacgcccgacggaccacagagcataaagacaccgacaggtttattgggattgtccaggcgggcgcgcgaggtacgtacgcgtttggcaatcagatccaggccatgccgctgaccgataacgcgctggttcagcgtgtccgccaggttaagcacggcgtcaatttcatttttcaccatacggcccagcgggataccggtccagtcagagaccacagcagcaaccacgctggcgtccacggcggcgaacagtaacggggcttcaccctgcaccgcgtgcagtttctgtcgggtctcgtcgagctgctcacgcagggaggtttccccttccgtgacgcaacgtgcgcgcagggcaatcagctgttcgactaattcacgctcctgctgccagcgcgcgtccagcgcatcgcgctccgcttccagtgcagtgcgctgcgcggcaatactggcctgacgcgtttcatcacccagccccactttggtttcgcgttcggcgatttccgcttcgatttccagcgcagccagacggtgcaggcaatcttccagcgcggcaggctgtgccccctggctgacggcaacgcgcgcacaggcggtatccagtaacgctacggctttatccggtagctggcgagcgggaatataacggtgagacagcttcacggcggcgctcaccgcctcatccagcaacagtatcttatggtgtttttccagcgcgctgacggtgctgcgcagcatcaggatcgctttcgcttcatccggctcctgcacctgcacggtctgaaaacgtcgggtcagcgccggatctttttcgatgtatttcttgtattctgcccaggtcgtcgcgccgatggtgcgcaactggccccgtgccagcgccggttttaacaggttggcggcatcgcctgtgccctgctgaccacctgccccgaccaacgtgtgaatttcatcgataaacaacacaatcggcgtcgggctggactgcacttcattaatcagggcctgtaaacgcgcttcgaactcgcctttcattccggcaccggcctgcaacataccaatatccagcagccacaactgtacgtcgcgcagcggtgcagggacatcgccggcggcaatgcgcagcgccaggccttccaccaccgccgttttaccaacaccggcttcgccagtcagtaaggggttgttctggcgacggcgcatcaggatatccaccatctggcggatctcttcatcgcggcccgcgaccggatcgatttttccgtcgcgcgcacgggcggtcaggtcttgcgcatactgcgctaaggtgctgtcgcctgccgcagggggcgcggcggcctcaccggctggctgcaccagcgcctgctgaacttccttgctgttagccagcaaggtatcaaactgctccagcaaggcatcggcattcacgcgtgaaaactgcgctgaaatgcccttcaggacgctggcaagcgtaaaggtttttaacattccaatcagcagatgaccgccacgaatgcgggtggcaccgtacttcagtgaggcataaacccaggcgcgctcaacggcgctatcgatgtgttctgcgagatcggatactgctccagcgccgcgcggcaggcggtccagtgcagcgacgatatcccgcgtcagcgcgttttcatccagtgaaaaatgcttaatcacctgctgaagatcgccatcctgctgctgcataagctgatgcagccagtgcaccaactcgacgtaggggttgccacgcagtttacaaaaggcggtcgcactctcaagcgaggtaaataacagcgtatccagtttgccgaatagcacggcacggctgatctctgacatatcggttctctttattgaaagaagcgggctaattatcggggaaagcggttgggctatgacggcatcgcctcaacctcaaaggcaaaatcttcacgatcaacgggctgcggttgctgtccaagccaactggtgtagcccagccgggccgtaccgccaagggtgattcccttaacggcttcggccgccagaatcaggctgagatcccactgcatctcaatgcccagatagtgacgtacccagtcacacacttcgcgcgagccctgtgcctggggtaaaaagcgttcatattgctcggcgctgagtggaccgatacgcagacgaaaacgatgttgcacatcacgcacagccacaccgagaaaggcagattcgccaaggcgcggcatatggcgtccggcagacagccgggcctgatcgcggctgtccagtgataaccactgcggcacgttctgttgcagcataaacggcacggcaaagtaatgacgcagaatgcgaaccagtccttccgcatcgtgaccatggcgactgagatggcctgacagcataagacgggcatgtaaactcagcgaactggcctgctgctgagcaggtaaaccaatgcccgccacgcaggccagataatcctggaagcggcgatcgtcgcggcgatccagagaactggtgggctgtgaattcgcccaggcccggtaaaacagtagcgtggcacgatggtgaaacagatcggcgaaggcgctcaggctgtgatcctgatggtgatcgatgcgtccgcgtacatattccgtcaggtgcgtgggcaaagggccgttagggccaaacaacccaaagctgtaaatggagacgtcgtagcgttcgtcctgctcacgggctttaacctgtgacacggtcgacggtgcaaaggccagggatggcttttgtccaatacgcacggcttcaaatttgggcagtggcgctttacctaaggcataacgctgcccactctgagcatccagcttgcgtaacagctgaaacaggtcatagcgccagggcgcggccatgaccgcctgccaaaagccatcaggcaggcgaacggcccgctgtaaaggaataacgtgcgccgtctcactcatagcagggcctttttacccatgcgcggtggccagtagcccacttcgccgcgctgttggctgctcagggtgaattcggtaaagctgtttagcgcgacaaggcgagaaaagacccgctccagcacgctgccaaacagccacgggctggcacctgaaaatgcctgttcatcgacttcaagcgcaatactgacgccgcgcgcaaacaccaccggccccggttcaggcacccggcggtgaacggctttgaggttgcagtgacgtataccgtcaatctgccgggttaacggcgtttccgccaggctggcatataaactcagcatctggcgcagtgcagccgcgccttcgccatcactgctgtccatcaggctcagatagttcatctgcaggtggctaaccagtcgccatgctgacagcccttcggccagcgccggtcgcggcggcgtcgggcctttgcacaacttaagctgcccgaccgggatggagtccggcataacaaagttgccctgctcctgctgcaacagcatcaacggcagatcacggctggtacacatgacttcagccgacaaatagcggatgtcactgttccatggcgtatggttttgatcgaccaacgagagaaacacttcagaaccgatatagcctgtgcgagtgccataacgcatggcgtgctcagataatgtgcgctgctcacgacgcagtgagaagtaagcgccataatctccgccatcatggctgaacgtgctccagaatggccggaagatctgctcctcgcgctgcccttccactgaggcaaataagcgcttcaccgaatgtatctcgtagtccagcggacgaatgttatcgaccaccagatggtattcatgctggctgtcactgaccttaagccgctcggccgttttggggaacaggttaatgaccggtgtgcaatgcagggcaaggtgcgcgctgtctaccacgctttccagtgccgcatcggctttatccagcaagatgacgatatcgaaagactgtgtggtgtcgcagcggcgcaggaaaggcgccagctggcgcagactgacaaactggaaacgagccggaaaggcgaaatattcctgcaacaggcgataaccgtcgaaattgcgcagatcgtctggtaacaatgcctgttcgggtgcgaagccttcctgttgcagggcatcatcgggcaaaaactgacgttgcggttttgcttccacggactgcaggatgatgccaacacggtgctgcatcagcagctccatcagtttcagcgcctgaatatcgggtccgctcaggaagaacatgatgtcatccaggctcatctggctcagcgaggaaatgccttcgcaggtgatgcggatacggagtgcgctggaagctgctgtcgatccgaccgctttcagttcgcctaaagggatgtctgccggcacgccgcctaacgacacatcgctgatacgcaggggctggagcatgacatcgtgtgcggtggtgtagctacaggtaaccccggtttttttcaggttctggctttccatcatcgtgccgcgcggcactaagaaaccgttgctgatatcacctttacggctgtccggtgtgagctgtgctatcgccattgagggtgtcggtgaaagatagcccggtgccaccatttccagcatccgctgggaaaaccgtggaaactcggcatccatctttaactgtacgcgcgacgtcagaaaggcgaagccttccatcagcctttcgacataaggatcggcaacgtcaataccgcgcatgccaagccgcccggcgaccttgggatactgggcagcaaactccgcgcccatctcgcgcagataggccagttcacggttgtagtaatcgagcagcttgctgtccatgattaacctgcatcctgtagttcaaaatggccgctctctaaatcaacctgagtgcggaacagaaactccagcgggtacggcacgcaccataaccggcctttaatctcaatcgataacacgttgtgcagactcagggaggtcaggtcgcttacacagcggacctgcaagccctggggtaaaatacgtggctcaaaatgcagaatggcatcggtcattttgcgttgcatatcctgccattcaatatccgaaatattttgtcccgccagcggtgccacgccaaagttcaggacagaacgctgtacctcagtcaaaccggtcagatcgtgctgcgcctcgttattaatggtgttgaataaccactggagatcgcgcagaacattacgccgcagcgtactgtgagtaataatggaactgttgccggactcgttggttttgtctggcgcgtcatccgtcagtcgatccagcaaggaggactgaagtttgtcgcgcgccgttagcgtgtcgcgatttttgcgcgcacgataaccgccatgcagctgcgaatagccgtctccggacgaattgtcattacgactcatgagctaactcagtttcgttgaaaataagctgttgcagtgtcagtacaggatagtcagcgtcatcactgagccacatcttttgcccgtgtccgataaactgaccgtcttcgctgtctgaagcctgccactcggtaacgctggcgcgcaggaaacgttcgtctgccttgtcctgtaaaggataacgtaccggaatctgacagatctgttcactgccatccaccagctgcagccgggtatgacgccagaccagatccgtgacgctcgccggtgcctgaaactccatttcactaatcgcagcgaacggaatccagtaataacgtccattagcgatggcttcacagaccggtccaaagcggctgtcaccgtccattatccaggcaaactggctttccccttcctgagtcgtggcggtgccggcactggcctctgcactttccagcgcctgagcacgcagtgccgtaccggcggccttgtcgcctgcaatgtctgctttcagcgcggccagtaagacttcgcaccacggccaggcgctgcccggcagttgcggctcagcgtcaccgcgcaaaaccgctgcacgtagctgttcgccctcgatggcctgttgcagcagggtcacggtcggctgtgcctgcggcagcatggccagccaggattttaactgcgtctgtgcccggctccagttaccggcaaggcatagcagctgtacaaaagccgcgcgtaaatcgacatccgcgggattggcctgaatttgcgcagtgatgctggagaggttttcagccagagaagcgctagccagtcgctgttgtaatgagtccattcaaactccttatgccttagttgatggtgcgatagacggctgcggccggatctttaagttccggatgcagtttttccaccaactgcactttgattgatgcagggctgcttaaccagggtgaccagattttacggacttcctgcagacgggcacgcaaggcgttttcgtccgcggcttcactggcgggcatctcaacgacaacctgatttaccgcctgccagccattgaactgttgattgaacggcaacaccaaccagctgtccggtgatttttcatcactgaggaccatgcgctcactgttgacggtggtgatggtcagctcatcaaccggctgtttattattcaggcccgacaccgggaaaccctgaagaaaactcacagaaaccgatttagacgcgtccttacccatttgcgttagcgtgctgtgtccgcttaaccagccatctttaccacaggttacgccctgcttagcgggaacaaagagcgcactggactgggcgggctgatgccaccaggtgcggaaatggcaaccatccagcaagctgaactgaagccatggcgtcgtatctgccgccggcgagttcagtaccaccggggcggcaggtgcggtctgggtgacgggctgctgctgcacggacggctgctgcgcagcctgaaccggttgcaccgcggctggcggcgtgaccacaggtttccactgctgcgcttttgccgccgtacccgcagacagcgcgccgccgtctgtatcggttaattgccagtgcaactgctgtaacggtttacattgtgacgccattaacccggcgacacggggcagaaaatcattcagcaccgacgcctctttgtcaccgtgcgtcacaatgcgcagattgaccgtgctcttacaccagctcgaaagctggttatcttttacatcatcaatccagacatccagtttctgagttggcgactgcacaatgcgatagttctctgcaaaggcatgtgtactcaacagcaatgcagtcaggcccactaatccatatttcatgttggcgttctcaatctcgaagagggaaaaactgcgccgcatcagacagcgagtgcaataaggtggtgtcttctggtgaacctacccacacagccatagcgctgaagttgtcctgctgaccaccctgcggttggctgtttttgataatttgttgcatcagggtcagccactcttctggcgtattcaccatatgcaatgactgctgcatttgttcgagcgtgacgccatgccagaaaccatccgtgcacagcaagaaagcatccccgtcttcaataggcaccacatcgctgtagctggcatcccgctgttcatcgcccatgcctaacgcaaaatagagcaggttactgttaatgccttccgtctggtgcccggcatctttcatttgctggatcaggctgtggtcggtggtgacgtgatagagatagccccgacgaaacaggtacaggcgactgtcacctgcatgcgcccagtaagccagttcatagtctctgtcgataaacaaactgaccagcgttgtccccatccggctgtgctgactgtttgctttttgctgttgccgaatcgcgccattggcataattcacgtaatcgcggatggtttgcgcatccagatgcgcattcccatcgaaggcttccatcaggctactgcgtgcaatttttgctgccacatcaccgcccggaaaccctgctacaccatcacacaccacaaagcaggctgaacgttcaccgatgctctcaccggtttgatcctgattgctggcgcgatcgccctgattcgacgtggaagcagtagagatattcatgcgtcatccgtgtgggtttgtgagtctttatactgatttacttccatgtcgtacgcgtgcaagaaggcttcgccaaacaaggtatggaagtcatcttcaatttcaccggcggtttcgccatagcgctggacaaaatgctcccacaacgcggctttacggctacccggcagaccaaggcgcgacacagaacccgcctggcgagcttcgtcttcaagttgatcgggattgaaggattgcagcatggaagcaatgatggcgcgaataccggcaatcatgcctaactgatgcgcctgcagatcgatcagcgcgtcacgcacagcctgacgtggtggcataaagccgggcatacggctaccaaacatctgcatcaggaccgtcttacccgacggcaggagcttgaacgggttgttggcatcatccaggatcacggtcatgtcggctttcacaccgcgctttaaaattgaccgtgaagaaagcagtgccaccgttccctgcgagaacatgctgagcatctggccgaactgccgcatctgctcacggtcgaactgcggcgtcggttgcaggtcctgtaaacccataccttccagtaacgcatccagcaactcaccttttaaggcatcgccactgctgctggtactgctctgctctgccccaccgctgttgttgtgagaggcaaccggatcgatacgcaaccgcccttttggcgtcggtgaaggcgtgcgctgcaccgcctgcggtgtgggtaaggtaatgccgccataatcaatcggactctgtgcaccttcaggctggacaggctccggttgaggatcgaaagcgggatcgtgagtgacctgcgtttccgtgtgatcaaacaatggcgaactgcttaaatcggccaactcaactggtgccgtatcaaggatatctggcatcggctggtgattttctttgtgctgtaatggcaccgcttgatggggctctttctgctgtaagggtgcagactgatggctctctttctgctgcaagggcgcagcctcaggtgaagaaagcaccacatcaggctgggccagcggcaccgcaccgctcatcattaatcccaggggatcgtcatgatggcgcgggtccggcgtggcctggctgccaaacagatttaacgggtccacgtcggtggacatttcctctatttttggctgcccttgcgcgttttgttttgccgacaaggtactgggtgtgcggtcatcaaaaatgctttcctgagcaaacagcgcatcttcttcatcaaacaggctgcttgttttaggttgctgaccgatatccaggggtttatcgctgatcaactgcgccagcggatcttcgggattacggttcgcagcggtagaagttaatggattcgcttcaggcatttctggcgcggggcttttacgcttcgataagtcgtcagaaatcgaaaactctttggcaaggctgtcccagatctcgcttggaatcgctgccgtactggcagcggccggggcggccgaagcctgaacaggggccgcattgggcacagcctgcggctttggcgctgccgctaacggtggctgttgcggttgctgctcgccattgagatcgtttaccagcaggcgatagtcatcaatgccgagaacgtccccatcctgcaactccacctggcgtccccgttcaagcgggatgtcattcagcagcacgcgcgtgacattgccacggttagtcaggcggcattcaccctcagcagtgatgtgcacgatagcctgcaggcgggaaatagtgcggtcgtcgtcaggcagtaccagattattatccacgcctcgaccaattgtgccgccgggaggaagaaaatcaaaacttgtatgcggcggttcatggccgggtttagcggttattatcgtaaagcgcatcacggattcctgcggttagctgttcgacatctatatcgcgcgtctctcggaaagaaaggcgggatatagaagcgtagtcaatggtacggaagataaacgcaaacctaatgttgcagatagccagcccgtgaaaattaatcgtagggcatttctgataattctttcgtgcgtaactcatcaagcctggtgacgcactggttattaaatacggtatgcgcattgctgcctttatctgcgggatgcgcatataactggcactgctcgtcacggtaggctaaccagtgacgctgggattgaataaacaggttctggtagttctttttagcttcaggttcactttgaaaaacatgttcgatgcgttttttcgtcgccccgtaggcctgatttaaatcgtcttctgcctgcgcccggttattctcggcacagctaaacacatcggcatcactggtctttttagcacagtcatcaagggcgtagacggcggaagaaaagccaaacatgataaaagtcacacatcccaaaaaagatatcttcattttttaatattgacctgttttacagatgtaaaagcgccttgtttaactgatgtctggctacggtgaggcactcgcatatcagacagtacagggtgtggcaaggcgcaactcagggcgttgtcctgtaaagggttcgcagttccttgatcgattttgctcctgaagcaccgattttcctcgtcagtggctcattgatcgtgatcgagtgattggtcaggtcgacagaaacgatgatggcttcctgtgctgtcgcattgggagacgcaacgtcatatatcaccgcgatgatgactttattatctttttcatcgagcatgccgacagcgcgagtcgcatgacatgtttccgcttcccagtcaccaaatccaattgttggtaaaacacgctctgcctgatgagcgttgtttgaccaggcgacaaaacacacgttcttatcttgtaagtcgaaacccttcccggcaataaaactgcccagaactttgccttcattaaccagatgaaaactttggtgtgcaactggagaaccgccctgaatgcctttatcagacgataatttataaatacttttctgatagggcgcatctgctgtaggagcaagggaaagcgcagccaatacgtgaaaaggagttaacagcgataaaaacatcagtacataacgcataatattttatgtatccattaacgtaatgaccacttgaatggtgaaaatatcatcgcaccactataacgtcatatcagcttgttaaaaaatcagtatggcagctgtttaagtacggccgtacgctcagtatccattcgataaatgcagagattcgttgtgacatcgtatggattactgccttcttctgcagcaaaagcttcaagatgacattgaccatccctgaatttaagccaattacgctgcgtatcaaccataatcccggcatactgctcacccagttttttttgagcgccgtacatttgtacaatgcgctctcttgcaagaccatattcgtgatttaattctttttcagcctggcttttatatttaacagaacattgatatagctcggcatcattacttgttttagaacacagcgtttctgcgaagcaggaaactgaaaaaacagcgattgaagccacaaaaaacgctgcgtaaattttcattactcactcgactccgaaagtttcagatctcatctcatcagcaaacgcattaaggtaaagaaagcgcgtttgcttatcttaaaagactcacttaagcacattttattgctttgccaactcaacgagttcatcaacacggtcttgcatttttttcttaaggcacgctggattaacaaaacacgcatttctttcgtcaagccagcgtttctgtgttttacgaagctcgactgaacgtgatttgacatcaacccctgtattcacaatttgctttaacgccacattgtaggcctcggccacgcttacatcccaggaagacagatcggaatcatgacagatggttttttcactgtcgcttgtagcccttgcgcaggcgaacgaaggttgcaatgtggcattatcagcgagtttttttagtaaaagataagactggttatcccagttcaggaatattgactcttcatcaagttttacaagccagtgttcactatgttcatctgaagggctgattgccccattctgacaatgaatgcgataaggacgaatgtctaacgttcctttgacgggaagagcatagcttttagccggatcggagagctgcccttctgtcgtcctgctcatcaaagcgtttattgatgtcacgtccatggaaacataatctggtaactcgcagcgactagctgttagtattgacgtttttattttatccggagtgaattcaaaaatacgtcctctcagcgtcgggtcatcagaaattagcgccatcaggtttgtagaagtggaatcttcgttaacataaacatgttcaactttccatttaccatcaagctttaaaacacgtccctgttcagcagaacacagtaacggcgtaaccagcgaagcgataacaagtaacaataaaccggttctctgcataatggacgcctgagagtgagatacagaaaagacatttatttttaaattcataattagctataaggtactttttttaacttgctgattctttctttatcttgatccgcaacacaggcgtttctgtatgccatgctcgcttcagagtttttgcccaccgccagtgaagccaattcacaatcgttgtcacgatatttaagctatgaccgctttgattcagtaaaaattcgcagataatcttctctgtctttaccagaaccactatatacatcattaattcttagtctggcggactggtattctttatttagagatatttcaaaaactttgacttcattattaatgacaggcgtaaaattcttgtgcattattgccatcagcataagcaactttttcagcaactgatgcagtaaaatgggtaagaaaaaatataaaaatcaaaaaaacttcctattttattcactaatcgagccaccaatgtttaataaagtcaaaaaaccatgcacaaatttaactattaattgctgagcagcgccctcatttcagcaatagtctttatttcggtgttttgaaatttctccgttaaagccgtgtcaaaagtaatattccgcgcagaggaattaacaccaataacataataatccgtgccataatcgttttcattacggacaccatcaccatcatgtacaggcaattcagttcggtaaatagttgcaattttcacatcattctcattctgctgtgaaatgatcccgactgactggacttcatgacagcctactgcctcccattcaccctgaccaattgtttccataaattggtcgatcactttgccatttttagaccaggcaatgaaacatacgggctgagtcgttttcctccaggcctttccctgaatgagcgttccaatttctttattcttactgtaaagatgaaatgtttgattatgattaatatcaaccctttctaaatcatgccgttcaatttgctcaatcacaaaacctttattatcgattgattttaaaggagaaagcgtcatgcccgcaaggctgaatggggcaaaaaacaccattaaaagtccgatcattgtttttttcatattgaaccaatcgattaaatatatctagttaagcacgtaaacgaagaaaaacataagcaaaccgaaaatggctgtcagcacgaatataactctataaaagaacaccagatcagctatccactttatcatatcgtttggttgtgactggataaattgataagcctcttgccttacatcttcaccctgcctgaatttcattttcacccctttttggaggcgatataaataagatagcttctgataatttgcgtaaaaacccaatttactcgaaaatttagtggtggcgtctaactgaaggttggcgctattgaaaccaagaattagcttagcgtatttttctttattttttttgaatattaaagatgcaacaatatgtaaaacacctataagaaagaacaaaaaaataaccatactcatggtgaagttatacaatgtcataatatcttatccatgatgatgtctacagctttgccgccagcttcaccaaaaccatatccccctgctgcaccaccaattatgccgcaagccaaggctccaactccacccgttgccacacccaatgcaacgcaagcacctgtagcaagtgaagcagataacgctccgccgtaaaaaccagcaagtgtgctccctgcaaacctggaatattcttttacagcaactttagtgcattcgtgctcgcgatcaactgtgcatcctttatatacatcattagtcgtatttagtgcactgaagccaatcgcaacccaaccgccatatttcatgaactttgctgccttagctgcagcatcaacataggttgagtatcctcggatggcaccgacacctgccgtttgccagtcatgtacgattgatgaacttgaaagatttaatgcatgttttagttgctcatatggccgcaatcgcagagccaatcttgaaaagcggttcaatagttcttctaactcattaaaaagacgacgcctctcaataaaaaattgctcacctatcagtgtccctgccgttaaatattgattacggtaagcattttcaatagcttttaacttattaccaatttcagaaaaatatttttcacctgcatcaccgattaaaccaagacctttatccataaaattggtgattgcggcaatcgaatcataatggcggtgaaaaaaattcgcatcttctacagacatggtagacaagctgttattggtttgcttttttgcaacattgagcgcatttattacggtcgggttattatttccgttaggatctgcaactataagcatctgcccaggttttgcccatacgacgtcggcgtttagttctaaaaaataattaattgctggaaaattacgattaccgaataagaacattgcctgttcagttaatctccccggacgttgcaccacgcaaaaacctggttcgacattactttttccagccatatcaactccatgaaaaatctactataaatagatattatagataatgttcaaattgcctgtaataacctgtttaaatgaagcggccctaaggccgctagacaataaattacgcttctttgttctctttgatgttccagccagcgctgctttctgcgcctttgccaccggaagaactctgctcccagtactgctgtttcactttcgcagcctggaatgcataggtaacgcccagcgtatcgtcgtgctcagaacccacgaactgtacgttggttaccagaacgtcttccagcgtaatgcgggtatactcgatttgagtaccgccagccttacagactgaaacttcaactttggtgacgtgcttaccgctggcacagtttttcaacagtgcagtgacagctttgtcgattttggcattaatgtgcaggtcgttgaagtttactttaccggcgccgccgccgccgcccacgctcatattacccggttgattagcgccccaggagaaagaggtaatatcaatccagccggtatggttagaatctttagattcaccagtaatgccgtctaccttcaaatacatatcaatagccataatatttactcttcgttatggaaaaagttgtcgctttcgaaaaagcatctatatggcaaagagaaaagcatggggctgaataaaacagtccatattttacttttgcctcgacttcgggtgttgctacaggcatcccgaaagatcccaccacaattaaccgcaatagcaggagatttttttgctgtatgggtatttcaaattaaggtctttgtgcaaaaggcaacgacacttatagagtgaaaccattatgttgtgcactctgtttcacccagattacgctgctgaaataagcctgaacaccgtcaaactggttgtaataattatttcatccgttgtgctcacaccgccgttatttataacgtaaaggcaggcggaacattatactgactaatccacgaagaaagcgcgacactcttcgcgacaaacgtcactttcggaaaaggtttattccgcttcgtcccaagcaatattgttaaaatttggggtaaaacgtaagccagccatttttactaaaggcctaccttcatgcagcagtactgtgcgttatgacaaaaagagcacaccccgcagggcgtgcctcatgttttaacgattagttttcattcgacttcagcgagggcagttttgataccagacgcagtgatacggtcaatccttccagctggtaatgcgggcgcaggaagaatttcgcagcgtaatagcctgggttatcttcctgttcttccacattcacctctgcagcagccagtggcttgcgtgatttggtttcctgagaagagttagccgggtcaccatcgacatagttcatcacccagtcgttcaaccagcgttccatttcgtcacgctcgcggaaagaaccaattttgtcacgcacaatacacttcaggtagtgagcgaaacggcagcaggcgaacagataaggcaggcgggcggccagacgggcgttggcggtggcatcagcatcatggtattccgctggcttttgcagcgactgcgcaccaataaaggccgcaaagtcggagtttttacggtgaactaatggcataaagccatttttcgccagctcggcttcacggcgatcgctgatggcgatttccgttggacacttcatgtccacaccgccgtcatcgcttgggaaggtatggcacggcagatcttccactgccccgcccgactctacgccacgaatcgatgtgcaccagccatactctttaaatgaacggttgatgttagccgccatcgcataggctgcgttggtccagctatagttgccgtgatcggaaccgtcggtctgctcttcaaaatcaaagctgtcaaccggattggtgcggataccgtaaggcagacgagacaggaaacgcggcatcaccaggcccagatagcgcgcatcttccgactcacgcaggctgcgccatgcagcatattcggtgttctggaagattttggtcagatcgcgtggattagccagttcctgccaggattccatctgcataacgcttggggccgtaccggtgataaacggacagtgggccgcagcaccgatacgtgccatctcgcccaacagctcgacatcctgcgggctgtgatcgaaatagtaatcgccaaccaggcagccaaagggttcaccaccaaactggccatattcctgctcgtagattttcttaaacagcgggctctgatcccagcccacgcctttataacgtttcagcgtgcggctcagttcctgcttagaaatactcataaagcgaatcttgagcatttcatcagtttcagtgttgttcaccaggtagctcagaccgcgccaggcgctttccagcttctgaaagtcatcgtggtgaataatctggtttacctgctgagacagcttttcgtcaatttcagcgatcagcgcctgaatcgtgcggtaggcatcgctggacatcgtaacggtgttttccagcgcctgctgtgccagcgtttttaccgcgctttctaccgcttcacgcgcctgatcgcttttaggacggaattctttgttcagtaacgcactgaattcatcctggctaaagctggcgccgccctgcgattgcggttgttgagaagtctggttcattactgctcctccttaccttcaggggcatcgggctgcttaggcacgtgtgacagcgcctgcatcagtgatgggtcctgtaaaatcttaccgataagctcttcagccccgtttttgccgtccatataggtcagcagattcgagagctgggtgcgtgcttccagcagactgttcaacgggtctactttgcgggcaatggcatctggagaaaaatcgtccatgctttcaaaggtcagatcgatgttgagtttgccgtcgccgttcagcgtgttgtctacctggaatgcggcgcgtggcttcatggctttcatacgctcatcgaaattgtcgatgtcgatttccatgaatttacgatcgtcaacgctggcctgcggctccagcggtttaccggctaaatcggccaggacacccatgatgaatggcaactgaattttgcgttcggcaccataaacttccacgtcatattcaatctgaacgcggggcgcgcgattgcgggcgataaatttctgcccactggacttcattgttggcatggttctctccataaataatgcgcgggtataggctcgcaggaggcgcgcaggtctcgctgcgtaaaggcttgactgttagcttagtcgcggcgtccaaaaatgttctctaactgatgtacaccatcgggcgcgagatcgcgaatgatgtccaaaaaatccagttcgatcaggcgttgtaccctgtctatcatcagcggcgccggatgactcggctcatgctggctaaagtactgtttgactttttccagcataagttgggcttctgcccgagaattcagttgagcactgcgccagtcagtcgcggcacgcggggcggcaggactggcctgacgctcggtttccggtgctgactgcaccgcagccgccagtgaatgtaatgattcgatatccgtggcctggcagcgctcattcagcatcgcaatgctgcgctgcagctgactcatatccggtaaggccgtttcatccagtttttccaccacaatgcgccgaatattctgcaaacgctcggcaatgttctggatggccgcaatgcccggttgttcgccgcgcgccagttcgtcattgagacgtggcagcccacctgggtagtcggccacctctgttttgctgccgtcacacagggctgaggcatcacgcagtgtaataccgtcggacgcatagcgcatgagccatgactgacgcaccgcgccggtcagtgccgactgatcgcccagcaccgcgagcgcattgatgcgataaaaaggatcatgctcgccatcttcttcgaggcggggccagagcggctcccagtactgcagcatggcctgctcaatcaattgcagaccctgggcataacctggcagtcctttgaggcgcgtccaggcatgtgtcagcgtcagcatgacgcgtaaatctttgctgcgggtcagtagctccagcgccagcttttccactttattccagtcggcgggttcagccgggataatagtgttaccgaactgctgttcgcctttccccacactggcctgttccatcgcctgaaaatccgcatcgtactccaggttttcaccgcacggattatcgtggcttaccggtatcagcaaggtgtcaatatcaatactcatccgcttcgcctcaggattcaaacattggaggataaagtccatttcgtcccggctttgcaccgcccgccggatcaaacaacagtgaaaataactgcgccgttaagtttccactgtggacatgggtataaagcgggaagccatcgctctgattcgtccaccagaaactggtctggaactggggatcaaagctttgtgacggcaaatgccagctcagtgttgaatcttgttctccgctgccgataaccgccagaatatccgatgactcctcgtcctgctgaggctgaggcagtggaatactcaacagcgcctggtcgaactgctcgggtgttccgccatcctgcaccgcgcgcaacaaggtattccccatctggtgataccagtcgcccgtgcgtgccagtaatgaaggcatccattcggtcggcgtaaaataacgtaaggcgcagaggggataatggcgtcccacgctgtcacgtgcggccgtcagacaacccatttggatcagttgtgtgccgagcatgggcggcaccacaaagttccacaccggcgctttaagaaaagcccgtgagggggcattttcgccttcagcactggtttgccagtgatgtaatcccacctgaaaccagttagaccactggcgctgcaaggtatcgggaaagcgtcgtttcacaaaatcacccgaactgggcagtttaccgtaccagccaggtgctgcgtaatgggtcatagtcagatcctgtttcagggacagctaaatgcgggtagctggaaaggattacgaatgctgccaggcgtgaatgacagcgtcacattatgaccatccacactgaagctggcttcgcgagtcagcccacctaccgacgttacccgcgcgcggtcaaagaagcgattaagcgcccatgggccgctggtggtcagggtcgaggtggtgccattcgtcagacccagttgcatacgtacctgacttgtcccgcccggaccgggccagctcactaactgcacagcctgtggtccatgactatagcgtaaaatctgtccatccacgtccaatgtcatattcaggatatcgttatccatcttcacggtacgcaatgtcacgcggaaggatggcgtggtagcgccattggcaaagaaggcatcacgaatcgactgagcctgctggaaaggacgcaataaggcttcgccgccgggtaacgttttaccgtcaatgccgggcgtgaaacgccatgcggcacgcgtggtatccactttgctggccagattgtcacggaaaaaactgtccatcagtccggtgcccggtgcaaacatgcgcgccaggtcatccggtgtgacttcgcttcgtccattacgcaccaacgggtaacgacctgcgatagcctgacggcagaaactgcccacctccatggtgatgcgtttccggacattatccatatcgcgacgttgtgcatcgctgctggcgccgacagccataccggacaccatattttgcagcgagccaggcaagcgtccggcgctggcctgcagacggcttatcgcatcaccagacggcggtggcataccgctgttggcggcatcctgcacggcagtcaggtagcgataaagatcgtcaatctgcttcaggaaatcatcgacggccagcactttgctgccttgctgcaagggctgtgcgagttcaataatcggcgcaaaatgcgcggtgaccgcttgctcaggcgtttgctgcacggctgcctgttcaccgttggtacgtggcgaagtaaacagcgcctgtagcgttcgggtcgcactgttatctgaagatgcagacgggtcttttgcgttcttgtcttcaggctgtgcgcgggtcagcgtgagctgtttgctcaggttaatcaccaactggcgcaacggtgaatgattgcctgacagcaggcgtgccgtattaatacgctgcgtcagatcggcattactgttgagctgaatgtcgctgagaaactgctcccactgacggatgtagtcctgaatatacagctggcgcaccgcaaggtcggtttgtttgctgtcttcatgggctgtctcggcacccagcacccaggtatcatccttgtagagcgcatccgtcaccggcgcgatctgtttatcaacatggttccagtaaccgtctggcgtaaagagcccggacacaccgtcgttgactgacttaccgcttttacgtgaaaacaccagttcactttgtggcccgcccagggctgacagggtaaccggtgacagtgagccatcgcgttccagcaggcgtttcaggcgtccgtaaacgcgctgtgacagcggcatctgactaatcagcgcctgctcgcgctttaccagcgcatcatccttcgcatacggcgaggactgaatctgcgtctccaggagctgctgcagatgccacgccagttgcttcacttccgcctgggtcacgtcctgcggcaattcgcgagaaatgtttaacatcatccatgcctggagaaatttaccgtcgtagtgttttggctggtacagcatctgataagccttgagcgcttcatagctgtagtcggcatcacttccggtgtcattgcgcagccagcgggtaatgttctgtgcaacctgtggcatcagcaactgcttcagcgcccggtcatacaaggcctgggtggcatcactgacttccgttccgcggtacaggcccatccggcgcgtaagcggtggatgatccagagaaaaggattcactttcaggaaggtgcagcagcgtgttgagataaggcaccaatgcaaacaggttaccattcacctctttttgcagcttgtcgcccagttgctcaacctgtgggcttttcgcggccatctcctgcaggtaggttttgtttttgttataactcaccagccacagtgcacccgcaatcagtacaatgaccagtaacgcaacatagccagaccacaagcccacccggttacgtaattcccaccagcggttgctgccggccaggccagactcctggaagatgacattttccagcacgcccttaaggaaaaagctctggcctttgttttgcggaatcggtgcgtctttatcgaccttgtcccaactgcctgattccccttgctgctggcccggcagatgcagcgcgcgggtcagttcacccatcacgcggtcaaagggtaatccttcctgcgtaccgctggcgaagtagataccgcgcggcgcaaactgggtttcaaaatcggaacgtgcaaacaggatatccaacgcttcggccaactgtgggcgcagcgcggcaaattcctgtggaaacaggtagctttcggcacgagcctgagcatcactttccgccaacaggacatcagcaagtcccgcatccagtcgctgttgcagcagcgaatattcctgctgaaactggctgctgagttcaaagtctgccgttgatgcttttgcccaagggaaagtaaagccccaaatctgctcgcgctgtgccttgtccagactggaaaaatagctgcggaagccttttaacaggtcggttttggtaaccagaacgtacaccgggaaacggataccgagttggtcatgcaactccatcagtcgctggcgcaacgccaccgcctgattacgcatggcctcaggtgactgggataacagatccgccacactcaaggtcacgatgacgccgttaaccggctggcgtccacggtatttacgcaggagttcaaggaactgatgccattcaccggcatcccgctcctgctggctttcctgagtggtataacgtcctgctgtatcaagcaacacggcttcgttagtaaaccaccagtcgcagttacgcgtaccgccaatcccgcgcagtgcggccttaccaaacttatccgccagtgggaactgcaacccggagttcaccagggccgtcgttttaccggcacccggtgcgccgataatcatgtaccacggcagttgatagagatattgatgactgaagcgctgtgcccagaaaggtgcacctttactgctctgacgctgaaagtgtgcttttttaagcatctctgtggcttcagagaagcgagtcgccagcacctgatcttcactggtcagacgcttgcggtcttcttccggcgcatccgacttattactctccaagctggacatcagtttccggttcagccagtagttgtaaacgcgcggaattgcctgactgaggccccagacgacatagagcagcgcaatgctgatcatgcggttctgttcagactccagcgggcgagaatccacaattgagaacaccgggccgataacccagataataaatgataacgcggtaataccgacaaaaccccaggccagacggctggtcagtaccgcaaatagtacgttcagcatggattagttccctctcgccaggccgttgagttcagcttgcgtcgtatcaggtgcgacctgcaatgtaatctcgacacgacgattacgtgcgcggttttctgcactgttattcggcaccaacggatgcgtttcgccacgcccttccgctttaacgcgtgatggtttagccaactgtttttgcaacacggtctgcacggactgggctcgcgccagtgacagctcatagttggacgcgaatcgtgcactgcgaatcggaacgttatcgctgtagcccaccaccagaattttcccactgacattattcatggcttcagcaatacgctggatgaccgcgtcataacgtccgcgaatctctgtcgagccggatgcgaacaggccatcccctttcagcgtcaccacgctttgatctgcctcgtcacgcacggcaaccaggccttcgtcgatttcaggcttgaggaaggacttcagattcagggacggcggcggcggcggtgccggattgcggatctgcacttctggcagcgtcgtctgataaatttttgccaggactggcgaggtgtaatcccccagacgccagttcagcacaatatagaacaggcaggcagccagaccagccagcgccgcgcaggcccacagcggaatcatcggtcgccacagtttgcgcaatactggctggtcagtcggatgcggcgataaggcagcggcaaagctgcccctgacgcttcgaatcatctgcaacagacgctgtttaatggtgtccagttgagaacggccattatctaaaacccgatagcgcccttcaaaaccaagcagtaagcagaaatagatcagctccagtaacaggatgtgctgacgcggattttgcgaaagcttcgccagcaactggaaaaacttttcaccgccccaggtttcattgtggaaggtcaccagcaagccattactggtccacacgccacggcttccccagggcgtcagtgctgcagcttcatcaagtgccgtacacaaacaataacgcgcgcctacgatcacctcataactcagaccggactgctggcaggccagctcgaaacggcggatctggtcgataagctgttgacgtagacgtgcgggatcgtcatgcgacacggagtgacgaatctgtggaatcgcgttaatcagcggattagcggctgccaccaaaatattctgatggctaagatcctgctgaaatgcatcactgttcggtttattttgttcctgcatcatgcctgctcagtttgaattattctgactgactgcgaatggcccagaactccatgttcaggcccggaaaatcaccggcaaggtgcagcgcgaaggcacccgatcgttccatctcctgccacagctcgctgttcttatccaactcaaaatagctgtaacctgcatgccatgggatctgcggcggcgcgcccggcatggctttcagggcaaggccaggcaactgcaactgcacgaggtcgcgaattttcgtgaccggagcgaccttcatttgcgccgggaaatgcgttttcagggcttccgctggcacactggctttcactgccagcacaaagccaaactcgcgcaccatgctgttatccggcacggttgcgacattcaggccgtgtgagcgttgggtcagcggtaactggatagcgctctcttccatgacctgtgacagcccctggcgcaacaacagcgtgaggcgcgagaaacagccctgcaggtcatcatggtcgtagaggggaaaagcatctggcgtgcgagcctccgtccacgttgccagctcagcagccagctgcagccagtggctgtagagggtttcgggatgcaatagcggcaggtgctgcagatgcgcatgcaggcctaactggcgattgagcagcgccagcagcataaaatccaccatatctgcgctgttaaaacggcctgtgccgggtgcacgttggcttaactgctggctacgctgctgaatcatgccgtgcaggtcggtcatcatgctctgtagcggacgactgccagcaagggtaagtgtggggggaatgtagtcattgtctaaacgaatgtggttgtcactgcgtttttcaacgatctgggcaacgcccatcgctgtccattctgcggtcagatcctgctccagcatcaaacgcaggcgcagcttgccaaactggacggtggccgtcccgacagcctgcgcattatcatcttcaacttccgcttcccaggccagatagcgcgccagcgaatccggtgaatcctgaaaggtcacggcttcacgtccgttacggcgagcaggaatcgccaggaccactttagcgcggtctatattgcccggcacatccagcggtgcgggcccgtgttgcggctggctgaaggaaaaaaaggtaccatctggcaagcatccgctggcggcactgagcgccagtttaccctgccgtaacagagcttcatcaaattcgagatcgaaaaatccccaaacgtaaggacgttgcgactggccccattcacgcagtgcgttttgcagaaagttttctgcctgctgaaaatggtggggacgtaaaaacatcccttccgcccaaacaaccttttcggctctgttcataatcatcctttgaagacggttttattgcttaacgggacgcatgccggcatcgtctacgataatgttggcgtttaactcaccatcattgctcttccagaactgccagaacgaactgctgtcgctgtcaggaaaaggcaacgccagccgccacactttgccatccagcttttgatattccgccatgatgccgatgaaacgtgcttcaggaagacttttggcactcagcgttttagtgagctgaccggacatcaggaaaaactgctggttgttaagcagcgtatttcccagcgcggcagcaggttgattctgtaaggtgaaaaagtcagcggacataaactccgcatccgacgtcagtaacatcacccggactttcaacggcgcgccaccattgatttgtggatgcgcctgaaaattcaggttgtagcgcgcgatatcaggcttactgctactgcatgccgtcagcaagagtagcaggaagggccagagccatattttcagaccagcgcgtaaataggtatgtgccatttctgtccctccctgcccctgacttagttgatgatccaggtaccgttatttttgttctggcacgcctgactgttgccatcgactgacacacaggtctttttcctggcagcggcacgcacacgacgctttggctggtcagctttaacggtttgatcgtacatatcgcttttcaccacggcacggaacggcacatagccaatgacttttacagcgctggttggggcctgagcagcggcacctttgttatcagctgcttttgcatcggcagctggcgcgggtgcggcttcggcctgcgcgtcttcacccaatgccagccagttattttcaacctggccgacaacggtatagctttcaccggtttttagggtttcaaccactttgccgctgaaatccgggcgcgtcatgacggacgccggatacaatgcgcgataggtttcattcaaggcagaaaactgagcgggtgcagcaatggcatgacgatgcatcaaggtggtgccatcaaccgtgctggtcaccattgtgtcatccgtcatttttggcggtgttttacagcctgcaacagcaaaaacgaacatcaggcttaatgcaattcgaaagttcaccattttcttcatatttagttccattaatacccaaaaagtggccattggccggtgttaagcaaaccatgtcgtcatacgaggtatgccggccgccatctggagccaacatcctgattaacaaaacaatttgcctgaataagataatttattgagtgtaaaatttatattcgatgagattgaacagtgtagaaactgctcataaaaacctgatgaccggaacaagacggctgaatgtaagattaaacattcagcaaactgacaaattcctaaacgcaaacgtcattaagacagcctggttaactattacgcgcaaacaattcatattgctgaatcgttaagttttgcaaggctgattaatcgttataagtgtggggagaatggcaacatcctgcttaacttccagtcgatctcacacaaatagcaataaatcaatggtttacaaattaaactgcagcaccatagctaccgcacgagcctgaacatcctgctcgcctgtgtaaagttcttttccttttattaacatcttacacagctttacataatgcctgcaaaatttcaacatagctcagacacatcctaatcagtaataaaactaatatttatggttaacgcaaacttcatactggcctgagaatattgccatcaaaatggctaaaaaccgcgaattcgggctgcctcccgctccgcttaagcctgtaaacattagcataacgaatgcttaatgaagaaattatgtctggaaagcaggataaggggcgcgccggggaagcgtttttaagtattaaatcgtaattaagtcaaattttacccatacgtaataaatcctaattcatttaatttatttaaattcaatgagttaaaaacaagaacttatattaatttaagaattatcttaataacctgatcaattaatagcgtctttctgcaactgttatggggaaattaaacggcatcgcgtcagttgttacagaccagccaggcccgcagggataacgcctgagggccgattttaaatgaaagtatggatgcgggaagtgacgtctgtacggacgaaaacaggaagccgcaagcgttacgctgaacgccaacacagaccagcgttagccagcgcggtgtacgcagaaatcacgactgctgggctttggcaatcatcttacggtaattgttcaaccacttaccgctgttgaatcgtctccagaaaaagagccctctcaccatccagtcgaggaacatgccaagccagacgccagtcacgcccatccccagttcaatgcccaacaggtagcccacaacaaccctggcacaccacatgctgaacatggagacatacattgtgtaacgggcatcacgcgcgcccttgagaccggcgggaagaacccacgaagcggcccatattggcatgaacaaggcattcagccagatgaggtgtttagtcacattgatgacgtcgggatcgctggtgtagaaacgggccagtaaacctgccagcggtacggtaagcgcagcaatacatgacagacagagcgtggccagccaaaagacatgctttgcctgccgttcagcctgaaacacctggtatttacccagccgccttccggtgatgatagttgacgctgaacccagagaattacccggcaggttaatcaatgaagccacagagaaggcgataaaattaccggcaatttcattggtgcccatgcctgcgacaaaaacctgagtcagcaatttaccgccgttaaacagcacggattcaatactggcaggcacgccaatgctcagtacttcatataagatgctgctgttccagcgacgaaaatagctggaaagcgtgattttaagcgaagcattaaatccaatcattagcacataaataatggcgaaagcgccgatgtagcgggtaatggttaaccctaatccagcgccgacaaaccccagtccatcccatgaaaagcagccataaatgagtacgctactgatcatgatattgaggatattcatcccgccatttatcagcatcgggatcttggtattccctgccccacgcagcgcgccactgccgattagcgtgattgccgctgccggatagctccatgcggaaacctggagatagctcagtgctaaggctttaacttttggttcggcagcgcccgcaatagcatcaatgatcaggtggccccagaattcgatagcaatgaccagcaccagcgccaaaatcgtcatcatggccagagactggcgcgtggcggcgcgggcacgcttgccgttgcgtcttgccaggctgaaggcgacgactacggtagtaccgagatcgatggcggcaaaaaaggagatgatgaccatgttaaaactgtcagccaggcccacgcctgccatcgcctctttacccagccaactgaccaggaaagtactcaacacacccattaacagcacacaggcgttttcgaaaaagataggaactgcaagcggcgaaatttcacgccagtacagcgtgcggtaggaacgacgtttgggataccacgccgtgcgcttaatcgcctgcaccactgctacgccgggattttgcaaaggagtaccaaatatgaagaagtcgggggaataactctaatgatggtagcctgcgggcaaatatgcaaaacgttttgcattcctgttaaatcatggttacacactttttttatctctgcctcccacccatttaaatcgccgcgttgtcgcatccggcacgcaataatccctggaagaatgccttttctgtgcggataacctgatgtaatggtcgggtttatctgcattttcacttaccccatcgcgccagcgttaagcctcgcctataactcgcagcagtaaaatgcgcgcgatcatagattcttcaccaaatccttcgttaaacccgctaagctgaaggaaattgtcgtaagcatgtgaaaggagaagttatgcccgcccaacggaaaaatcttacacgcgagcaggcgcttgatacgcttgagcagatgtatgacgatgcagtgaatgccctgcgcgcgtcgataaaagcctacacggaagaaggatcgttacctgatcccgttgcccggtcgcaaggtctgtttgtttatcctgaattacgtattacatggcagggcgatggccctcagcagaatcgtacccgcgcctggggacgttttactcacacaggcagttacagcactacgattacgcgcccggctttgctgcgccattacatttctgagcagcttgctatgctggaaaaagagtatgaggtagaaatcgacgtcggtccttcgcgtcaggaaatcccttatccttacgtcattgacggttctgacctgtcgctggaccgcaccatgagcgccggtattgcccgccattttcccaccaccgagctgtcgcagattggtgatgaaacggcagacggtttatttcatgccgatgccaccttccctctttctcacttcgatgcgctgcgcactgacttttcactcgcccgcctgcgccattataccggcaccgccgttgagcattttcagccgtttgtactgttcaccaactacacgcgctatgtagacgaattcgttcgctgggccattgagcaggttcgcgatccttcgacgccttttgacagtcttgtctgcgcaggtgatgtcgttctgacagccagtacggaagacaacgaagcgatgctgtctgatttagcgtggaagaagcatcagatgcccgcctggcacctgacctcacccaaccgccggggcattaccctgattaatatcggcgtcggtccgtccaatgccaaaaccatctgcgatcatctggccgttattcgtccccatgcctggctgatgattgggcactgtggtggcctgcgtgaaagccagcgtatcggtgactatgtgctggcgcacgcttatctgcgtgatgaccatgtgcttgacagcgtgttgccacccgatatcccgattccaagcatcgctgaggttcagcgggcgttgtatgacgcaaccaaatcggtcagcggtatgccgggcgaagaggtcaaagaacgcctgcgcaccggaaccgttgtaacgactgacgatcgcaactgggaactgcgctattcggcttctgccctgcgttttaacctcagccgtgccgtcgccgtcgatatggaaagtgcgacgattgccgcgcagggttatcgcttccgggtgccttatggcacattactctgtgtttcagataagccgctgcatggcgagatcaagctgcccggtcaggcaaaccgcttctacgatggtgcgatttcagaacatctgcagattggtattcgtgccgtggaattattgcgggctgaaggtgataagctgcattcacgtaagttacgcacgtttaacgaaccaccgttccgttaaacgataaaagatgaaaaagacggtattaagtgtgaatgcatttcacattaatgccgtctctacattgaatacgttatgctgattcaggctgcgtttaatacggcagtgttgatgaaccaggcaaatacagcaaggatagccgggaccattaacgtccagattagacggttattcaggctttcaaattttaaatccagtttatcgaatctttcgtcaatcttgtcgaatcgatgatccatggcatcaagtcgcctgtcgatgccatcaagtctgatatcaatgccattaagcctgaaatcaatgccgtcaagacgtgcttcaataccgttaaatctcacatcaatagcgtcgaattttttgtaaacatcatcaaacttcgcatttatcgcgctgaactggatatcgataagattaaatcgatgagcaaagttgaataatatgccatcgatttcagtcagcttgctctcaatgctgaccagcctgccgtcaacatcggcaaacctgatgctaaaatgttcaactttatcttccagttgagtaaatcgctgacgtatttcaacatgaaacacagtctgctccgagcgcagacgctcaagatcggctttggtcgcaaacgccatggcgcgcccactaaaaagcgccagatcgatttttatttgatgattgtcggcttcaagtcgctcaaagcgcatctcaaaattttccatttttctgcctcctgtccagcgatgactgagggtcaaatgcggattaccgcgattccgttttccatacagattgcccattattttttcctgacaggcggattaactcaatccattaatgtaagttccaacctgcttcactgttattgaagcaaagtctcgcgcaataaacattacctgattgaataaaaaggaaaaataaaaagagagtcaactcgttcctttattcgcaatgtttaatcaaaggataaaaggacagcggcgtgaagaaaaggtagttcagagaggatctggaagggagcgcacaaggattgaagataaccgtgaataaccgtcacccgttaatttggcatgccgcattaaaaccgttacagcatattcaatatactgtaacggtctgattaattaggcactcagccagccaagtttaatgacaaataagatagaaagaataatcagtgcaacattaatctctttagtgcgcccgctgagtaacttaaccacggtccaggtgataaagccaaacgcgataccgttggcaatagaatacgtcagcggcatcgtcagtgcggttaccgtcacaggggcggcagtcgtgatatctttccagtcaatttcagccaacccggacgtcatcaaaacagcgacaaacagtaacgccggtgcggtggcataaaccggtacgcttgacgcgaggggagaaaagaacagcgcaagcaggaaaagaacggcaaccaccacagccgtcagaccggtacgtccgcctgcgctgacgccagcggcagactcgacatagctggtggtggtagatgtccccagcagagaaccaaacagcgcggcagcactgtctgcaaccagcgcgcgccccatcttaggcacgttgccctgctcgtcagccagcccggcacgtttggtcacgcccagcagtgtgccggtgttatcaaacacatcgacaaacaagaaagcaaaaatcacgctaattaagccgacgttaaaggctccggcaatatccaactgcataaaggttggcgcgattgaaggcggtgcagaaaacacaccaccaaatttggtcaggccgatccccatggaaataaaggtaatgagcaaaatgccaattaatacggcccctgtgacgcgacgtgcttccaggacgacgatgatgataaaacctaacatcgccagcagcggtcccggcttggtcagatcgccaatccccaccagcgtggccgggttatccaccacgattccggcaccttccagcgcgataatcgccaggaaaagcccgatcccggcggcaatacctgcgcgcagcggcagcgggatgctgttaataatccattcgcgaatcttaaatatggataaggcaaagaagatcacggcggacaggaacaccgcacctaatgcaatctgccagctatagcccatgtgcaagacaacggtataggtgaaaaaggcattcagccccattcccggtgccagcgcaatcgggtagttggcaatcagccccattaatacagaaccaatcgcagctgccagacaggtcgcgacaaaaacggcacctttatccatgccggttgcgcccagaatactggggttaacaaacagaatgtaggccatcgccaggaaggtggtaattcctgcgatgatttcagtgcgtacggttgtgttgtgcgcttttaatttaaatagtttttctaacatcattatctctcgatgatagagacgtcacttaggtgcgcgctctcttgccaaagttatggtcatgctgtttgttgtgatactgagggatcgccagtgctgtcgcatgccagcccggccacccgaaatactgttttcgctttccttagtcacgtgagcaattgcaaaggcttaagcaattgctgtgccagcctggcacgcaatcgattacctgggtgagcgcaagcgagccttaagataattctgaaccgaatcagggcgcgattatggtgcattgccccctaacagcgcaatcgttttcctgcacggttcactctccgggaaattctgcgcttacgcacggtttagcaccttgccaggcgacgctggtcacgtttcagcagcatcaacctgcagacagtattggaatgtgtacactcgcatttaacccttcagtaacattgaggtcacacgatgaagccagcaattctggtggtggatgacgatcatgctgtctgcgatctgttgcaggacgcactcagtgaacatggtttgttggtttatcgctgtcatcagggaaaagatgccctcgcgatggtgcgcgaacgcccggaaatttcactggtgatgctggacatgatgttgcccgacaccaatggattgctggttctgcagcagttgcagcgtcagcggccggacattctggtgattatgctgaccgggatgggatcggaagcggagatggtggtgggcctggagatgggagcggatgattatatcgccaagcccttcaacccccgcgtcgtcgttgcgcgggcgcgcgctgcactcaggcgtagcgggcgcgtcgtgacgccggaaggcgaccatgaaggatggcgttttaatggctggctgcttgatgaggcgcgctgccagttactgaatccgcagcgtgaaaccgtgaccttaacccagggtgaatacaccttgctgcgcgccatggtacgacatgcgcgcaaggtcctgacgcgcgatcagttactggaactcactcatagcgaaaacatggatgtgtttgaccgtactatcgatgttctgattatgcggctgcgccgtaaaatcgaagtgaacccgcatcaacccggcctgatccgcacgattcgcgggctgggttatgttttttcagcggacgtggtgaaacctgaaggtctgcggctctcgacgcaaacggcctgagccatccactgccgcatctcggtcagtggacgaatgccatcgatggcattcgccgcgcgtaagttaaagcaggcacaggtgtgagccagttgcagcgtcgacagcatgtcatcgccctgatggctggcaaacagcacccccgcgcaaaacgcatcgccggctcctacactgccaacaatgtcgtccggtgccagttgccatgctggctgccagatgccctcgccgcccacctcctgaccccatgcaccttccggcgcatgaataacgacgcgctggcgcacgccctgcccggccagccactgtgcggcgtttgcaaaagccgccggtggctgaatcccctgactgtcacgcaacacaatacctgacagcgcctgtgcttccagttcgttaatgatcagataatccagccagcgtagtgcgggcagcacctgggggcgataatcaccaacacgcgaggccaaatccagagaggtaaaatagccacgctgctgcatctgggccagtaaacgggcgctgcgcgtaccaaattcgctgtctgcgccatccagcgtttcaagcagcagtaaatagcctaaatggaagatgcgctgtgcgtcatcaacggccgcaaaatggggcctgtccagcagggcgttcgcgccgggtgaaaagaaaaacgttcgctgcccatccggtgccgtcatcacctgcgtcatcgcggtgggcttatgactggtacgctgcacccagcgatgatcgatctgcgcctcctgcatcatggtcagcagatagtcaccgtcggcgtcattccctaacaggccgatcgccaccagcggaagctgacagtgcatgcgcgacagggtaagcaggacgttaagcggcgcgccacctgccgccttttcgctatgctgcacctccgccagccagccctgctccggccagtgactaatgcggtggacgtaatccaccagcatcacgccagcggccagaatgccgcgccgcgcgctcatctatgcctgccctacgctgccgaaaatcttcatttgctgcatgaccgtctcacaaatggctttttctaccgccatgagcagttcagcaaactcgtcataacgcgtattgcgtgatgccagactgcgctctaccgcgtcgagtgccgcctgggacatgccggtataaaagttaattttatgaataccgagcgagatagcccggcggaaatccgcatcgctgatgcccgatccaccgtgcagcaccagcggcacgccggtttgctgacggatggcggccagccggtcaaaatcaagtttgggttcgcctttgtatttgccgtgggcattcccaatggcgaccgccagcgtatcgatgccggtttcatggacaaattcggcggccaggcgcggatcggtgaatttttcgctatcggcctccccaaagagcgcgccaccttcatctccccctaccgcacccagctccgcttcaaccgacacgcccacggcatgtgccgccctgacaacctcgcgggtctggcgaatgttttcgtcataactcagggtcgaaccgtcgaacattaccgaggtaaagcccaggcggatggcctgcatcaccgcttcgaagtgcaaaccgtgatccagattgagcaccaccggaatagcgtgcttcgcggcttcaaactttatcgcctcaacgatctggtcgagggtgacgtatttaaaatgcacttctgcaatgttgataataaaaggtgagcgttgctgcccggcagccgcaaacagcgcgcgcagaaaatggctgtccagaacattaaacgcgcccagtgcgtacccattttgctgtgcatgagccagcccttgtgccagagagatcaatgccattattcactcctcagattgagccaatgggaatagtcgttgcagagcagccggtgcggctcctgatcctcatcgagggcgttaaagcgtgccagcggcgtcagaaacacgttgtcgttatcgtcatcgttaggcatcgagacttccccgaccagcacatcgccaaagccgttttcgccccagaaactgtgccagacaccggctatcagagtgacgctttcgccaggtgacagccggagctgtgaccctgcagcatgggtttgcctgatgccatccagcgacaccgtgaccggcgtgctcgctttttcattgccttcacggttgtaaagctcgacgatcagattgccgccaccgcgattaataatgtcttccatttttcgtggatggtaatgcatcggcgtcacctgaccttcacgcacatgcatcactttttcagcatagggtttgtgccagggctttccgcccggtgagccattgcgcagggtgaagagcgtcaggccggtttgcagaaaatcatcggcgccaaagctggtgaggtcccagcccagacgtaacgccacaatttcatccatatcacactgctgctgacgccactgacggatatcgtaatccgcccagggcggcagatggacatcctgacgcgtaaaaaagtctcgcgtgttttgcaaaaacacattcacttcggagcgttgcatcctcagctctcccgttaaagcggcaccctgaggtgccgcgcgccggtttatttcactgtccagcccttgtagctgctgacgttattacgatcgattaacttcaccgggatcagtaccggtttatccggggccggtttgccctgaagaatgtcgtaaccgatctccacggctttggctgccatcacctgcgggtcctgtgctggcgtggcggcaaacagcgagtttttacgcttcagcgcttcctcgccgtccggcgaaccatccacgccgacaataaagaactctttgcgctgcgcctgttttgcagctaagtctgcgccgatagcggtaggatcgttaatggcaaacaccgcatcgatttttggatttgccgacagcaggccggtcatcacttccagtccgccttcacggctgcctttggcgttctggttagaggaaagcagcttgatgtccggatggcgtttcagctcggtcatgcagccttcgacgcggttctgtactgccgaaacaggcggtccgttaataatcaccacgttgcctttctctttcaggcgatcggcgatgtatttacaggccatttcaccggcctgggtgttatcggacgtgatggtggcgttagcaccatctgcggccacgtccaccgcgaccacgacaataccggcgtcacgtgcgcgcttaacggcgggagcaatcccttttgaatcggcggcattcaggataatcatgtccactttggcagcaataaagttgtcaatctgaccgacctgctgtccgagatcgtagccgctcgagaccagcgtgaccttaacgttgtcgccggccagctgacgcgccttcatctctgcacctttagtgatctgcacaaagaatgggttagccagatcgcctacggttacaccaatagatttcagttcttttgcctgagccacaccggcgctgaacagcgttgccgccagcagcccagttacaatcggattaaaacgcatagatcttctcctgctgttatttatctgccaactgctgaatggcgctttgtttgctctgcgcatgtggcctgtcagcccacatgatgacgagttcgatatttgtcgatcagcacggcaataatgatcaccgcccctttaatcaccaactgccagaaataggaaacgcccattaatgtcatgccgttgttcagcgtggcgataatcagcgccccaatcagcgtaccggtaatggtgccgatgccaccgacgaaactggtgccgcctaaaatgaccgctgcgatggcgtccagctcatagcccacgccaaggttgccgttggcgctgtaaagacgcgacgcactcatcagcccgcccagcccggacagcaacccgctcatgccgtagacaaataccagcaccatgcccactttgatgcccgtcagtcgggccgcctggatgttgccgcccaccgcgtagatatgcactcccagcgtggtgcggcgcaaaataaaccagcagatggcgatgacggcaaaagcgatgacgatgagccacggcaccggcccaagatagccgttgcctatccactcaaaattaatatcggaattgataaccgtggtgccgttggccagcagataggctgcgccgcgcagagcggtataggtgccgagcgtgacgataaacggcggcagtccggcccaggccaccagaatgccgttaaacaatcccatgaccagcccggcccccagcgccattgggatcgtcagtgatgccagcatcgggtccagcgaggtcagcagcgccaccaccgccgtggtgcccagcatcgatcccacggacagatcgataccgcccgtcagaatgacaaaggtcattcctgccgccagcacaatattgatagaagcctggcgcgtaatgttcagtaaattggcttcggtaaagaagttaggagtaacaaaaccgaagaccgcgacgattaaaatcaaaatcggtaaaatgcccaccgtctgcatgatgtcgcccatcagagcgcgcttgatcgtcggtgggttaacaggtgccgtttgtgtcattgttttatcctcatacttcaagcggtgatgcgctgtgcgcaccggttgccagcgtcatgatgttttcctgactgatccggtcgcctgccagctcgccggcgatggccccttcatgcatcacataaacccggtcgctcatgccgacgacctccggtaattcactggagatcatgagaatggccacgccctgtcgcgccatgtcctgcatcatgcggtaaatttcgcttttcgcgccgacgtcgacgccgcgcgtcggctcgtccagaatcagaatgcggggaccgatggcgatccagcgagagatcaacagcttttgctgattgccccctgataaaccgccagcgcgtaccagcgcatggggcacacgaatattgagagacgaaatggcctcactggcgatttttcgggatttgcgacggttaagcatgccgtagctggcatcacgctccagggtagccatcacgatattttcctgcgcggccatctccagaaacagcccctgctctttacggttctcggtaagaaaaccaatgccgtgcgcaatcgcctcacgcggggagtgaatcgccaccttctgaccatcgatccagatctcaccctgtttaagccggtgcacgccaaagatcagctgtgccagttcactgcgtccggcccccaccagtccggccaggccgacgatttcgcccgcacgaacctccaggctacagggatgaactttgccgccgtcggacaggtggttgatcgccaggcgaacggcaccgcgcggaatcgtgcggtctttgttaaacaggtcactgagtggacgccccaccatcatgcgcaccagctcactggcattgaggttgtcacgcgtcaggctgcccacgtactgcccgtcgcgcagcacgctgacccgatctgacagttcatagacttcagccatgcggtggctgatataaataatcgccatgccttcgctgcgcagacgtttgatgagggcaaacagttgttcggtttcgcgattcgacagggcggcggtaggctcatccatcaccagaatccggctgttacggtgcaaagcgcgcgcaatttcaacctgctgctgctcggcaatactcaagcggctgactttgtcagtggcgctgaactgtgcgcccaaccggttgatcacctgttgcgcctcgtccgccatctggtggcgcttcaccatgcctgcccgggtaatttcactgccgagaaagatgttttcggccacggtaagattgggggccaggttgatttcctgatagatcagcgtgatgccagcagctaacgcctctttgggacctttcaactgccagggcttgccatcaattaacacctcgccactgctggccgtataggcacccgccagtatcttcatcagggtgcttttacccgcgccattttcgcccatgagcgcatgcacctcaccgggatacacggtgagatccaccccttttaacgcgtaaaaattaccaaagcgtcgggtgatctcgcgcatttcgagtatcggctttgctgtcatctacccgctcctgctggttatgaatagcagcgagttaagcagggccagataaatagaaaatgtcagaggtcattcatatttgtcatattccgccttgtgctcgctcctatactcggctcatcgtcgcacggtcggagagtcattatgcaacgcagttcaccgtggcaagtcggggcgcgcggtcgcctgttgctgtctcatttgttggtggtgtgcgtcacattaatggtcagcgtggtggcggtaaccagctttcgtcatgcgggcaccatccaggaacaggcccaggcgcaaaccctggccgatatgaacggcagccttgccctggcgcgggataccgcgaacgtcgccattacggcagtgcgcttatcccaggtggtcggtgcgcttgaatatcaaagtgaatcgcgacgattacagcagaatcagcaggctttgcagcattcgctctttttgctggccaacacaccgctggccgcacgtgagcctgagcgcgtggctcgcctccgggcgcgcagcctgatgcttgaacagtcggtcagtctgctgttacgcaccggccatgagcgccatctgcagcgcaatatgttgttaagcggtttatggcagtcgcaactcctgcttgaacgcattaacgacctggcactgcggcagaccgcaggcgcacccgacagggagctgcgacagcagaccggcaggctgctggatatcgctatccgtaccccttcgtcagccgcggtgattgaacagctgcagcaggtcatgaacacatggcacagcgtcacggcgcaaggaacgctgggtgacaacgtgcagcaactggtgcaggccctgcaaagcctgacgccgctgtcggcggatctggaacagagcgatctggccatcgcctacgccacctaccgtatcaaagcgctggtggccgcgctgaatgacgacattactgcttacgtacagcaggtggcgcagcaaacagaaagacgcaatattgcgacacatcaccaactcgactcggtgagcggatttatcatgctctctgcgctgctggcgttggcgatcaccgtgtataccggctactacatttaccgcaacctcggctccagcctgaccgccattgcgggggcgatgacccggctggcgcagggagaacagaacgtcagcgtaccaggattgcagcgtcgggatgaactgggtgagctggcgcgcgcgtttaacgtttttgcccgcaataccgcctctctggcgcatacctcacgtctgttaaaagagaaaagcacccagcttgagtccaccttcctggcgatgcgcgatggttttgccctctttgataacagcggggaattggtggtatggaatgcgcagtatccgcaactgctgggcatcgccccgagagatttgcatcgcggcatgcactatcagcaattgctggagcagcttgatgtgcagttgcacgatttagcggaaccccaggaagtcaggctggcagacggacggacgctggaactgcgctttagccccgtgccgcggcgcggaatggtgaataccgtgctggagcgcacctcgcgtaaggtgctggaagaagcgctggtgcacagccagaaaatgaaagcggtgggccaactgaccggcggcatcgcgcatgattttaataatctgctggccgtcatcatcggcagcctggcgttaaccgaagggcagcttgcgcccggccctcttgccagccggattgaacgggcacgccaggcggcggacagagcggcactcctgacccagcggctgttggctttttcgcgcaaacaaaccctgaatccccatgcggtttccgtcgtgtcgttgattgagaatctacaggggctactgcagcactcgctgctgcccggtcagcatttgattatcgatgcacagcggcccggctggccagcctggatagatgccagccagttagagaatgcggtgatgaatctggtggtcaatgccagagatgccatgggcggacagagcggcgagattcgcctgcgcatctggaatcagcggcgaagcgaacagggtgaaaaacgtgatcgggtgacgattgaggtgatcgatcacggttgtgggatggcggatgacgtgcgcgcccaggtctttgagcccttctttaccaccaagaccaccggcaccggaagcgggctggggctgtcgatggtctacggttttgtccgccagtcgggtggacaggtagagctggaaaccgcgcccggccagggcacaacggtacggctgttgctgccgcgtgcacctgatgtcgcggcggcacgtcccatcgtgccggctccggctcagcccgatgccgccgatgaccgtctggtgctggtgctggatgatgaaccggcggtgcggcaaaccctgtgtgagcacctgcatcagttgggttatctgacgctggagtgcgcgaccggtgaagaggcgctggcacttctgcatcagacgccggatatcgatttgctcatcagtgatttaatgttgccgggggagataaacggtgccgaggtcattcgtcaggcccagcaaacctggccgaaactggcaacgttactgatcagcggtcaggacctgcgccaccagccggtcacgctgccgctgtgtgagcggctggcaaaaccctggcaggaggcgcaactggtacaggcgctccagcgcgcctggcagcgaagcgcgcggcttaatcgtgcccgcccggctgccacaacggcaccgctttcccaatgatatagcgcttacgcagatggcttgagatcgtatccatgatcatcaccaccaccaccagaatcaacgtcaggaacatcactacatcccagttccacaggcgcatattttcagcataaaccaggccgacaccgcccgcgccgacaaagccgaggaccgccgctgagcgggtattcgactcgatctgataaaggctgagcgccaggaactgcggaaaagactgggtgaagataccaaaacggtgcttctgtaagctgttcgcgcccagtgcccccagcccccggctgggtgaacgctctaccgcttcgtgcccttccgaatagagcttacccaagagtcccacgtcctgcaggataatggccagtacaccggccagtggccccatgccgaccgcacgcacaaagatcaggccccagatggccatatcaatcccgcgcagcatgtcgaacagacgacgcatcaggaaagcaatgggccgggctgcccggtcatgcatcacattacgtgcggccagaaaggataatggcagcgccagtaaggtggcggtaagcgtaccggcaaatacgatcgccagcgtaatccctacctgagagaaatagtagccaaagggccagttggcaaagtcctgccagacaaacatgcgcaggaaatagcgccccagttgctgacagcccatcagcaggcggccccattcaataccgtacaccataaagaaaaagacgtaatagagcaccagcgccagtgccagcatagccagacgccgcagatagcggttttgcgcggcaaagagttgaggatgttgctgcttcatcgccatgatatcaggggccaacgtaaccatatttattcctccaccacacggcggcgcaggcggccagaaaccgtatccagtagcgacaccacaatcagaatcaacaacagcgtcatgctgacctgatcaaagcgatccagtttgatgttggtcattaactcctgaccgattccgcccgccccgaccagcccaagaatggtcgacgaacggaaattcacttccagccgcataaaactgtaggaaagaaaggtaggtttgacctggggccagaatgcaaagcgcatacgctgtagcttgctggcaccgcaggcggcaagtccgcgtaccggcttatccgatgctgattcaatcgattcataaaacagcttggtcaggctgccgatggtatgtaaagccagcgccagaaaaccgggaatcgcgccaatcccaaacgccatgacaaacatcaccgcccacgccagctcaggcatcgtgcgtaaaaacgccacaaaggctcgaattccgatgcgcaggctggcgggcgtttgcgtgttgtcggcggcaaaaaatgccagtacgcctgcaatgacgaccgcaatcagcgtggaggccagcgccagctgtaaggtttcccaaatcagcgggagctgaatgttcagacgatagccccagtaggccagcgacccttccgtcttgccatcggcaaacagcagcggcagatgcaaaacggggataatttcgcggatgtaatcgaaaaagtgcggcaacgattgccagatggtcacgagactgaactctgacatattggccgccgccagatagagcaccaccaacaccaaagaccagatgagcgagtcacgcttctgttggcggcggatacgttgataataacgttcgaagtcggtcacgggagatgtctcagattgaggtgtgacaaagccatcctggaaaggttgacgtgcagacaagcccgtcggctgtctcgtgccgcctgccttgctggaggcggcacgaggacggaaagctcactgccctgccgttagccgcgcgcgcctttcatcagctcgcgtttcatatcaatgatgttctgaaagtcagcaacagaggttttgccaatgtgctgcgcgccgcccacggctttaacgaaacaggcgtgatcggttttatccagctttttaattgccgcaaccactttctctttaaagtctgctggcagtttattgctcaccagaattggaccgttaggaatcaacggcgattgccagatgatgcgaatctgcttcatcagatcgggatggtccatacggatcagtcggccaaacgcacccgatgtgtaaccggtgttgtaatcaccgaccatggatgtccaggtcaccgcgccgtcaaactgattattcagcacgcccagaatgtcctgctcatgaccgccggagaaggtcacgcttgaaaagaagttgttgtatttattatcaatcgtgccaccaaacatcttcttaaaggcctggtttggcacgaggaagcccgaggttgaatccggatcggccataccaaaggatttgcctttcagatcttccagcttcttgtaggggctgtcggctttcacaatcaccacggagtggtaaccgcgagactgatctttgtcatccacaacgatacccactaaatcaacggccttggggtcctgaatgtagacggacgcgtacgaggagggagacatgctcaataccagatccactttgccgcccagcagcccctggatcacgcctgaatagtcggaagagttgcggattttggtatccacgttcagctctttatcgaagaacgatttaacacactggttatcaccaatctgctgcgtcgcgttctgaccgcccaggatacccagattcagttctttcggtgcgtccgctgccttaacgccaaaggtaagcagtgctgtagtcaataaagcgaaagatctcattttcattagcattgttctcttgctgtgatagttagtggatctggttcagttcgtcaccgtacagctgatgcagcaggccgtcggtgagttcagaaggatgaccgtcaaacaacaccacaccacgctgaataccaatgacgcgcgtgcagtaactttttaccagctcaatcgagtgcaggttcaccatcacgctgatgccctgaccgctgacctgacgcaacacatccataatgcgggtggtatttttagggtccagcgacgcgacaggttcatccgccaacagaatttttgggttctgcatcagtgcacggcaaatcgccacgcgttgcatttggccgccggagaggttctcggcgcgctgcaacgcctggggcagcatattcatccactcaagcagttgaatggcgcgggcgcgatcggcgtcagagaagattttgaaaaaggatttcagcgtggacgtctggctgaggcggccaagcaatacgttggtcagcacatcaagccggggcaccaggcaaaaatcctgaaaaatcatgccgcactgggtgcgccactcacgcatctgccgactgctgagattcaccacattccgatcggcctcgccgtggtgcagactgataatcgcgccctgtgaggcggaaatggtgccattgagcatatgcagcagcgtcgatttgcctgcgccagagcgacctattaccgccactaattcgcccgcatgcaaatcgaaactgacgttatcgagcaccttattgttagcgtatgctttgctcaatccctgaacagacaacactttttgcccgcctgaatgggtcaatgacgtgacgttatcgaccacagttttaagcagtgcctgtgccatgatgtactccgctgttacagtttacgttctgtacgcccgccctccgaatccagagttgacgttatatcgctggtcggtgctggttggcgtgcgtcattatcttgcgtctgttgctcacgccgcaggaatctgacgagagaccgctatattaagaacatgggggatgaaggctgtattacggttagatgattaaactgtgacaggcaaatcggcaccgagagacaacgacaaaccgtcgtaagccgcgcgcacctgagcaggcaaggcgtgctctgccagccagttatccatgtgatgactcaaatgaatcagccaggcctgatggggtttcagttcatcgatgattttcagcgctgcggtcagatcgttatgattgcgcccgccctgtccgggcggatcgttacagtccaccaccaggtgatccagcgtctgtccgcgcagaaaatccgctgtatcgggcggcagaccgcaggtatcgcacagccaggccagacgcgatccataccagtcaaacagatagccgtgcgtcagccgggagtgctgcagcggcagtgccgtcacccgcaacgcaccgaacgactccgccacaaaaggggtgagggatggacggaaatccagcagtccgggatgtttgaacagatcgtcacagcccttctcatccggcggcccccagacgggaatggcgttgccttcgccccagcgcagggtgaataatccctgcacgtgatccatatgatagtgagtcagcaaaatccggttaatgtcacccggctggaaacgttcggccagcaggggcaagcccgcgtccagtaaaatacgcgcctgaccggcttcaatcagggcgctacagggcgcacgtttataacgtggctgctggcgggcgcgtaaacaggcgtgacagtcacaaccgaacaccggtgcccccgtcacgccgccagtaccgagaaaggtcagtttcatggcgacagcgccagcagctggcgtaactgttgtacggtatccgccagcgcgccatcgttattcagccgcaaacagccctctggttgatgctgcgcagcgcgagccagccgttgggcgatcgcctcttcattttcgcgtccgcgctgccgtaagcgcgcggccagcaccgacggcgaaacctcaatgcacaagggtaacagctgcgcgccgtaacgcgcgcgcacctgttccagatgctgccgggacccgtttaccagcacgttttgcccgcattcaagccagctatcaatttcacgcccgatgccgtagcgaaaaccgtgggcctgccagctaacggcaaataaacccagcgcctcgcgccggataaactccgcttccgtcagggcaacatggttttctccccccacatcgtgggggcgcgtaatgtagcggtgcgcaatcagcaggccatcaggcggtgcctcgcgcagcaggtccagcaggctgtctttccctgagccggagggacctgttagccagataaaccgggccatcagtacacctgccgacctttactccacacatggcgaatatggggatgaccatgttgggtatgcgccagcaccagatcggcgcggcagccttcagtaattacgccacgatcttccagccccagcgcccgggccggattacaggtcaccagcgcaatagtttgcggcagagacagcgcgttacgctcatctgccgccaggcggaacgccgcatccagcaggctgccgggataatagtccgatgacaggatatccagcatcccgtgggacgccagctcccaggcggcaacgttgccggagtgcgagccgccacggacgatattcggcgcgcccatcaacacctgcatattgcggtagcgggaggccttcgccgcctccagcgtagtgggaaactcggctatcgcgctgcccacgccgtgtgactcttccacgtgcgcttcggtggcgtcatcgtgactggcaatggcgatgccatgctcacggcacagcgcggcaatcgccagacggttaggctgtgaccaggctttggccagcgccagctgatcgcgctcaaactcatccatctgctcatcattaagctgatattttccctgatagtactcgcggtacttttccagcgatgcgtactggcgctgtcccggtgaatggtccatcaacgacaccagcgacagctccggtgacgagatcagcgcttcaaacagcggcagcgttgtgtggtgcggcagctcgcagcgcagatgtaataaatgctcggcgcggtttagccccttgcgattactgtcgcgaatagccccaatcattttgctgaggttgtccagccggtgaccgccatcgcgcacatcgcccacgccgatggcatccagcaccgtggtgatgccgctggccaccatcagcgcgtcatggctgctcatggccgagtgtgccggccagtcgactttagggcgcggggtgaaaaacttatccaggttgtccgtgtgcagctccaccaggccgggcaacagatacgcgccttcgccatccagcgcgctggcaagctggctggtcgtttcgctaaagttggtaatacggtcttcacgaaactccagcgatcccgctacgacttcattttccagcaccagctttacattattgatgatcatgcttctgcccctgtcgtgaagggctgcatcacgtgcaggcggtccgccacacgttcccgcaccgcttcatcatgaaaaatccccacaatcgccgcaccgcgctcacgcgcctgttcgatcaggcttaccaccgccgcgctgttaacgctgtcgagcgacgccgtcggttcatccaacagcagcaccggataatcggcgataaaaccccgggcgatattgacgcgttgctgctccccaccggagaaggtcgagggcgcaagggcccagagacgttccggtacgttaagccgggtcagcaggtctttggcgcgcgcttcacagaagccgcgttcagcgccgcgctccagcaagggctgcatgacgatttccagcgttggtacgcggggaataacgcgcagaaactgactgacccagccgatggtatcgcggcgaatcgcgataatctgacgggctggcgcctgcgccatatccacccattcgccctgatgctgtacccaaatactgccgctgttggcctgatagttgccatacagggcacgcagcagcgtggatttaccgctgccagaatgcccatgcagtaccacgcattccccctcactgacatcgaggctggcatcctgcaataccggcagtgccgcaccgttctgattgtgcaggacaaaggttttgcacaaattttccacgcgcagttgcgtcttcattgtcgctgtcgccatttagttaagcaccgatgaaaccagcagttgtgtataaggatgatgcggatcatccagtacgcggtcggttaacccactttccaccacccggccctgcttcatgaccagcagccgatgagccagcaggcgcgccacgcccagatcgtgtgtcacgatgatcaccgccagattcagttcacgtaccagagtacgcagcaggtccagcagccgcgcctgcaccgagacgtccagcccgcctgtcggttcatccataaacaccagtttcggttgggtcactaaattgcgggcgatttgcagacgctgctgcatgcccccggagaaggtggtgggaagatcatcgatacggttagccgcgatttctaccgcctgtagccagtggctggcttctgcacggatatcaccatagtgacggtggccgacagccatcagacgctcaccgatattgccgcccgccgtgacctgaggacgtaatccttccagcggatgctggtgtaccacgccccattcggtacgcagtaaccggcgacggtcgctttcactcatctgatagagatcgcgctgcaggtaatgaatctcgcccgcctgcggcaccagccgggcagacaggctgcgcagcaaggtggttttgccggaacccgactcccccacaatccccagcacctcgcccggatagagatcaaagctgacctcctcgaagccttttcccggtgcataaaggtgagtgaggttattgaccgcgagcagcggttgttcactgtgcatgttgttgttcctgctgctggtggcaaaaatctgtatctgagcacacaaacattcgcgttccctgatcgtccatcaccacctcatccaggtagctgtggcgcgatccgcacagcgcacagggttcgtcccactgctgcacggtgaagggatgatcgtcgaagtcgaggctttcgactttggtatagggcggcaaggcatagatgcgcttctcgcgtccggcaccaaacagctgcagcgccggcatcatgtgcattttcgggttatcaaatttgggaatcggcgacgggtccatcacatagcgatcgttgaccttcaccggataggcataggtggtggcgatgtgcccgaagcgggcgatatcttcatacagtttgacctgcatgatgccgtactcttccagcgcatgcatggtgcgggtttccgtttcgcgcggctcaataaaacgcagcggctcaggaatcggcacctggaaaatcagaatctgatcttcctccagcggcgtttcgggaatacggtggcgcgtctggatcagggtggcatcgaccgtgcgttcggtggtggcggccccactgacccgttggaagaaacggcgaatggaaacggcgttggtggtatcatctgcgccctggtcgatgactttgagcacatctttatcaccaatcacgctggcggtgatttgaatcccgcccgtgccccagccgtaaggcatgggcatttcacgtccggcaaacggcacctgatagcccggaatcgcgacggcttttaagatggcgcgacgaatcgtgcgtttggtttgttcgtcgaggtaaccgttgttatagccgctgagctcagccattttgctgctcctgatagtcctggcgcagacgtttcagcagttccagttcggcctggaaatcgacgtagtgcggcagttttaagtgggaaacaaatcccgcggcttcgacgttatccgcatgggacagcacaaactcctcatcctgagccggactggtgatacgttcattgtgctcgcgggtctgtaacgcgcgatccaccagcgccatggacatggcttttcgctctgcccgaccaaataccaggccatagccgcgcgtgaagtgcggcgcgctttcaccgtcgtgggtaaatccgttgaccatttcacactcggtcagcagcatttcgccaatttccagttcaaatcccagctcttccgggcaaacgctgacgctgacatagccggtgcggatttcaccggcaaagggatgggttcgcccatagccacgctgggtggagtagcccagagagagcaaaaagccttcatcaccgcgtaccaactgttgcagccgcgcggcgcgcgaagcgggaaaccccattggctcgcgggtgatatccgtcggttcgctgtcgtcgtcgctttcactctgtgctaagccttcgtcgctcatcatgctgaacatatgcggacagtgctcaggcagtgcctgctcgcttcgctgcggaagcggcgtttccccgttagccatcagggtaaaatccagcaggcggtggctgtagtcgtaggtcgggcctaaaacctgaccgccgggtaagtccttatacacagccgagatacgccgctcaatccgcatgctgctggtggctaaaggcgtgctttgtgccagacgcggtaaggtcgtgcgataagcacgcagcaggaaaatcgcctctaccaggtcaccgctggcctgtttaatcgccaacgccgccagcaagggatcgtaaatcccgccttccgtcatcacgcgatccaccgccagcccaagctgctgtgcaatctgatcgcaggagagctccgctacggcgcgatcgccccggcgcaagtcggcctgcagatggtgggcattcgcaatggctttttcgccccctttcaccgctacgtacatgagcacacctcaacattcgttgtgcgtggcaccgccatcatcgcttcgccacaggtgaaaatcaggtcaacgccctgaggaaacggatggggccgggcgcgcaggtattcgagcacgctttctggcagctgtggcgcaatggcgcgggcttcacgcagcccaggccccgacaatcgcagcgccaggccaccgtttagcgagggcacttcgataatcagcgtggtgcttttttccggtgccaggttgtcacccgcggcgaagtcgcctggattgggttgagcgtcggcgtggcttaatgcaaaggccgcatcgttgctgtcggtaacagaagcgccggtatgaaaacgcaggttgtcgcgcagctgttgattatccacctgcgggtcaagccatagcgggctttcctgatcgaccaacgtcagcagcacggcggtggcggcaggcgaaagtgcgccccagccctgttgcagcggcagggaaaccatcacgcccggctcgctcatggctttcagaatgcggcgaaaggcgtgctgcgcatccgcaaccggatgattaaaacttgccagtaaagtcattcattgtctccgcgtaccagcgtaaagaagtccactttgctgctggcaatttcacgtgcgcgcagctgacgctgctcttcacgtgaggccgccagcggggtaataattttttcctgcagcagttcaccggtttctgtctgctgcaacagggcatccatcagggcacaacgttcggcatgggctttatcccgcccgagcaggtagctgtaacccagggtgccatcgttaagccgcacgactgcgcgcgtcacggtggcatcgccgaccacaaaacgcttgccggtagcgcccatgcgggcctgcaggcgcgtcaggccaatttcagccggacgaatcagggtaaattcaggcttgaggttgagcggctgccagtgcgcgtcaagctcggctgcgctgctgtgagccaacaccgaaagccagtgctggcgggccgtttgctgtttcattagtgctccagagtcagttcgatcatgtcgccacgggtcaggctgacggagtattccgccatcgcgccatcggtggttttattcagggtacgcacgcacaacagcggggaatgcagcgcgatttccaactgtttacactcttttgcctgcgcccggcgggtgctgatacgcgtctggctgcgcaccagctgcttgccggtatggtgctgcagaaagtcatggagtgaaccgctgttgaagcgttgcagctgcggccaccagctgagatcggcaagaaagtgattgatcagacagaccggcagaccatttactcggcgcagagtacgcaggtggatcacgtcattgccttcgctcaccccaagtgccgcggccacatcggcactggccgggcgcagcaccgccagcagacgttcactggtgggatcgctgccctgctccatcaggttttggctgaagcgggcctgggcatgcagcggatagtcgtaggggcgcatcaacaccaaaattccaacaccgtggcggcgttgcagcaggcctttattgaccagctcgtcgaccgcccgacgcagcgtatggcggtttaccgcatagtgatcggccagttgctgctcggagggtaaatagtcaccactgcggtagcgttcctgaacagcctgctccagttgcgctgcgacagcctgatacacagtggtcggatgtctggataactccatcacaattaaatcctcacatcagtagagggatttcgcagcgaaggtgctgcgggatggaaacagactgacgggatcagatgacagcgaggtgacgagacggtgacgtaaacatgaattcgcgccagcctgtcgcgtacagggcaacaggctggcaggtgggtccttcagggctggcccaggctatccagcagtgccgccgaggtggcgaccgcgccaaagataccgccctgcatatggatcatgctcagggcggcttcatgatgatgtcgctcagtggcggcacagcagtcggataagaccaggcactcatacccgcgatcgttggcctcacgcaaggtggtatgcacacacacatccgttgtaataccggtaataatcaagttgcggatgccgcgactgcgtaacaccagctcaaggtctgttgcatagaaagagcctttaccaggcttatcgatgatcacttcgcccggcagcggtgccagttccgggataatctcccagcccggctcaccgcgcaccaggatacgaccgcacggtcctgggctgccaatttctgcattcatcctgcccgaccgccagcgtttattggcaggcagatcgctgagatccgggcgatgcccttcccgggtgtgaatgacgggaaaatgcagcgcacgcatgcgggccagcaacaccttaagcggttcgacaggcgcgcgcgtaaggccaatatcgtagcccatggtgtcaacgtagccgcccgcgccacaaaaatcgatctgcatatcgatgacgagtagcgccgtatcagcggcactaaaatggccatcaaacggccaggcatagggggtggaattcacactgtactcaggcattgttcttctccattcgcggcgtcggggaacgtaatttgataatcagggtatagctcagtgccgctgtcaccagaccgataaccgcttcgccaaactggggaaaggccagatgcgcgatgaccgcgcacaggcttcccagcgcccaggccgcaaaggcggcaccgtgaaaccgttgcgccgggcgctgttcactcagcttcgccataaaaatcagatcaacaatcatgaccgcaccaaacggtggcaccaccacgcccagcaggctcagccatgccaggaaataagtccaaacgcccgccagcgccagcaggccgccgatggcaccgagaatcagcgtccagcggcgcatcttgctgttaaaaagatggctgaagcctaccgcaccgttataaagacagtgcgtacacaccgagccaagattgatgaacacaaacaggaaagccaccacggttaaaatctcaccatgccccatcaacatgggcaggaaattaccgccgttggtcagcgggtccaccgccgcgccgaccgagacaataatcacgccaaacagataggcgatcaggtttgcgaccggaaacgccgaaaaggcggcgatgaccgcagcacggccactcttcgaccagcgggtgaaatcggcagtcatggtgccggaatcggcaaaccccgccaccaccatggtgaccgccgtgcccatgctcatggctcccgccaccgtggggctgcccttccagtgaaacatgctggaaaaatcatgtgtctgcccgacgaaatacagcgcgacaaaccctaaaatcacaaacattggcgcagcaatcatgcccagcacggacagagcacgcacgcccagaaaggtcacggccgtaaacagcaccatggcaaatgccgtcaccgacagggcattccagccaaaggtctgatgaatcaccgtcccggtcaatcccgtctggaaggcgtaccagccgataaccacggtcgacagaaagccggacacgaggatatagcctttgctgccgaaggtcctcttcgcctgcagggcaaaattcatcccggtattgcccgcaaaccagcttagtgcgccgacataggcaaacagcaccagattgcccatcacaatcgccagcaacgcaggccagaagccaaggtgccaggtaatgatgccgccaaacagcgcattggtgaggatcatggggaaaccaaaccagaccgcagaaaccgagcgggtcggatggcgatgcgacagcggcacgggttcgtgctcaaactcctgctctaacgttggggaagcctgttttttcatggcaaaaattcctggttaaggtgaatccacggacaggcgcgctggggcactgacgttcatcctgtgctcgccatctttatgacggtacaggtgccgtcgcgctggcgactgtcattgcattgcgtggtggtgtactgccgccttaccgggctgttaacccttttccacgcatgttgtcttaccggtatttttaacccgataagaagtgcatgaagcatgccaggaatcgtccctcccgcgttgtcacgcgcggatgtccgtctggatacgggctgggatacaagatcgaatacttatgataagacgcggcaccttacccgttgcggtgcggcggtttctggcacgctgatggggcggtgatgcacgataaatgggaaacttttgaatctcatctggaaagcgaaaagcacatcagaatgtcactgcgttgtcatgcgcccttcacgcccggcgaccacaatagtcgcccattattcttgtcgaaggcttttatcatgtctgctgttatccgttttggcacttttctggcgcttttttcaggcatgattgcggcgcctgttgtgagcagcgcacagacatcggccgcgctgcctgcaccgcccgccgaccccggatttaccgatagcgcgcctgcggcaaaggtgccggcttttgttgacagcatcgccaccaaccaacgcggggatgcgcgctttgccacgctggagacgaatgccggcgtgcgcgtggtgtccggctttctggccctgtggcgtccgcgtacgctcaaggtcgatgcggggatttcggcaccggcccgtgatggttttgcggcgattacgccctctgattgcattggcctgcccggtaaggcccccgtctgcggcacgatacttaatcatcaggtactggcggcgaatgttcagtatgtggttacggcgacccgccagcgaacggcagcccaggcccaggcggcctactttgacgatcgtcgagccaaaggctatagcgtcacggacggcctgggtccgctgaccgcggcatggcgcagtgccgctcagcaggtcaccaccatcacgcagattcccgcagatgccacgacggtgctgtataacgaccagggaaacaacaccggcacgggcagccatgacggcaatcgcgacttcggtgaggtggtggattttctcaatgaaatgggtaacaacgcctctacggaaccggcaaaacgtttctataaatacgcccgtccctaccgctggcgttcagaggtggcggtggtgcctgcccttgtgcccgcagaaagccctacgcccgctaccgatggcggatttatcagcggacacacagcggaggcggtcagagatgccctgaccatggcgtggctggtgccggagcgctaccaggagatggtcagccgcgggatggagttgggcgaaagccggatcgtcgccgggatgcattcgcctttggatgttatgggcggacgcatgttcgcgctggccgttaccaccgcaaatctgacggcatatcatgaggatgcacaacgcgcgtacaaacaggcgcatcaggtattatggcaacgcaccggtacacaacccagcacctttctgcaatacgctcacgccgcgccgctcagtgccgaccgcttcgccgatcctacccttaaccgtgccagtgcccttcggcgcatgacgtttggctttgctcccatcgcgtcccgccatcgtccagcggtggtgcccaaaggtgccgaggttctactggaaacccgttttccctatctgagtgccatgcagcgccgcgtggttttaaaaaccactgaactgtcatcgggctatccgatcctggatgatgccgaaggttggggacgtctgaatatcgtggcggccgccgacggatatggtcagtttaccgggaatgtgcaggtgatgatggatgctgagaaaggcggttttaatcaggccgacagctggcggaatgcgattggcggccaggggaaactgaccttacagggttcaggtacgctgcggctactgggtgcgaatcgctacagcggcggcactgaaattgaaggtggcgtgctggaggccggttcagccagcgccctgggcgtgggtgaagtttatgtgggcaacgccggcagcgtgcgtattgccgcagccagcccggtgcgcgttaaacaatattcggcgcagcctcaggcaactcttgaactggatatcgatggtcagggcggaggtcgtctcaacgtgaaggggccattggtcgcaggcggtacgctgttagtgaagtttgtgaagggttatcaccccaaaccgggtacgctgattccgttgattgaagcgggctcaaatgcagcccactttggtcgcattattgtcgagggctatcaggctcagcctgtcagctccgctacgcgaatcagtattaaactgctctgatcctgagcacggctggcaaggcgcgcagagaatgggcttgccaggcttctgcgcgccgggccgaaaattacacgccgaactctagcgggttatgtttactgatcagtgagcgtaacggcacactgcttttcatcacgggtgatttaatcacgatatagctgaagtacttatcgatgccaatttgcgcatccagcatcttctcaatcacatcctgataatgctcaatgctgcgggtaataaagcgcaacaggtaatcgtaacccccggtaattaagtgacattccatgagttcgtcaacgtcacgcatggcggcttcaaacttcataaagtcttcgcgccggtgtccgttcagcgtcacttcggtaaacacggtgaccgagtcggtaattttggtgagattgacgtgtgcttcatagccggtaataaaaccggcctgctcaagccgtttaacccgttgcaggcaaggactcggggaaagtcctactgcatcggcgagattaacgttgctgatacggccatctttttgtagttgcaccagaatattaatatcgatgcgatcgagtttcattaagccgttcatagcacccctcattgtttacagctgtactggatgttcgctactacccagagcgactctgtgtacacaagcgtaaagcgcacttttatagatacttaaaatacgccactctaaaataacaagtacgctacttttttgtaacacaaaaaaaccccggtctgtcacgctttgcaaaaattgcgccagcgttgaacccggcggcgaccccgctggccgcgataccgggctgttgcctgttcaatgagggagagcggctatcctaagcgtccagtcgcacgcgccagggcaatatcaaaaatatgcagtgcctcttcaagttgcgaatcggtggtcactaacggtgcaaggaagcgaatcgtattacggtgtaaaccgcatttaatcagcagcagcccttcctgacaggcgctgtcgaggatcttttgcgtcagcgcgctgtcgggtttgtgggtgtccacatccagaatttctactgcctgcataaagcccacgccgcgcacgtcaccgatgcaggcatatttatctgcaagttgacgcaaacgttgattcaactgctcacccaactgacaggaacgcgccagcaggttttcttgctcaaacacgtcaagcaccgccagtgccgctgcacaggccagcgcattaccgccataggtgccgcccagtccgcccggtgccgggccgtccatcacttcggctttacccaccacaccggaaatcggcaggccccccgccagacttttcgccatcgtcaccatatcaggcttaatgccgagttgctggaaggcaaacatgctgcctgtacgaccaaagccggtctggatttcatcacagatcagcataataccgtgttgggtcgtgatgcgacgcagcgcctgcataaatgctggcccggcgggcaggaagccgccatcgccctgcactggctcaatgataatcgcagccacgcgctccggcagaatctgcaccgcaaacagttggtccagcgctttcaggcagtccgcttccgtcacgccgtgcaacgggttcgggaacggcagacgataaacatcgccagggaaagggccaaagttttgtttgtaaggcgcggacatccccgtcaaggtgacgccaagtaaagtacgtccgtggaaggcgccgtcaaaggcgatgatgcccggtcgttgcgtataagaacgggcaattttaaccgcattctccaccgcttctgcaccgctggtgaaaaacacgctcttatagtgttcgtccccgcccaccagcttattcaggcgctgcgccagttcgatatatcccggataggccaccacctgaaaacaggcgtgcgataccaggcccagctggcgagttacagcgttaaccacagccggatggttgtggcccacgttaagcacgccaatgccgccgacaaaatccagatagcgattgccttctacatcccacacttcactgcctttggctcgctcaatcaccagcggatgagcggtaacaatgccgcgcggcacattatgatctcggacatccagcaactggctgttgtccgcataggtttgctgctctgccaggacattctgcatttttatacctcatccacgtcgtgttcgattggcttaagtatcgcaatctgtggggcaataacgctgccgtaattccgtcagcagcggcatttcgtgtcaaaatcccacgggtttcagcgagtaaatgttgttcccagcccgtggcaggccagggtaatcaacgcctggatgccatgcggtatcagcgcgtcgttaaagtcataggcggcatgatgaagcggcttgctgggggccgatcctatccatacataggcaccgggctttgcctgtaacataaaggcaaaatcttccgaggtgagtgcaggctggcgcgccagttgggttgtcatgcccgccgcctgcaaggccgccagggcctgagtcgcctcagattcattgttgatggtggccgggtaataacgcaaatagttcacctcggcctgtaacccgtgcgccgccgtaatgtgttccgccatctgccgcagccgggattcaataatgtcctgcgctgccgggttaaaagtgcgcaccgtaccggtgatgttggcttccgcagggatcatattgtgggaaaaaccgccctgcatacgcgtcaccgtcagcaaagccggttcgcagggatcgagcgcccgggaaaccagcgtgtttaactgcaccaccagttcactgacggctaacaacgtatcgtgcgtcagatgcggctgtgcggcgtgaccgcccgcgcctttgacagtgatatcaaaccggtctgccgcggccataatggcaccgggccgggtctgaatttcacccaggggtaattcaggccagttatgcagggcaaacaccgcatcacaggggaagcgctgaaacagaccgtcgtcaatcatggccttcgcgcctgccaggccctcttctgccggctgaaagataaagcagacagtgccgctgaactcaacttcacgcgccagcttttccgccgcgcccagcagcatggtggtgtgaccgtcgtggccacaggcatgactgtggttcgctaccagactggtccagggcacctcgcctttgtcctgcatgggaagcgcatccatgtcggcccgcagcccaatcatgcgtgagccgttgcctttcttcagcacgcccactacgcccgttttgccaatgtcccgatgcacctcaatgcctaaatcctgtagaaaacgcgcgacaatatcgctggttcgctgttcatggaaacccagttcaggattacggtgtagatcgcggcgcaacgccactaaatggtccatctcaatatcctcgtgaacgatcaacgacgccgtgcagcggttcaccacgctgaaagcgacgcagattagccagcagtgcgctgatcgcgctgtcgttttgcgtctggctggcgatgtgcggcgtgagccagattgcgggatgcgtccagaatgcatgatcggagggcagaggttcagggtcggtcacatcaatcaccgccgcccgtaactggccgctgtcgagcgcatccagcagatcctgatgattaagctgaggaccgcgcccggcctgcaccagtgcagcacctgctggcagttggctgaacagcccggcattcagtcgcccctgagtactgggcgtcagcggtagcaggcacaccagaatatcgctgcgggcgagaaagtcgggcagctgatcgtcaccatgccagcacggcacatccggaataagatgcggcgtacggctccagccgccacagtcaaatcccatcgcctgaagctgtgccagtgccgcgcggcccagttcgcccagtcccatgatcccgacgcggcgctgactggcgggaatagccagatgcgcctgccattgctgatgccgttgctgctgaaaatagcgtggcatatcacgatgtaatcccaacaccgcaaaggtgatgtactccaccatgccctgcgtcaggccgggttcaatcgttctgaccagcgggatatgtgacggcagcgtggacagatcaaactgttccgctccggcccctacggaaaacaggattttcagattgggaaaacggtctgcaaggttatcgggcggcagccaggcgaccagcgcatcaacctgatcggcatcgccggtctccggccagaggtgtaaatgaatatcgggcgcgtgctcagccagccaacgctgccagtgcaggccgcgctgtggctccgatttataaacgatgtgcatcaggccattgcctgcgtcatcagcccaaatgcctgcatgccttgtggcacccagacgtcaccgcgcaccatcgtgatcggcgcgtcaacgtttgtcaggcccaggctctccagccaggcggccagcggcagcgcggcatccgtatccatgcgcagatattcgcccttcaggctctgcatcagcgcggcggttagcgcctgggcaaccggaaaatcttgtgcaataacgggtccaatgacccagccacgaccaaagcgccgcaggctggcataaccctgaggggtttgctggttatcctgcaagataatggtctgattgtcggtaatcagatgttccaccagcgccgggcggaaaagcccgtgcgcggcctgctccatctgcaccagcgcatcccgatcgtcaggggtggcgctgcgcagcgtcaatccagccgggatctccactctgggtaacgcgttcagggcaggcgtttggtactgtaggatcttaccgcaggtaacaaagccgagtttttcatacaggcccttacccatctccgtcgcatgcagacgcacgttataaccgggcactttctctaataaggccagcatcaactgcttgcccagcccgcgcccctggtgctgattcgcgacaatcaccagaccgatggtcgcggccttgtcgccccagcgccagagaatcgcactgcctattacttcgccctgctcttcaatgaccacgccttcgccgagctgcatgccgatggcccagtcttcatggcggtgcggccagttcagcgcctggctcatcgcgtaaacctggggaatgtcttcggtcgtcatggtacgaatatcaactgtcattttgctttccttacatcatgccgggtgcatcaagtccgctgccgtcgataaaacggctgtagcgataaggcgtgggatcgaccaccggcgtggagtctgtcgccagttgagccgccaggcggcccgcaccgggaccaatcccaaaaccgtgggcactgaatcctgccgacaacaccaggcctggcagttttgccaccgttgaaatgaccggaatcgcgtccggtgtactgtcaatcatcccgccccaggcctgggcgactttcaggtttgccagcgcaggaaattcacgccgcattgccgcaagtccgctttccacgacccaggcatcggcagcggggtccagaatacgcatccgctcgaagggtgaaatcgcatccagatcccagcggcccatcgcctcagggccattaaagaacggcttcacccccagattcagggtaagatttttacgccgacttttaaacgtgggataaaactgtcgcaggtaacgaatcccctgcgcaccgggttcaagccgcccgcggcccgatacggaaacggtatagctgccatccatctgcggtcgacaggcaaagctttcggtataaaaagggacggcgatagcctgctcaatcgggtaggtacggaaggcggtgccaatgacgttccccagcggcaaatcaatgccgtgccgacggcaaaacatcgaggtccaggcgcccgccgcacagatcacccgggaggttttgatcaagccgcgttccgttatgactccgctgacgcgcccggctgaaatatccagcccgcgcactgcacactgctggaaaaccagcgcgccttttttttgcgcgccaatcacaatgcccggtgcagccagtttaggttcagccgcgccatccgccggggcggaaacgccgcccagccagtttgtggtactgcctggcgtcatggctttcgcctgctgggcattcaggatatcgctgcgcacgccgtactgtttggccatctggccccacttatcccaggccgcaatatctgcttcgttgcgggtggcatagaccagaccgctgcgacgaaagcccagctcttccccggtttcaatgctaagttcttcccagccgcgtaaggcttcaatcaccagcggcagttcgcgctcgtcacgattctgctgacggcaccagccccagttgcggctcgactgctcggcgccgaccagccccttctcgatcagcaccaccttcaatcctttttttgccagtacccaggtggcggcggcccccgcaataccggcaccaatcaccaccacatcggcggacgccgggaaatcactgctgtcctgtacgtaacgaatcggtgcgggcatggcgtagccacctcttaatctgtttgtttgccggtgccatgacgctcatcgcgcccggcgcctggatactgcctgtctgtcgaacgtgatcgacgacataacagcctgttactcagctttcagaatctcttcatgctcatccagccagccctgacgcagctcaggaaccgcgcgtttcaggcgttcgaaatagagttcactggtaggctggtcataattgctgcgcgccagctgagtgacgatgctgccatttcgcatcacgacgatctcatcacataccgcgcgcacggcgtgcatatcgtggctgataaacattaccgacaggcccagctcgcggcgcagttcgctgatcagatccagcacggcggaagctaccacggtatccagcgccgacgtgacttcatcacataaaatcacatccggttcagccgccagtgcacgggccaggttaacacgctgtttttgcccacctgacagtgaccaggggcggcgggacagcacggtgcgcggcagcttaaccagatcaagcagttgatagagtcgctgctggcgagcgatgccgctcagaccatgaaacagcgtcagcggacgcgttaaaatgcgttccacgctatgggccggattgagggctgtatccgccatctggaaaacgtactgaatacgtcgcagctcattgtcgctgcgtttttgcatctggcccgcaacagagtggccgttaaacaggacatgtccctggcaggcaggattgagaccggcaatggcatgcgccagggtggttttacccgagccggattccccgataatgccaatggcctgacctttccacagcgtgagattaatattttccagaatgcggactttgggcaatccatcactgccctttggaccgtaaccggctgacaggtcacgcacttcaagcaacggcagttcatccgcctttgcctgacaccagttgctgggccgctctttttgctgagcggcatccatcagcaggcgcgtatagtccgcctggggtgcaccaatcaaatgcgccgttgtgccgtattcggcaattttgccttgcagcagaaccagaatccggtcggccatttgcgccaccacggccaggtcatggctgacataaatcgccgttacgccacgttgtttcaccacccgacgaaaggcttttagcacttcaacctgggtcgtcacgtctaacgccgtggtgggttcatcaagaatgaccacctcgggatcgctaatcagggccatcgccgtcattaaacgctgtaactgcccgcctgagacctgatgggggaagcgatcgccaatcgtatccgggttgggtaaggccagctcacggaacagcgccagcgctttgaccttcgccgccttgcgcgtcatggtgccgtgaatcacaaccggttcgataacctgatcgatgattttcattccggggttaaaagaggcggcggcactctgggcaatataggacactttattgccgcgaaacatgcgcaactgcgcgggcgtgagatccatgatgttggtgcccgccacatgaatattgccctcggcgatcttgcaaccgtggcgcgcatagcccatcagcgccatcgcaatggtggttttacccgagccggattcaccaatcagcgccagcacttcacctttttgcaccgtgaagcggatatcggagacgatatccagttcatccccattgtcggtatgcgccgtcacgcgcaggttatcgacagaaatcacaggcattgccgtatgttgtgtcacgttcatgccccctcctttgccagcgtcaacggacgcatgctttgcaagctgtcaataaacaggttgaccgcgatggtcaggctggcaatcgctaccgctggcatcagcaccgccggtgagccgtcaaacaacccctgaatattttcacgcactaatgttccccagtcggcataaggtggctgaacgcccagccccaggaagctcaatccactcagcagtaaaacgatatacacaaagcgcagaccaaaatccgccaggaccgggtgcaccatgttgggcagaatatcgtggatggcgatgtaccagcggctttctccccgcaggcgagaggcgcggacatagtccatgttgcgtaagttgctggcgagggcaaaggcgatacgaaacgcacccggccagtaggtaaacaccgccgtgatcagcagcatcggcagcgaggacccgaacaccgccacaatcatcagcgccagtattttgcctggcaacaccagcatcgcgtcattgatacggcccagcagctcttccagccagcgtccggttaccgccgctaacaacgccagcatggtgccaatcaggctggccagcatggcagcgcccagcgccagccccagggaaaacttcgcaccgtacataatgcggctgagcatatcccgcccgaggtaatcggtacccagcaggttttcatgcgtcaatccgcccattaatggcccgaccccaatgtcgtcaagattgtggggtgcccaccaggtgccgaagatggcgatgatcaaccagaacaaggtcaccaccaggcccaggcggcccgataaagacagtgactgaaaaatacgccacggaagcaatattttcatcagctcctccatttcgggttaaaggcgatagtgacaatatccgccgccagcagcagcacaagataacagctggcaaacagcattacgcagagctgtaccaccggcagatcgcgattactgaccgcgtcgaccatctggctggccagacccggatagctgaaaatggtttcgataataatgaccccaccaaacaggtaagaaagactgagggaaatcgcgttagcaatggggccgacggcattcggtaaggcatggcgtaacaccgcccgcatgggggaaacccctttgagcaaggccatttcaagataagggctgtcgagctggttaataatggccgcgcgggtcatacgtgccatttgcgcgaccagtccacagcataacgtcatcaccggcaacgcataggctttgatgtagctggcgaagtccatactgggactgcccagcgacatcgcagaaacccagtgcagcttcacggcaaaaatcagcaccgcaatcgtggccaccagaaattccggtacggccaccgtcgccatcgtgccaatcaccagcgcacgatcgagtttggagccacgattcatggccgccgcgataccaataatcagtgcgagcggcacacaaatcgctgtggtagtggcagcaagttcaaaggtggcgggaagacgctgcgccaccagctgtgcaaccggcagatgactcgcaaatgaggtgccaaaattccccgtcagcatgccgccaagccaggtgaaatagcgtaccagcagcggctgatctaaaccgagctgctggcgcaaggccgctaccgtttctggcgtggcgttttgccccaggatcatttgcgccgcatcgcccggcagcaggctggtgataaaaaataccaccgccgagacgataagcaaggtcaggatgccggcgccaatgcgccgggcaatcaggaacatcatgtatcggttcatcggcgaactccttcgtcagacgattatcaggctgaaagccaggcaaactcatggaagcgatagcccattagcatgcccgatggccaggcctcaaggccgttaaccttcttgctgtagccatccattgaactgataaatgccgggatgagcgtaccgcagtggtcatagatcagggtttgcatatcaccgtacatctgcttgcgtttggctttatcacgctcaccgcgtgccgcaatcaccaactggtcaaactggggatttttccagccgctctcgttcgtggaggagcttgacaggtagaactgtgagaacagcatatccagcgttgggcgcgggttgatcgagccgtagcccaccggatctttcgtccagtgtgttccccagtagccttcatacggcacgcgccgcacgttaacgttaagccctgcgttgcgcccgacctgctggatgagctgcgccccttccgtcgcgccttccagcggcggcgtggtaataatctctatcgactgtccggtcatgcccgctttgttgatgtaaaatttggctttttcaggatcgagcggacgcggtttaagatcggcgttaaacagcggatgccacggcggaaccggcgtgtcattactgatatcgccaaagccctgcagcaccgttttcacgatgatttctcttggctgcaggtatttcatcgccagcacgaaatccgggttgctgccgggtttgatatcggtacggatgatcaggttggtatacatgccgcccttggtttcaagcaccgcgtgatccgtcgtatgaccaatgcgcatactgtctgaggctttcaggcccgaggccacctggatatcgccagacagcagggcgttgacgcgggcagcctgatcggtaacgccaagcagctccacttcgtccagatgcggcaggcccggtttaaagtagttcgggtttttggtgcccacggtattcacgccaggcgtaaagctcttgcatacgaaggggccagtgccgatccctttgctgaaatctttggtgccatcctgaacaatcaggaagggagacgtggtcagcatgtagggaagatcaaaattaggtgccacgagagcaagctgcacttcattatcgttgacggcagtgatggtcttgaactgttcagcaagcttgaatgcgctggaggcaacggcaggatctttatgacgattaagcgagaaaatcacatccttcgcggtaaaaggtttaccgtcgtggaaggtaacacctttgcgcagtttaatgctccaggtgatgccgtcgtcagaatcaaccgactctgccaggccgggcttaacggacatcgccttgtcaacctcggtcagacagctgtaaaacataaactggcgcgtgtagtcggcgctgttactgccttttgccgggtccagcgtatcggttgcagacgcgttagacatcccgacacgcagtttcccgccctgtacgggtttgctttccgccagcgccatgccggggaagccaatcagtcccgtgctcatcaccgcaccggcggagagtagcttcattaaactgcgacgagacaatgtgccttcagtgatcatccgcgtcagagcaggattggttacgtcagattctttattatcaattttactcatctgtacacctcattacgtgttcgagcgaacatggaaaattccctgcgttattcagacggcgcatgctgcattgcccatccgcgacgggctgttggtcgctctcggcgaacacaacaaccccgcaacggcctgaaaaacaatgtgaatttacgaaaggcgatcctttgctttgtagtagagcccggcaaggggcaaaaaccacggttttccgtgatagcccggcagtgcaggccatgtctgacgctgccaggggttgtcccggactttctcacttaacagatcggccatcacgcggcccatccataccgacatctgggtgccatgaccgctgtaacccagtgaataaaatatgccgtcctgttcgccagcgtgcggcaggcgatcggccgtcatatccaccatgccaccccagcagtaatcaatttgggtgttagtcagcttcggaaacatcttcgccattgcagcatgcaatatctcgccgctgcgtgagtccgaggtcggattactgatggcaaagcgcgcgcgtccaccaaagaccagacggcggtccgccgtggtgcggaagtagttaccaatattcatggaggtaacatagttacgatcctcaggcagcaaggtacggattagcccatcatccagcggctcagtgacaacgataaagctgcctaccggcacgatacgacgctggaaccatggaaacggaccttcactggagcagcccgttgccatcagtactttgtctgcctggatttcacccttgctggtcaccacccgatggcgatagccgtcaaggcgttccagttgggtgacgtgatggtggggataaatttttgcgccgctgcgtgccgcggcttcggccaggcccacaccaaacttgcccatgtgcatctgaccgccgcgctgttgcagcaatccaccgtgaaaatcgctactgccgatctcacgctgaacctcatctttactcagtaactggatatcggggtccaccgtgcgccgcatcaacgtgaaggcgtcctgcagtccggcaaaatgcgaggctttactggccagcttgagtttgccgcaccaccgaaaatcgcagtgaatctgctcgtccttcactaactgctcaacataggtaaccgcatcatcaaacgcccgatagaagcgactggcctgttcaagtccctggctggcaaccagcgaggcaaagttttgcgccacgccggtattgcagtgaccgccgttgcgcgacgaagcctgactcatcacttctccgctatccagcaccacaacattgataccgtttcgcgccagcgtcagcgccgcagacacaccggtaaagccagcgcctatcaccaccacatccgcctgtgacggcaacggcccctgcgcggcagcgctgaacgacggggcggtggcttgccagtacgattccagtttcatgtcgatgtcctcaaagaccgacgacgccaggcaggccgccaatgtctttaacttcggtgtattgataatacggattagccggttcatggccgcggttgacccagaccttatgcttaatgccaaggtcgtgggcggtcatcaggtcataacggaaactggatgacacatgcaggatctcgtccggacggcagtccagtttttccagcatgtattcaaaacctttcatatgcggtttgtaggcaccggcctcttccgccgtgatcgtcatatggatcggtgcgcccaggcgaggaatatgatgaggaatcaggtcattcatcgagttagtcaacagcaccagcgggaattctttcgccactttggctaagccagcggggacatcaggatgcgggccccaggtggcgcagtcagcgtaaataaaatcgctgtctgcctgttgccatttcacgccccactttttgcaggtgcgctgaatagcattgctgaccacatcgtaatagggtttccatgcacccatgacttcgtccagacggtagctggaaaaatcagtcacaaaggcgtccagcgcttctgcgtcgacacgatcggcgaaacagcgtttagccgcaccggccatgtcaaaaaaaatcagcgtgccgtaacaatcaaatgtgatgaatttgggtttaaacagtgccattgaattaacctcgttattgtcaggtgtggtgcttaaaaatcgatcagtacacttttctggcgctggcaggactggaaggcctggcgacccaaatctttgccaatacccgatcccagaaagccgccggtagggataataaaatcgccagagcgaccgtagcggttgacccagacggtaccggcttcaatcgcgcgtatcgcccgcatcgcccggggcagactcagcgtatgcacgcccgcgcacaggccatacgtgtcatgtgccgccagtgccagcccctgctcttcctcatcgaaggtctgaatcgtcagcaccggaccaaaaatttcctgctgaaccgccgggttatcaggcttaacctggcttaacagcgtgggctgccagaaccagccctcatcggtatccgcaaagcgttcgccgcccaccagcacttctgcgcccagggctttggcttcttcaatcaccgaacgcactttattgccctggcgtgcatcaatcagcggcgcataacgactggtttcctgccaggtgacgccgggtttaacctcacggcacaatgtcgtcagccgcgccgtgagcgcatcggcaatgccgcgctgcacgattaagcgtgtacccgctacgcaggcctgaccgccattagcggtaaagccgcgcagaatacgctgcgccagcacctcaatatcacccgcatcatcaaagaccagttgtggactttttccacccagctccagcgtcaccggtttcatgccgaactgcgccgcatcgctcataatgcgcgcgccggtcagggttgagccggtaaaggagaccttacggaccagaggatgcctgacgagcgcactgcccgttacggccccactgccctgtacaatattgaggataccggccggcaaaccggcctgtaccgccagttctgccatgcgtacggtagaaagcggcgtcagttctgatggcttgagtaccacggcattccccgcagccagcgccggtccgcacttccacgaggccatcgacaacggaaaattccagggcgtaatggcaccgatcaccccatagggttcagcaatcaacatccccaggctgttttcacgggtggggaacaggtcaccgctgtatttgtccgcgcattcggcatagaaacggatggcttcggcagtgaaaggaatttcgtgctgtattacgtcagcaatcggacgcgtcgagcccagcgcttcaagctgggccagcagccgatcctgctcaattaaatcggcccagcgacgcattatccgaccgcgttcacggggtgcgcagcctgaccagccgctggtttttaatgcctgatgggccgtcatgacggcatggtcaacgtcctcggcctgcgcttcatgcagagtggcaaagacgtgaccatctgaggggcgtttgacggcaaaagattcgccttgtgtttgcacatgtttcccgccgatataatggcccaacgggagttgcacgctttccgggtcgaaactcaacatggaagaatccttatttattacagccgtcacacgctggtttggttaaatttcggcaatgcttttctgaaatattaattaggtaatgcagaaagtatgccagccgttaagaaaattaaaatgcgtttaaaaccacgcaaaaaaatttttctgccgtattaatgacggatttattgcggaattgccgaagccttaaacagatgatttacctcacaaaaaagccgcattgctttggtgcattgcgcatgaaacttgcactaaaaaggagaatggaaggaaaacttagatctggcgcacaaaaaaaagcgccagcagagtgcttatgctggcgcgtacatttatgactaccgttttaaattacaggctgccgagatggaaagttttttgctccagatattcatcaattccgtaacgtgaaccttcacgaccaataccggataattttaccccaccaaaaggagcgacttctaaagagattacgccggtattaaaaccgaccatgccaaattccagcgcttccgctacccgccaggcacgacgaatattctcggtaaagaagtaagcgcccagtccataaggtgtgtcattcgccatcgccagtgcctgctcttcatcgtcgaagataaacagcggcgccacggggccaaaggtttcttcctgggcaatgcgcatctcacgcgtgacctgaccgagcacggtaggctgaacccaggtgcccgttccattgctgatgccgcctgttaacagcgtcgcccctttttgtaaggcatcatcgatgtgcgcattcaccttttcgaccgccccggtattgattagcggcccgatggtgcttccggctgcaaatccgtcacccaccttcagggtagcaacggcctccagcagacgggcggaaaagcggtcatagatgttgcgctgaaccagaatccggttggcgcagacgcaggtttgcccggcgttacggaacttgctggtcattacgcccgccaccgcaatctcaatatcggcgtcatcgaaaacgattaacggcgcatttccccccagctccagactcaggcgttttatgctgtcagcgcactgcttcatgagtaactgacccacgcgagttgaaccggtaaaagagatcttacggacaaggcggctttcggtcagcgcggcaccaatttccgtcggcataccggtgaccacctgcaagacaccggacggaaaaccggcgcgctcggccagtaccgccagcgccagcgcggagagcggcgtcaggtcggagggtttaacgataatggggcaacccgccgccagcgccggagccaccttgcgggtaatcatggcgatagggaagttccagggtgtgatcgctgccgctacaccgaccggctgtttcaacacgataattctgcggtctgaggtgggagcaggaatggtatcgccataaatgcgacgtgcctcttcggcaaaccatttgacgaaactggcaccgtacagcacttcgcctttcgcttccgccagcggcttgccctgctcggccgtcatgatgatggcaagatcgtccgcgttatcgataataagctggtaccacttctccagcagcccggcacgcgtggcattaggcgtttttgcccattcatgacgcaccgactccgcgtggttaattgccgcctcggtttcctcacggcccagcgccggaatggtggccagcgtgtcgccggtggccgggtcgataaccggcaaggtttcgccctgatagccattctgccattggcccgcgaacagcgcctgttggcgcagcagcgtgtgatcgtttagttgtatacgtgacatcccatccccctttgttcagatctttccactttatcgggtggggggaagcgcaggatgttgttattgccagccagaaagtgttcgctgagaggatttacggcagaaaaaaaattttatgccgtcacgatatgcagcctgatgtgcctgagcgttaaatctgaaaatcgatcaccggttcatcatcacccgctgatgaaagcgcctgctttttgatctcttcaagcgacaggttggcgttgcacagctcaagaaattgccagacgtagttgcgctgtagctgtccccgtttcaggcccagccataccgtgttggcgtcaaacaggtgcgtggcatccagcctgaccagctctccgcccggctcggtttcacaggcctgatcggccaggataccgactccgagaccaagtttgacataggtttttaccacatcggaatcctgggcgctgagcacgatgtccggttttaaacctgcaccctgaaaggctctgtccacgcgcgagcgtccggtaatgccctgacgataggtaataagaggatggtggctcagcgcattcagtgataccggttgctgctgaacgaggtcatgatcgcgcggcaccagcaaagcatgatgccagctgaaccacggaaatgccgccagactgccgttgttcaccagcatttcactggcaatgccgacatccacctctcctgccagcagcatatttacgatttcctgcggcgatccctggttgagttcgagccggacattgggataaagctggcggaacgccttgattaccggtggcagactgtatcgggcctgagtatgggtggttgcgatggagagaataccgctggattcattggtgaagacgtctgccagacgacggactttaccggcttcgtccagaattcgctcagcgatggttaacaacgccttacccggctctgtcataccgagcagtcgcttgccgcgccggataaaaatttcgacgccaagctcatcttccagatcgcggatatggcgactgacgcccgattgtgacgtaaacagggtgcttgccacctctgtcaggttgaactcccgccgcgcggcttcgcgaataattttaagttgctggaaattcacaccctttacctctctttacacaatctgataaccagagggtaaaaaggattatcgataacaggaaatactaaaaaagttttatttatgcatttaaagcatatgacacgcagcaggaaggaatgaatcacatcagggaggacagccagagaaagggcagtggcgcgatgtctccgcgccctgctttacagacagatcaacaaggatgagcgttagctgaccagcgtgagttcgcgtttttccgtcagcggcttgttaagcagcgacagcaggatatttttaacggcctgcgcaggcggcgataaaggcaaacggtgcgacaggttcagcgacaacggcaggctgatggtcggactggtaatgcgcgccatccacgcctgggttgatcctaccagcgcccgggcagccgactccggcaacacggtcacacccattccgcttgatatggcggcggtgagggttgaaagcgactctatttcgccaataatgcgcgcactcaggcgacgcagtgaaaacgcctcatcgacccgctggcgcacagcgctgtagtcgcgtggcagaaacaagctcatctgcgccacgtcggccagatccacgttggtcccaggacaggccgtggtgcccaccagatacagatcttctttcagcaacggcacgctgttaatgcctgccgtcggcgcacggtcatacagcacggccatatccaactgaccgttgatgatgttttcgtttagcgcactgctgctgttttcatgcagataaaccatgatatcgggatactgttcccgtacggtttgcagcagcggcatagttaaggctgaggccgccgttcccggtgccaggccaatcgacacctgcccgttgaccacctcacccgcattcatcactgctgactgtgccagttcgcactgccgcagaataacgcgcgcatggctgtagagtaatttcccggcttccgtcggcgtaacgccgcgcttggtgcggttgagaagctgctgttccaactcaccttcaagcgtagcaacctgctggctcaatgcaggctgagcaatatgcagcacttcggctgcccgcgtcaggctaccgatatcgacgattttcacaaaatatttcagccgtcttaaattcatcttgcctccgttgctacgtcaaggtgtctggctggtctctgtcaaccagcttgcataagagggaattgcaatatgcagaccaggtttattcagatcgcgaaacatgtcgggaaataattgctaagcatcagaataaacagcgtttatctgtaccaccaaagaggtaagtctgagagcgccgccgcattcaggcggcgacgcgaggtgagctgcaccgcaacagtgcgcaatatgtcaaaccagcgtgcagcgtcggccctgtgccagcaaaggttatcgacgtgccagcgcccggcccggttatgcaggagaaaaagcagaaagagagaggcgttgctgcgttgctgcgttgctgcgttgctgcgtgaaagtctaagactgttggctgagaagaaacacgttattgcctgagtggttgatcgattcgaaacgtcttcccacctataacgctaaatatactcacgtttttttaaaaggtcagaaaggcgaatacgcaaacgcatttgtgttgtagcaaggcagatatcctctggcaccagagaaaacccccacgggacttcggtaaaaagctttttagttttgctgtctcttgttcacctcagccagcaaagcgcgaatacgcaaacgcatttgtgttgtagcaaggcggcgatcctctggcaccagagaagacccccacgggattccgtttaaaagctttttagttttgctgtctcttgttcacctcagccagcaaagcgcgaatacgcaaacgcatttgtgttgtagcaaggcggcgccaggcgcttaggcccaggagcatagttaactatgtgactgggataagcgcctggtgccaacgccgctacggcgcaaaggcggcagcgtattagcgtttggcgcgattgcgtcgcatatcgatggtaactgcggcgacgatgatgatgcctttgatgatgtcctggatatacgcatccaccccaacaaaggtgaatccgcttttaatcagaccaagaatcaccgcaccaatcagcgtgccggtaatacgacccacgccgcccatcaggctgctgccgccgatgaccgctgcggcaatcgcatccagttcgtagcccacgcccatgcttgactggccgctgctgacgcgtgccgccagcaccacacccgccaggcctgacagcgcccctgcgatggtgtaaacgatgatcaggtatttattgacgttaatgccggacactttggccgaagtcatattgccgccgatggcataaacatatttgccgtaacgggtatgtttcagcgcaacgtgaaacaccagcgccacaaccaggaaaatcaccaccggcatggctccctgaccaatagaggtgaatccatcggacagaaaactgatggggttgccctgggtgtaatactgcgccagaccgcgcgcggagaccatcatacccaaggtggcaataaacggcgggataccggtacgggtaattaagacgccattgatcaaaccgcacagtaaaccaacgccaatgccggcagcaatcggcacggccgcaggcatattcaccagggatggaaacatcggcgtcagcgtttctgaggtttgcgccaggctggcagccaccaccgcagtcaacgcaatcaccgaaccggaagagagatcgataccggtcgtaatgatcacctgggttacgccgacggcgatgatgccgatgatagcgacctgtaatacgattaaaatcaggcggttcgtgttcatcaggaacgactgatcgcgaacataccagccaaaaatttcaaaaattaaggcaatccccaccatcaccacaaagatgccggtatcctttggaaccttgtgacgcaggtttgccaggaaagagggttgttgctgagaagcctgagcggccgtggctttcatattactcatcgtggtttcgcgcctcattcggatgctaacgacaaaatagtttcctgatcggcctcttctttatcgaggatgccggtaatgcgcccaccatgcatcaccatgatgcgatcactcatgcccagaatctccggcagctctgaggacaccataatgatggcgactccacggttggcaagctcactaatcaaacgataaatttcggcttttgcccccacatcgattcctcgcgtcggctcatccaggatcaggattttcggttgggccagcagccaacgggcgatcaagactttctgctgattgccgccgctcaggttattgatgatttgatccatggtaggggttttaatattcagacggcggatttgatccatgcagtcctgagccattttgacatggctgacaaagccgcttttgccgctgtattccggcatgttgacaatgctcatgttctccagcaccgacaacaccaaaaacaatcctgactttttacgatcctcggtcaaaaacgccatgcccttttcgatggcgaccgagggcgagtcaatattcgccgggatgccgtcaatcagaatttcgccgctgtcaaaatgcgccatgccaaacaggctttccatcacttcgctgcgcccggcaccgaccaggcctgccacaccgagaatttctccccgacgcacaccgaaactgatgtcggtaaagcggtctttgcagctcagatgacgaacggtcagcacctcttccccgatggcattattgaatttcgggaaaagctgtgtcagctcacgcccgaccattttggtaatcagagactggcgcgtgaacgcactggtactgtcactgcctacccaactgccgtcacgaaacacactaatctcatccgtgatggcaaagatctcatccattttgtgactgatataaacgatggctttaccctgctcgcgcagatcgcgaatgatggtaaataaatgtgcgacttcggtttccgtcaacgcagaggtgggctcatccataatgacaatgtcggcattccaggacaccgctttggcaatttccaccatctgctgtgaggcaatactcagttcgcctaccatgcggtcggctttcagtttgatattcagccggttaagcagcgcctgggtttctttattcaactgggcatggtcgacaaagccaaatttaaccggctcccgtccaagccagatattttcagccacggtcatgtgcggcaccagattcagttcctgatggatcattgaaacaccggaccgtaacgcatccatggtgtccctgaattgcactggctcccctttaatcttgatggtgccctgatcgggacggtaaatcccgatcaggcacttcattaaagtggatttgcccgcgccattttcacccatcaaagcatgtaccgttccggaacgtacgcgcagcgacacattatccagtgccttcacacccggaaagaacttgctgatgccttcggcttcaagcgcaaaagcggtcatacatcacctccgtactacgggttcagacgtttatttttggttcatagtggtgtatttggtgtagttgtctttggtgatcagctggaacgggatatcgacaatcttctgcactttttcaccgtttgccagcttgatggcggtctgaacagcgccttcaccctgcccttttgcatcctggaatacgctggccaccatcttgccgttcttgatcatctgcaacgcatccggtgtgccatccacgcctgctaccagaatgtgtttatcgttcttgcctaatgcctgaatggcaccaatcgccatttcatcgttgtttgacgcgatggcattgatatcatcgccagcggtcatccagttgctcacgacatctaccgcatcgttacggctgaatttcgccgtctgcttttgcaccactttaatattcgggtatttcgccactacggcttccacacctttggtgcgttcgcgggttgattcgttagccagatcacctaataagatggcaacattgcccttaccgttcatggccttcgccagggcttccatctgcaaacggcccgccagttcagagtcggagcctacaaaagccattttgtcgcctaactgggcctgcggtttacggtttacgaataccaatgccacaccggccttggacgcctgatcgataatcggttttacggcgtcagtgtcgactgggttaacaataatggcgtcgacgccctgtccaataaagttctgtacctgctggagctgctgggccacatcgcctttggcatcttcgatctggccttttacgccatcttttttcatctcattttgtacggcgttacgcacaatcgtcagaaagttgtcatcaaataccgccatagaaacacccacggaaatatctttcgccatcgcagcggcgggcaacatgcaggctaacagtgaggcaacaatcgtttttttgatgttcatagggacccttcttatttgttaacttgctagcgaataacgctttgaatgaaaaatattttttacattcgagccgcttcgctggcgtttttatggaaaatttgaggtaaggcaactccgttaatgctttttttcaatccaccattacttttcttatctacatgattttactaaataaggatgagaaaccctctttacgctggcacgtccatcccactttcccgcgccgaacagtttatttattccatatattttgtttttgaaatttttatcataaaagcactgaaacaagtgttttgatatcgtcaaataacaaaactttgacatgcgtctaacatctactgagaaatgggtttaaagtgagatcctgttagcagtttgaaaagcaagcgaatgtgtctgatattcgccaaagcgctgcttttacgagcacttgaacgcaaacgatgaaagagtgctttgacatcccgaactgacgccgctactattcgccccgttccaacaattcctctgtagttcagtcggtagaacggcggactgttaatccgtatgtcactggttcgagtccagtcagaggagccagattttgagaagcccgctcagggaaacctgagcgggctttttgcttggtgagatttagccgcatgatgatgggtggcagtggaatcgcgctcaggccagatgtgttgcgcttaatcaccttgattctgcggcgatgcgccccttccccatccgccacaccacgtgagcgcagtcgctgaaccagctaaggcgaatcacactttgcgcgacagcgctgtctcttgtttctttattcccgactcacgcgctgatagctgccggatgccagtcctgatttttcatgttgttcactccgcgttatgcaaacgcatcgcatcatccccttttgagataaatcagccagtgcgagatattccattttgggataaagatcgaaataaagcggtgtcgactatcaatacagaagaatatcaacgcgttgttaaagcattacctgatgtaagagtggcaaaaggcataacccagcaacggcgtgcttcgggtatttctttccccctcacgcatccaaaacgattcagctgccagaggtagctgactgtccagaaggtcgggcagttgagcgacagccgggcatttttgacgatgttcttcaggctaaaggacgttaacagcagcggatgctgactgcggctggctgaaaacgtttttaatcattaacgatgcctttggaagagaaataagacagaggcgttgtcggcacaacaggacgtaatatgcgcagcacaacactttaatttaattgatttattaaggtgagcttacgcgtttaccggtatctgtcatggggtcagctcgtagtgagatatccccagacgttaaaaaaaagcgttgttttgcgctttgtgaaaacggccccttaggttcatcagcactctgccgaaaacaacatgggtacgacaaaccataaccggagagaaagatgaagatatcgacacgattgtcggcaggatttgcctttttaatcctgctttttgttattagctctgcggttgccatgagcaacctgcttgaagcacgtcagaatattaatgagatcgtcaataccaacctcaaaaaagtcacactggctaatgatgcaggtacggccctgagaaacatgctggttgaggtgaggaacatggctctcttttctgataaatcagcgattgagaatgagtgggggcgctttgaaacccaaaaagcggcttatactcagaaacgtactgagcttgccgccatgatcgagagagacagtaaccagaaggaacttggcctgctcaggaaagtgcaggaaaatgaacaggctgcgctcaccacactcgccgccgctgccaacatgggcaggcagaggcaactggatggccttgctgcttatctgacaaatgttgttcgtcctcctcagcaaattctcatatccagtctgaatgaactaacagatatgcagcgggcgtttgctgaaaacacggcggtaaaaagtaatgactccgccagtcgcgttattaaaacctttattgcgctcattcttgcaaccgtcatttccggagcagcaatttgtgtgtttattagcaggaaactgatgcggcagctgggtggtgaacctggtcaggcacaggcgctggcagctactattgcggccggagacctgagttccaccgtggtgctgcgtagcaaggataccaccagcctgctggcctcactggacagcatgcaagccagactgcgcggtctggtctcgcagataaaagacgcctctgcctccgtggcgctggccgccgatgaaatcgcccaaggcaataccgaactgtcatcccgcaccgagcagcaggccgccgccctgcaggaaaccgctgccagcatggagcaactgaccgccacggtgaagagcaataccgcaggtgctcagcagaccgctgaatcggcacgcggcacggcccaactggcccgctccggcgagtccgacgtgcagcggatgtccgcgacgatgcaggacatttcggtcagcgccgcccgcgtgcgggatattacctcggtgattgagagcatcgcgtttcagaccaatatcctggccctgaacgccgcggtggaagcggcccgcgccggtgaagaaggtcgcggctttgccgtggtggccggtgaagtccggacgctggcacagcgcagcgccacggcggcgcgcgacatcaaggcgctgattgagcaggccgttgaccaggtggaaagcggcgtggccgtggccgcctcgaccgggcagagcatcatgaagattgtgggcatggtcggtgagctggcggaagccatggacaacatctcgctggcgtcatccgagcagatgcagggcatttcgcaggtcagcgtggcggtgagccagatggacggcgtgacgcagaacaacgcatccctggttgaggagtcatcgtcagcctcccgctcgctgtctgagcaggcgcaggatctgcggggcatggtggaggcatttcgtgtctgagaactcatcgccgggtgcatggacgaatgagtgttcttctttgccttcacatgcagccacaacccgcagtactgtgaatcatgggttcctgcgcggcgttatcgcattcattgcgaacgtctgaaaagaatccccctaaagtcgccaacgttttaccctgtcgaacctgcttatgcgtgagttctgcacagcgaatctctgagaggttcgctgcttactgcaacaggctgggcgctttctcttcaatcagaaatcgcacgttgcctgtcagcgagggatcatgtctgcacgttatcggcactggcaggcgcatagttccccaaacgtagtcaggctaatgatctaaacagacaagggtttgtagctaaaccgctcgttctttcagcgtatacagacaatgacaacctcagccagcggccagcatgaataaaacccgcccgggtttcccggcgcgggctttacgcgacgacagtcagccacttttccttcgcgattacaacacctctgcccacgtcataatcagtttggcctgcacaggctcggccagcagactggcatcgggctgccagctgtcccagtcgcggaaagcactgaaatcaagcccggccagcgtttccagcgagcggacagagacacggtattcgtccacctgcggcaccgcttccggctgcaaggacggcaacacgcggcgcggctcatccagcaacttatcctgactgaccagcaaggcggtcgcctgcggtttgccctgtggcccgatgcgcagaaccactttccagaacatcagcggcacctgtaactctccatattgccgatgttgatcgttaagtatcggtccggtcagcacgctaatctgctgtttggtcttgagcacgccatattccaggatatagcgctcaacgccttgccagtactgcacgctctgattaaaacgaaaatgctgcggtgagcagttggtaaaatgaaacgtatctttgttggcgcgcaccgcttcagccgctgtgccccaggtgggatcgctgcggcgagtaagatgcccgcgatcgaaccagcggctgaacgcgctatagaacgactgcccggtaacgtagcggctgtcgatacggctgtcttcagaccagcgatcgccttcggggagcagagaaggctgcccgctgccacggtcaatgttgatatagcgcgcgccatcaatattggtcgcagtgaaaaaagccagcttacgttcagcgttcatcagcagggaaaagtgttcataatccagcctggcctcagcgcccttgcgcccgtcacgcaggggcgcgacttcaccggaacgcggggcgataatcgcggccatatcgatgtgggtatcagccagaaagtccgcctgaaaaccgtcgcggttacgataattttcgtctggcgcggcggcacctggaagtgcgtagtccggtgcgggttcagccttgagtgcctgcatcaggattgcctgcctgtcagcaggcagcgtcggcagttcgcctttcagccagtcagtgagcgcgctgatgcgaatgccttcattgacccatttgccgttgtcctctatcccgccatgatgaagggccaccagttgccagccatcgttgaataccggcgcacccgacgagccgccttcactgtcggcttcgtagtgcagaaactgttcgtgacgggctaacagcgcattattgcgcagcgtaatttgctgtggcgcgccagacggatgatggatcagattaaggctgatgcccagtgcatgtttatcgttgcgatcgttaagcgccagcggcaacggattctcagcgctgtcgttaagcgcttcgccaagcgcgactagcgtgcagtcaaacgcgtccgtcgggctggtaagccaaaagcgttctgcatctacgctataaagacgcccctgaataagctcgtccgcctcgccctgacggtagccgaactgaagtgtgatacggcctgatgctgcggggtcagacagcagatgatggttagtcacaaagaggttgccgtgggtgagaaatccgctgcctttcggcacgccatcttctctgaccagcgccacggctttggccgcgcgcaatccttgctgcaaaaaagataccggtagcagatcgttcgtgccgatgatgacaccctggcgggcgcgttgctgaaacgcatagcgctgcgcgcgtcgttgatccggctccgcctgctggccctgactgagcgctgtgcgtgtctgctgtcgttgcccggccgttaccgccagccttgcggctatctgcgctttcagttgctcgttcattcgcctctccgtgataatgttatgcacccttttaaccatagctgctgcttatcacggcacaagcggcgcgaatatcaccgcgcgcaccaacgccctgccctcatccttaaggccaggttaggtatctgaaaggcgattgaacgaatgcttaaatggaaccttacaaagggattattgcgggcgaaataaccaggctgttgaaaccttcagcaaagggttcagaagccggtaaaaccgctttgactcagcatcctgactccattagtatgcgccctgtagcacgattcctctgtagttcagtcggtagaacggcggactgttaatccgtatgtcactggttcgagtccagtcagaggagccagatgtatgttttcatgcatcttaacgaatctttatacgattaagattcaacacgttagcgtgaaaattctttccgatgcattttcattttcccctccgcatcgggaaagattggtggtctgatttggggtcatttcagttcgataatggcgtaaccactctacgtccctgaacgacacgacaatccgcagcgtaaaaccatccgctaaaccttacaaagtttccgattctcatggcctgtcccttttcgtcaatccagccggttcacgtctctggtgtctcaaatttcgtatcaatggtaaagaatcccgcctcggcttaggtgcctatcccgatgtttctctggcttatgcccggcagcaacgtgatggcatacgcaagctgctggcgcagaaaatcaatccagcacagcaacgtatcgccaggaaagctgcccgctcaccggaaaaaacgtttaagcacgttgcattgggctggcataagcgcaacagaacatggtcacagaaccactccgtccgtctgcttgccagtctccggtttttttcctttccatatacccgggtcagtcccgcagattgtcgttttggttagtttaataatagcatcagtagcttccataaccgttggacgaaccctttcctcaacacgaatatcatttcccccgtgataaaccattgctttcatttttctttgcatgttaatcacccttctctttttttataaaatcgctccagtttaaataacattgaaaaaaaatactcacaaaattatcttagttttgaaaaactaaactattggggattagctcacaaaaccagcgtgatattaattggcattaaagtccgccacccgttattaataacttagcacccacatgagaccgctattaaaatagatagaaaacacgcctggtgagaaagattatccgattaattttggctgaattggttaacagattggctatattgcgcaatgacactttacttttaaatccatatcatttttagcgatcatgtctatattgatcgtatgcgcaaaccgtcatatccctaattaacaacttgtggcgatatcgaacccattattatgatgttcaatgcaatggacatgatgtgcagcgcattgacgccgacaattacggaaattcagcatgttcaacaggcagactgtccttgtactcatatcaaacggttattatccgcgcccatcgtgtgtggtagtgggcatgaagtatgcgctggcgataatctcactgacattctttgttctttttccgagcatgttgcaagccgaagagataaccgttcatcatactcaggggataaccagcgtaccggtcaagcccagggttgtggctgtacttgatatcgctgcactagataccctttccacgataggggttgatgttgcgggcgttcccacactcaactatcccccttatctcgctaaatttggggaaagccgttaccggaaggttggttcacttttcgagcccgattacgaagcacttaatgcgctgtcccctgacctgatcatcgtggggggacgttcatcacccaagtacactcaattagcaaagctcgcccctaccatcgaccttagtcctgactttcaacaccgggttgacagcgccatatcgcatgcgcagcttcttggagaaatatttgggaagcaagccgaggttgaccgtcgtaccagcaagctacgtgcaacagtagaggcacttcgagcacaaacgtcgaaaatagggacaggactgctggtgatgaccagcggtggacgcatcgcggcgctcggcccaaactcttggtttggtacactttataacgactttggcgtgcaacccgtgacgcgcaaactggatgatggccctcacggccaggtgatatcctccgagttcattctcgaaacgaatcctgactggctttatgtgattgatcgtgacgcggccataggggaaaaaggagcatcagcccaacagctgctggataatgaactggtgcgtcaaactaaagcctggaaggctggtcacgttgtctaccttgatcctgtcgcatggtatattgttggcgacggactcactgcgcttcagtcaatggctgatgaagtttccctggcaataacgaagacaaaatgacgtctccagcgcacgttgacaaatcgtcagtgaaaggacttttgatcgcactgagcgttatcggattgctttcccttattagcctctttatcggtgcgacgacaacttcgcctgtatcgctttttgcaggcaatacgacatcgactataagcattctgctggctagccgcattccgaggacccttgcattgctcctcgctggaagttccatggctgttgctggcctgatcatgcaaatgctttcgcgaaaccgattcgtggagcctggcacagcaggtacgattgagtccgccactcttgggttattgctggctgcgctactggcccccgggctgcctgtgctcgcgcgcatgcttgtggcatgttgtaccgcccttctgggaacactgctgttccttgtcatcctgcgactgtcgcccatgcgctcgccattaatggttccgctcgtcggcctgatgctcggcggcgtaatcaatgcaatggcgacatttcttgcctaccgcttcgaccttattcagtccctcgtagcctggtctactggggacttttcatcggttctgcgcggccgctatgaactactgtggatctcatttggcgcagccgtcctcgcttacattgcagccgacaggttcactgtggcaggacttggacagaatttcgcaaataacctgggcctgaactatcggctgacactcattaccgggctggtcatcgtttcaatcgtaacggctgcagtggtcgcgacggtaggtgcaattccctttgtcggtcttgtcgtgccaaatatcatcagcatgatgataggcgataatttgcgcaggtcagtaccctggaccgccactctcggcgccggtttcgtactgagttgcgacattctaggtcgctccgtaaaccaacccttcgagatcccagtgggccccatcatagggattgctggcagtgtgattttccttttcatcctcaaaaggggagctgcacgatttgattgaatctcaagagataagacccgttatagtaatcattttgctcgctacactgacattactcttatcagtggctttcatgacagtcggtgcaggaggacattggtcttttgtgctacctcttcgtgcacaaaagctcgcagggcttttgttagttggttattcgatagccgtctctactgtgctattccagaccataacccagaatcgtattctgacgccatccgtcatgggtttcgatgcactgtacgtatttattcagaccttagtggcattcaccataggctatgtccacgacgctaccatcaacccatttctacgttttgcagtcgagacattcgtcatgatcggttcagcaaccctgctctatagcagactcttcgccggggggcgcagagacctgatgtttctggcgatggccggtctcgttttcggtgggctactgcgaagtctgtcaaatttcctgcagcgtgttatcaatccgggggaattcgccgtcctgcaggaccgcctctttgcaagcttcaatcttatcgacgccagcctgctatccatagcagcaatacttgtccttagcgtctcgctgacaggctggagaatgcggcacagctttgatgtgttggtgctagggcgagacaccgcgatcaatttaggcattgattacaaacgaacggttagagccatcctgatgatgattgccatcctcgtatcggtctctacggcattggttgggccggttactttcttcggcctgctggtagccaatctaacttatcgttttgtcgggaatgcgcggcatgctctgatgctaccggcctctgtgctgatcgcgatgacgtgtctggtctgcgggcagtttgttctggagaggctatttggctttaataccggcctgagcattataattgagttcttcggcggtattactttcattatattaatcatgcagaaggcgcgatgataaaaacgcacgcactcactaaacggtacggcacaattacgactgtggacaacgtctcagtgagtatacctaaaggcggactgacatccatcatcggtcctaatggtgcaggtaaatccacacttatgatgctcattagcaggttattgccagcaaccagtggaacagtgacggttgacgagatgaatgtcgttaacacgcccacgaacatacttgcacaacgtctggcaattctacgccaggataaccataccagcgtgcgcctgaccgtcagtgacctggtagcttttggccgctacccgcactcgaaaggacgtttcacccaagatgatcgagagcatattgagcatgcacttgagtatctggacataacatcgttgcgcgattgtttccttgacgagctttcaggtggacagcgccagcgcgcctttattgcaatggtcctgtgtcaggacaccgattacctgttactcgatgaacccctgaacagtttagacctcaagcatgctactgctacaatgaagattcttcgaagagcagcagacgatcttggtaaaaccgtcgtattagtgcttcatgatatcaactttgcttcgtactattcagatcacattattgcgatgtccgcaggcaaaatatattgtgagggttctcctgaccaggttattagagctgaacgtctcggccaactttatgatatgaaggttagtgtccatgaactgagtgggcaacggatagtgacttactacgaatgatatacaaaatattttaacgttgccctttcagacatctgaataaactgttttcgtgaaaaaaaagcattaataaatataaatcacatgcaaatactttcatgaaaataatgtaccgtgttaaacagttgagagaaaacaaggcgaatgtgacgggtgctggtggtcctgacaaccgccatttttcggtttcgcttgtcattcagccagttaatggcaaaggcgatcctggtgagaggagcaagatttagagaagcccgctcagggaaacctgagcgggctttttgcggggtatcgctaacgcaccttgaaacccgattgatgttggcaggcaacactttcagatggcctcactgtttacacatcgatcatgattgccttcacgcgacgggcaacgtccatacatttccctttccagacgggcactgatcaataaaaaattcgtttatcaatggtttatagatcggtaatcaatcgggatgctagtgttctggctgataaaaaatttataatatgccccccactgagaggcagttgatgagtacgcgctttctttattttgccttaacagtattgctaactggatgtgtagcacggtctcatgaacccgatccgttacaggtgcagttcgctaattatggcacgctgcctaataactataaaacgctagtcaaagatacgttttattatcatctaaaagatccctatagcgcccattatcgttttttccagccctatagaggatattcatggatcatgaatgttcccgaagataaagaagaattgatgttcggttggatcattcccggcatggttaacgctaaaaacagttacggagcctatgtcggtcagaggaagttcattgtgatttattcaaatggccaatatcacaaccttaactacatcaaaggtacaaaaaaaattggccggccgctttaaaactacatgagcttttggccgttgagcaagccgggaacgtatcggcgtgacatcaggatagagccaccatacggagtatgatggccaggcgataacagaacctggatttaccagagccatggtttcattatgtgcttttaatcgggtaggtcgttaaaggtttaatttcctttaagacaaacatgctttgcatctctttgatacgcggcagcctgcgcacgacagacatggcgaaatcggcgtacgagtcgaggtcggttgccaccacctgcaacagaaagtcagcgtcgccgcctatgctgtagcaggccacaacgtcctccagtgcggtcacctgctgctcaaacttttccgcttcagcttcgctgtgacagtcaatgaccacccgaataaacaccattaccccagagccggttttttttcgatccagtaccgcccgatagccctgtatcacgccctgttcttccagtttgcgaactttgcgccagcacggtgaggcggacaggccaattttatcggccagttcctgattggtgatgcgcgcatcgccctgcaatacgcttaaaatttttatttctgtcttgtcgagtgccatagaggtcagttcctttccgattaaggcataaaacaggtaaattcttgcaaagagtaaggcatatcgacgtgattcagacaacccatttctggtcagctccggcatactgtattcaccctgtgttgtgtgcggtgcgagaggtgaatgcattacagacaggatgaaacgcaacgaagtaaggcggataagggcattttacttcgcctctgagcgagcgtgctgtcagggctacaggactcgtgaacagacgcatacatgtcatctaaagaaaggaaatgctatgcctgccaatgcagaattactgccttatgttttggcgcttggcctggccgccgcgattcctggcccgggcatgacggcgattgtcgcgcgcagcttaaatggcggttcactggccggcttagccgccctggcgggcgtgataatgggcgatctgttttatctcacccttgccgtttttggccttggcgtggtcgcgcatacctataccgctctctttaccctgattaactgggcggctgcactttatttgggttttctggcctggcagttttggtcttatcaaccccatgcaatcaacatcgaccagaaagtgacgcgtcagcaactggcttcagcctggctgtccggtctgagtattacgctgggtaaccccaaaacgattgctttttatctggcaatactgccgctggtgatttccctggagacgatctcactgaaattttgggggacagtgctggtgcccgttaccgccgcggtattactggctgtcggcgcaatgtttatattggcggcgatgaaaatccgggtttttctgaccagcccgcaatcgctgcagataatgtacaaagtggtaggcgtgattatgctgctggccgccatcggtatgatcgtaaaaacgctgtaatgcagcaataacgtcagaggggaaaaggtgccgctgccttatcgagaacgcacctcagaacagactgattaatcctgattggccgggggattttcccctgtcggcgcaacagtattgtttcgctgtggtagtatcagcctcttactttctcgttatcaggcaacccgttgagcactatgtcggacactacgaaacgcaaaaacgatcccgaagggcttaaaaaacgcattctggctggtgcactgaaaacctttgccgaatttggtatgcagggtgctcgcctggagcagattgccgagaatgcccagaccaccaaacgcatggtggtttaccattttggcaataaagagcagctctatatcgatgtgctggaacaggtttatcagcagatccgggaacacgaaaccggcctgaatctggcggcaatgcaacctgagcaggccataaccaaactggttgaggccagttttgattaccatgtttctcatccagactttattcggctgatctgcatggaaaacctgtcccgcggtcgctatatcgcgcagtcagcccgcctgggccagctgaaccgtagtgcgctggatctgctggatgacatcctcagtcggggacagcagcaggggctgtttattcaggaagtcgagacgctggatgtacatcgccttatcagcagtatctgcgtgcatcaggtatcgaaccggttcacgtttaatactctgttcagccccgacaaagatgaagcggacattatccgtcgtaaccgccagttagcggtcacggccaccctgcgttatatctgtcgctagcggccagcatcccgggcgtaaaaagcaatagtctatgcttaagaggtatttttaatatcacttaactaaggactgcagtttgagcagagacgccaacctttatccgctacgccagacccaccttgatccgcacgatgatgctgtctggaactgggcgcaaaatgcacaaattgggacgcgccagcaggtaaaacgccccgctgatgaagccgcgcttcagcagttattgcgtgaatccagtggcaaggtacgcgtgaccggcaaaacctattcccctggcagaatgttgtccgtgcacccggacgagttgctgctggatctcagtgcgctgaccggccttgtccgcagcgacgagaacagcgtgaccttcgcggctgccacaccgctggaagacatctacagcaccttgaccgacatggatcgcatgctcgcctcttcgcccggcgtcatttccgtacagacgctggcgggcgcaatggcgaccggcacccacggtcagggcctgcaacagagttcgattgccgatgaagctgagcacatccgcatggtgctgagcgacggttcagttcgtgagctgtcacgtggcgatgcggattttgctgctgcgcaggtttcccttggcgagcttggcatcgtcactgaggtcaccttgcgcacccagccttttcgtattttcacctgccataaaaatgcggttcccgcagataacctggaaagcgatttgctgcgctggaatgacgaatacgaactcagcaaagcctggtggtttgtggatgacaacctgatgcacgtgtggaatgcgcatcaagccagtgaagacgagatccagcattatgagaagaatggccgtgaagtcgtggagcacgctgatgaaggtgatgacagcctgaacgacaccatcgatcagacgctggaacatatgcatcgcgacacgcagattcacggtaaaggcggcaaacagttccgcaccgtgacacgttttcgggattttaccgatgtcaccggcgatatctatcagctgttctgtcgcggcattgccgtgccgcagatcaacgtagagatcggcgtgccgctggaaaaaacaccggcggttatccgcaagattaaacgctggtatgccgaaaatcgcccgcacatgcactatccaattatcctgcgctgtaccggtgcctcatcggcctggctgagcccagccttcgaccaacccacctgcttctttggctttgtggtgtattacgccgatgacggttccctttctgaagcgggcctgcactttttaactgaggtggagaaactgctggcagaagaaggcggtcgtcctcactggggcaaatattatgatgcctcgctgtaccgttggcaggatctctatccccactggggagccttccgcgccctacgggagcagcgcgatccgcaaagccgccttagcaacgactacaccaccgcactgtttaatgaaaccgataagggatgatatgtttgcctgggtaaccttactgacgcaaccggattatctggtgggcgtgaaagcgctgcaccgttcactgatgcaaagtaaaacgcgctggccactggtggtcatggcaaccgatgccattgatgcacaagactgcgccgcactggaagatgaaggctgtgtgatccatcgtgttgacggactttatccgcacagcgatctgaacgcgcactatgcgtctgaacgcttcggggaagtctggaccaaactgcgtgcatggcagttgaccgattatcagcgggtcgtgtttctggatgccgatatgctggtcttacagaacatggatgaactgttctcactggatctcggtgacaactttcttgctgcctgtcatgcctgccgctgcaatcccaaccagatcgacgcctatcctgacaactggcaacccgaattctgtcactatacctggcaggaacgtgaggaatcgccacccgcgcatctggatgactacctcaacggcggctttctggtactgaagcccgataacggcgtgtttgaaaaactggaagcccgcattgcggctatcgatgacctgagcgagtacaccttttccgagcaggatttgctgaacgaggcctttaaaggccagtggatgccgctctcttatgtttacaacgccctgaaaacgctgcgtttccagcatgacaaactgtgggaatgtgacgacgtcaagaacctgcattacattctggataagccgtggcagcgcgatctgtctcagcctgtcagtcagcgcgatcgctactatgcgatggacaagctgtggtgggataaagcgtcagcctgatcaacgctgaccggccccgacatgatgctcggggccgactttatgttgtgcagccataagtatgatgtaactaagacctataccgccttccagcgtctttctgctgccgacagggctatcgcctccagcaccttctgcacctgcaatccttctgcaaaatctggccacatgcggtcgcccgcagcgataccattaatcaaatcgcgaatttctaccgttttctgatcgttaaagccgatgccatggcctgccgaaacgcagaagttagcatagtccggatgcgcaggcccgattagcagcgttttgaagccctgccgccctgccggttcatcatgaatatagagctcaagttccgccatgcgctcctgggtataacgcagcgtgcctttggtgccggtcacgacataggtcagccccatcttggcgccgcaggcgatgcgcgaggtttcaattacgccgtgcgcgccattgtgaaagcgcagcaaggcactggcctggtcttcattttctaccggcaactgacggctcaggtcttttgggtccgggcgggttttaatcaccgtcatcatatccccactgacttcagcaatgttgcctacgagatagtgcgccatattgacgatgtgcgcggccagatcccccagtgcacctaacccggccagcgctttctggcagtgccagtcgagcggcgtttccggcttcgccaggtagtcttcattatgggtgccataaaaatgcaccacctcaccgatttcgccccgcgcaatgatttcttttgccagctggctggtgggattcttcatgtaattgaagcccaccagggttttaacccctgccgcattggccgcctctaccatctcctgcgcatcggccaccgtcagagacagcggcttttcagaataaacgtgcttgccgttggcaatggcagccagcgccatctctttgtgcaggaaattgggcgcgcagatgtctacgacgtcaatattcgggtcgcataccagcgcatgccagtcacccgtggagcgggaaaagccaaaggtggcggcctgctttgccgccagttcgggattaacctctgccagcatctcacgcacgatctccccttttaacgcaaacaccgccggtgcctgggcataggcgatcgcatggcagcgaccgatataaccgctaccgatcatgccgattctgactttattcattttgactccgggctgacagagaaaggattaaatgaaatttaaattccatttaagggtatttcaaactaaaaatgaaataactgtgacgaacctaaagaacattcgtgcaaccaggcctttcagagtcgttaagaaatggaacagagattctgtttattgaataaaaggtgcagtttgcggccatttttggcggtcacaaagcagagcggaacggctgaaccgcgggagttggcgagtatttcagcaattagacagttttgtgaaaaagagctttgacaagcctgcgggacgtcgataatatgcgccccgttcaaacgattcctctgtagttcagtcggtagaacggcggactgttaatccgtatgtcactggttcgagtccagtcagaggagccaaattttaagagcccgctcagggaaacccgagcgggctttttgtttttttattttacccaccagcgctgacggacgtcaggtagaagaagacggcaagtcgtgctggatgctaaccgggctggcgcgcagggcttttatatttaaccaggcgttgctacctgcgtgcggcaaaagatgaagatcgtccttaaggcgttttttggcctgacgcttcccctttatgacttatcgatccgcagcacaatacatcccaggctaatttctgccgtcacccgcgtgccggtttcaaatccgacttcacgcagccatttaccacttatatttagcgcaggtgtgctggtatcgccaaaattaggcacatagccgactttgtatcgacgctgggttttaaaagatactgagacaggtgcagcatcagaaggtcttaagttcatagtcatttgcaagctcctggttaagaggatgattccatgataagaggtgcccttttcaacggtgatgggctgaccgcattgtgaacgtctgcttatactaaacccgcgtacctcataacttactgcgtccttaccgcgcaccttagtgtgctctcacacagcccacgtgataatgatgcgtagcaaagctgacgaggtttaaaagacgcaggctcgcatgatatcgccgggaaagttttcgctgcagacgtcccgtcactgggttttgcaagtgcccgtaaacgatagcgtttttgacgcctgccaacaagccagactctggaagcctcctcgcataacgctaaaaatagccccctttctgcacgatcccctgccgccgtcctgtgctttaataaccccagcgatcgtgccagtgcgcgctgtaaggacagtgcttaacgacgcagtgccatgagcagtgaatttctgattgacgtaaggatgtaaaaatcccttccccacagcgcggcggttttttggtttgcccatcgacacgttacacgcgatggaaggcctgcgtctgactcttcgccccggcactgtgcctgagcgagtgggcaaactggttagcggaaaaacgcctcaactcccactgggctgggtcgatttcgccctggcgcagacggtgtaacctggaggccggactcgacaccggtattcatggtcgttgcatatgaggggtaatcggaaccgcaggtccgccaaacaagcagcggccgaccctgagaaattcacctcagggcgctgtacagcctgtcattttattaggaaaaatagcggattatgggaattttaagttgataagagtactgtactgcgtgcgtgacagacttagcggtgactggtttctgaaaaaaactttcacaaacgggttgctggtgccatacagctcgacacgcttatattcattgtgaataaactgctgcaggatagtcgccatatcctgcgccaggtccggtgtcatcgcgttatgagaggctacggtttgctcaaagctgagtggtatgcgcatttccgtatcaggtttaaaattggcacgtttacgttcagcttccactttaaactcttcaaaggcttcgtgtgttgaattgaatgtatcagccagcgttttgatatgtgcagccatctggttaacagcaaacgttctttttgtgacgaaatagccgcctacactcgaagcgatggacgcaataacaggaagagaaccacgcccaataatacttcccagaccatttaaggctgaccataaggccatacctgtcgcgccggtagagctggctacagcacctgtcacaatcatactcgcctgctgtacttttacgcccgcaatacgattatccaggcgacgaatctccccgcccggttttctatgcgacgcagactcttcattccagcttttgaagcggcggttattttcatctttataattcgacatcgcataggcaatctggcttgtttccgttttactgagctgggcgatttcttttggctcaaacgatctgactaaaatcagggcttcttcaagcacctcttttgtcagaaaattagcggaacccgcagggttagaaccagggtccgtagtaaggccctcaataaggttaactttgggaaatgccataacgccctctctgtttgatgccgcctgacgaagtgattagctttctttattttgtttaatatcccagcccatctgcaccgaggctgctttacttccctgagaagcctgctcccagtattccagtgccactttgctggcctgaaatgcgtattgcatccccagcgtggaggcgtgaccgactccggtaaagtcagtctgtgtcaccaatacatcttgcagcgtgatacgggtatactccacttcctgtccgcccgctttacagacagacagttgaacttttggcagatgtttaccggtggcgcaatatttcactaacgcaggcgtggctttatcgatcaatgcctcaacgcttagatcatgataattaactttccctgctccaccgccgccgccaacagccatattgcctggctgctgcgctccccagttaaatgacaggacatcaatccattttttatgattcgcattttgcgattcgccttcgattccatctatttttaaaaatatatcaatagccatttttcacctttatatttcagggcagattcactcagctctctttattttgtttaatatcccaaccggctttggtttccgcgcctttggtgccgcttgcgctttgttcccaatagctggttgaaactttggatgcctgaaaagcgtagtcaaccacaatagtgtcactttgcccgatgccgttgaaattggtcgcggtaaccagaacatcttctaatacgattttggaatactcaacctggcttccaccggctttacagacggacagttcaacttttgaaacatgctttccgctggaacagtatttaagaatggcaggcgtggatttatcgattaacgctttaacacgcagatcgttgaaattcactttccctgcgccgccaccgcctcccaccgccatattgccgggttgtgaagccccccagtcaaatgacagcacgtcggtccatcctttatggttgctgtcctgggattctcctgtggtaccttcaactttcaaataaatatcgatcgccattaattttttccgattacgttgtgatgaggataaaacgggcgttgcaatccgttatgttcagtaggtttcgacaaaatttagtgccatttgatattaaaaaatataaagcagcgtgcaatgactgtcgtagcgtgcgaacaagaaataaaaagacgcctgcgtgttttacgcagtgaaaatgaatatgtcaggatatctaaaatagaggtatccttttgaagatcttgatacattaataaaattaacatgacttcatgtcaattaatttacaactcacgctaaattattgggataaatctgaaagcaaatatttttgaaaggttatcgtttcaagaggtaatagttttaaccaaaacgcggcactgccatcgacctaatcggcaggcgttgggagtgcgagggctgccgaagtggggtgattattgaataaaaaaaccccacgcaaccagtgctgcgtggggttatcaatcggcgctggaaccaatcagggcttaacgccagcccagctccggagccacatacttcagaatcgattctatgacgtgcgcattgtaatccacgcccagctgattcggcacggtcagcagcaaggtatcggcttcagctattgcttcatcctctgccaacagcttgatcagtttttccggttcggcggcatagctgcggccgaaaatggcgcgggttttctcatccagaaaacccactgaatcctgatcctgtccactgcggccaaaataagcccggtccatatcatttaccagtgcaaaaatactgcggctgacggaaacccgtggctcacgctggtgccctgccgctttccaggcttcacgataggcgcgaatctgtttagcctgctgaatgtggaacggctcgccggtttcatcatctttcagcgtcgagctttgcaggttcatgcccatcttcgccgcccatacggacgtagcgttggagccggaaccccaccagatgcgatcgcgcaagccttcagacagcggctccaggcgcagcaggccgggtgggtttggaaacatcggctgtggattgggtttggcaaaaccttcgccacgcagcgcatccaggaacacctcggtgtgacgacggcccatgtcggcatccgtctcgccttcctgcggtgcgtagccaaagtagcgccagccatcaataacctgttctggtgaaccgcggctcagtcccagttgcaggcgaccgttagaaatcagatcggccgcactcgcgtcttccaccatataaagtggattctcatagcgcatatcgataacgccggtgcctatttcaatttttttggtgcgcgcgccgacggctgccagcagcggaaacggcgagctgagctgacgggcaaagtgatgcacacgaaaatacgcgccgtcggcgcccagttcttctgccgccacggcaagatcgatagactgcagcaatacgtcctgagccgaacgggtggctgactgagacgaaggtgtccagtggccgaatgagagaaaaccaatatttttcatctgtgacgtctcctgacgaaagacggttgctttcgcgttataaaccgtaatgcacaaagggtacgccagcttgtccatcactgatagtgaatatccttaagcgctacgttcaagaattttgacataaggttagcctgccagtccctatcctgttggcgttcaggttgtaatattacttgcgagcgcgttgggttttgacgcataacagaaattgcggcgctgtgttagggcagacgcttttcatacaaggatatcggatgcgcattttaatggtgggtgccggagcgaccggcggatattttggcgcacggctggtacaggccgggcaggatgtgacctttcttgtgcgtgagcgccgtctcagtcaattacaagaaaccggcctggtgctgcaaaccccatccggacgcgaagtcctgcaaccgcagttagtcactgctcctgcgctgaacagcccctttgacctgatcattctgaccgttaaaagtaccggccttgagcaggcgttgcgcgatatgaataacgcggtcgggccagaaaccctgattatgccgattctcaacggtatgcggcatttcgataccctgattgcccattttggcgcagacaaggtggtgggcggcctgtgcaaaattaacgccacgcttaacgaacagggccatgtggtgcagctcacgccactgcatcagctctattacggtgcgctggatggccataacgacgcacggcttcagcaactggatgcggcgctacgcacctgtgcggtagagacgttttttaccgaggatattatcagtgaactgtgggaaaaatggctgctgttaagcacgttaggcgcggtctgctgcctggcgcgaggtaacacgcaacaggtgctgaacgctgaaggcggcgagatgctgcttcagggcatttacgctgaggtgcttcaggttatttgcgccgagggttatcacccccgccctgccgttaccgccaaaatttatcagtggctgaacaatccggccacgccgatgacgtcttcaatgtatcgtgatttgacccagggtttcgcgattgaagcagagaccatcattggcgacctgctgttgcgcgccaaccgtcatagtcttacggtgccgctgttgaatgcggtgaacgttaacctgcaaatctatcaacagaaccgttaaacacggaagtgatgagaaagcagccgcgccgttgcaggacgcgcgggtaacggaattttgttacactcgctgcctcatcttatggaggaataatgacgtcccgctctgtgacccttgatgatgttgcccaactggctggcgtttcctatcaaactgtttctcgtgtacttaaccggtctgagcaggtctccccccgcacccgagaaaaagttgaagcggcgatgcaacaacttaactatgttcccaaccgggtcgcgcagcagctggcgggaaaagccacccgcaccctggggctggccaccagcaatctggccctgatggcaccggcgcaaattgcctcggccatacagcagcgcgccgccagagccggataccacctggttatcgccatggacagtgaagacaaccccgaagccacggtgaatgaactgatggcccaacgtgttgatgcggtgctgattaatatccctttagaagcggctgaggcagaaaaaatccgcgcgatgtgtggcaaaaaacccgtactgtttctggatgccgatccgcatgctgttgtctctcactgccagtattcaaacgaacaaggggcacgagccgccgtggcgcatctgattgcccttggacaccggcaaatcggcctgctcaatggccctgtgcgctcgatatcggcgcgtcagcgcgaagccgtctggcgtcaggtactggccgatcatcagctctccccctgctgcgtactgcgcggcgactggagcgcaaaatcgggctatcaggccatgctgacgcagctacccgatgccctgccccaggcgctgttagtggcgaatgacgagatggcgttgggcgcaatgcgggcgctgcatcagcacggcgtggcgatcccggccgatatttccattgtggggtacgatgacacggcggaaagtgcctggtatcagcccccgctcaccaccgttcgtcaggaccttcaacaacttggcacccacagcgttgatcgggtgctggccgaactgcgcggtgaggcggtgacgtcccgcatactggagccggttctggtgatacgggaaaccaccgccgtacccgccagccaggacctggacttatccgatctggcccgtcagctgcagcagattgcgcgtaagctctcgggttaagcgttttagcccgccatgcgggcgcaaaaaagcccgcccaaccttgagggttgcagcgggccggtgatatcggtaacggacgttctgcgctagcggcgcgccattacggcgcttttgtctcacccacgcccagcgtcttgagctttttagacagctcacggcgctctttagacaggtcagcatttttgatgatgtattcatcaacgcgatcttcatagtcagcacgcatgctggcgatgatttcctgaatcgcctcaacgctcatgccgggtttaatgtattcgctcaggttatccagcagcagtacgcgcttttggttgtcacgaattttcttctcattatcgacaatttcacgctgcagtttgttcttgcggcgaaacgtacgcacaaactcaagtacgtcctgaaatgattgcttggcattttccatgatggcacctttctttaagcctgctaaagcagggagagagtcaaaacgatcagcttagcggctagccagccttatgggcaattctcacagctaaattcggactggctcttatcttagcgcaaaaaaaccgggtttcgcattaagtcattgtctgaggtgattatttacgcagcgccagacgcatcaaatcggtcatgcgctccagttgcttcgccagctccagactcagccagacatagccgtaaatcggcgtttcctccagacggtcgctgccgtcggcgatcaactgcttaagttctttgacgatttctgttaactcatggttggcagcaataatgtcataggtttcccccttcaccgccatcaccgataaggtgcgtaacgcgttttccgtcatctgctgggtacgacgcagcgccggcgcgttcagcataatcagatggctttcccgcgatgcccaccaggcattaatttgcatctcaatggtgtacaccatattacggttaatggtctgaatcgcttcaaacaccgaacggggaatgcgcgtttccttactggacggctccagtaaagcccgcattttgatcacgctggtgagcagtttaccaaacggcttgttcagtcgcggcttgtccaccaggttggccgaaaaccccgcatgatagatttttgccatctcgcccagcgtatccgaaagttggatacgccagtgaatatacgcgcgttgcgcccagacggcggtaaatatcagcgccagcagcgagcctaaaatcacatcgccaccgcgccacatggcaacggtgaaatcccccaccggcgcgcctaccactacacagagcgtgatgccaatcaacaacgccatatagggatgttttcccagggtcagatagccgctgataaacataatcagcccgcaccatgccagcatgcccggcagcgaaatgatctccagcttgagcgcgattaatcccgaaatggaaccggcaatcgtgccaccaatgcgctgaatggcgcggggaaacacattgccccacgtcgagatcggccccatgacgaccaccagcgtaatcagcggccaggtgccttcggggatttcagtgatgcggacaaataaaaaagcaaagagaaacgcgaccgcgatgcgcagaccgtgcacgctgcggtaatgacgatacaaccagaattccagatttgagatgggcttatcagagcgcaaggtggctgtccgctggtaaaaaggtgattctacgcgatgcgccctgtcagtcctggcgcgccgtcaatattttagtgaatgcctgaagcaatgggccattatctccgacccgtgaccgtaaatcagcaaaattaaccgctcagttggccaggcggtcctgaggcaggcgatcgcccggcacctgcccgacaggcaggtgcgcgtagcgtaagattaaaacttacgtttcagatagtcagagaggcggctaactatgcccgcttcgtttacagcgctgagcgccaccagtggataactggcaatctgcttatctttgtccatcacctggatttccccaatgttttcattggctttcagcggcgcttccagatcggtacgttgaatgacgtatttggctttgacgttcgggatttcactgcgcggtagcgacagatagacgtcctctgccgtgcccacttccacctggtgcggattaccataccagacatgctcgctgccaattttcttaccggcatggaacagttgcaccgtgtcgaaggtattctgtccccagaccagcagcttgcgggcctgctcttcgcgccctttggcacttttaccgcccatgatcacggcaatcagacggtgctgaccgacgacatttgaagccacaatgttgaacccggccgtttcggtatggcccgttttcagaccatcgacatgcaggttgttatcccacagcaggccattacggttgttctgggtgatgccattccaggacagggttttctcacggtacatggcatagaaatctggctcgccgctgataatggcgcgggacagttttgccatgtcccgcgcgctggagaattgtcctggtgcatccagaccgtggacggtttcgaaatgggtatttgccaggcccagtttctcaacgtagtgattcatcagcttaacaaaattgtcctggctcccggcgacgtaatcggccagcgccacgcaggcgtcattgcctgagtcgatgatgacgccacggctcaggtcgcgcacagtcagtttatcgcctggcttaagaaacatcagcgaggaacctttgaagaccggattgcccgcagcccaggcatctttacccacggtgaccatatcgtcgcgggtaattttcttttgatcgatcgcgcgatcgaccacataaccggtcatcagtttggtcagactggcaggattgcggcgctcgtcgggattgcccgcggtaagaacctgccccgtggtggcatccatcagcacccatgacgcggcatcaatcgccggtggcgtcacgggaaacggcatatcgtcggcctgtgccagcgaagcccaaaaaacagttacggtaattaacagacgccttttcaacacttcatccttagttgcgcaaataaaacagacgggaacagccggacgttttacggcaaaagccttaataaggtttaaataaattgaaaaaaaatatgaactgctgcgcgccgttacgcagcattgccctgcacggttgtgctgaagcgcgcagaagactatcctgaacattgattttttgcagacaggacagcgacgtgcccgcctctgaattaactttcttgttccacgattacgaaaccttcggcaccagtccatccctggatcgtccggcgcagtttgccggtttacgtaccgacagcaacttcaatccgattggcgagccagaggtgttctattgccgtcctccggatgattacctgccccagcccgaagcggtgatgatcaccggcattacgccgcaaattgccgcctcacgaggcgtgagcgaggctgaatttgccgcccgcattcatgccctgttcaccacagagcaaacctgcgtggtgggctacaacaacgtacgttttgacgatgaggtgacgcggaatattttttaccgcaacttctacgatccctatggctggagctggcagaacggtaactcccgttgggatttactggacgtgatgcgcgcctgctatgcgctgcggcccgaaggcattaactggccagaaaatgaagacggctttcccagcttccggctggagcacctgaccaaagccaacggcgtggcccatgaaaacgcccatgatgcgatgtcagatgtgtacgccacacttgccatggcaaaactggttaaagagaaacagcccaaactgtttgagtttttgtttacgcatcgcaacaaaaacaaactcattcaactggtcgacatcccccaaatgaaaccgctggtgcacgtttccggtatgtttggcgcggcacgcggcaataccagttgggtggtgccgctcgcctggcatcccgacaaccgtaatgcgctcatcgtggtggatctggccggggacatcacgccgctactggaactggatgccgacagcctgcgcgcgcgtctgtatacgcgcaaaagcgatctcggcgatctggcagccgttcccgttaagctggtacatatcaataagtgtcccgtgctggcaccggcaaataccctgcgaccagaagatgccgagcgtttgggtatcgatcgtcagttcagcctggataacctggcgacgctgcgacaacatcctgaggtgcgtgaaaaactggtggcgatctttgccgatgcggaccccttcacgccgtcggatgatgtcgacacccagctctatgatggtttctttagcgatgccgatcgggcgggcatgaacattattcgccagacagcaccggcgaatctgcccgcgctggacctgacgtttgacagcccacgcgtggctaagctgctgtttcgttaccgggcgcgtaattttccgggcaccctggatgatgccgagcagcagcgctggctgcagcatcgacgcgaggtgctgaacccggagaaagtgcagtccttcctgatggagctggaatccctggccagcctgcatgaaagcgaccaggaaaaagtggcacagttgaaagcgctgtatcgctatgcgcaggaactggtgtcctgacactcagactggccggggaaagctaatcgcctttcccggccaacgcatcagatcacccaccacagcgcccaggtcagagcaaaaccacacagccccatcagggtcgtcagtaccgtccaggtttttaacccatctgccaccgacaggcccagatagcgggtcaccacccagaagcccgcatcgttaacgtgagacagcccaagcccaccgaaacaaattgccagcgtcaccagcacccgatgcacatcatcaatgccgccgacggcctgcgtcagtaagccactggtggtgagaatcgcgacggtggccgatccctgagaggcgcgcagcgccagtgacagaataaaggcggcagggattaacggcaggtgcagtgtttccagcgccagggccagcgctttacctacgccggactcaaccagcaccttaccaaaagcgccccctgcgcccgcaaccagaatcacgctggccgatcccggaatcgcccgtccggtcaggtcttccagcttatctttgctccagccacggcggatgcccagtagccaggcagccagccctaatgcaatcaacagcgcaacaggcggcgtgccaatgaccgtcatcactttccccagcaggctgtctggcgccagcagtgagtgcgacaacgtgcccagcacaattaaaacaatgggaaccacgatcaggccactgatggtcaatgcgcccggtggggccggctcatttttcttgatggcaccttcaggcttcgccatctgtaactgttccagcacctcgactgacagatgatactgacggcgattcatcacccgggcgacgtaataccctaaaataccaaccgggacagagataagaatccccagcagcatcagccagcccatatcggtgtgcaaaatcgctgccgccgccgccgcacccggatgagtgggcaatgccacatgcaccgttaacatcaccccggccatcggcaggccaaactttaagggggaaacccgagccaccttggtaaagccgtagatcaacgggataacgataataaagcccacttcaaaaaagaccgggatgcccagaataaacgccgccatcgtcagggcggcaacggtccgtttcaggcccagggttttactgaagcgctgggccagcgactccgctccgccggaggcttcgataatggccccgagcatggcacccagcacaataataatggtgatatggcccagcagcccgcccatgccgctgataatcgtctccatgattttttcagccgggataccggtcgctatcgccaccagcaggctgacaatcagtagcgcgacaaaggggtgcactttggctttaatgaccagcagcagcagaatcacaatgctggcggtcgcgatggctaacagcaacgcagtcgtcatggtaaacctctgagtaaattatcttttttagaatttttggctacagctcaacctgatgctggtgcgtataaaagacgaccagaactgcaccggtgctgacacaccggtgtgatgtttatcaatgctttagcggttttttgcccagggcgagaaccagttcagcccctgaacggtgtccccgcgcgggatatactcacagccgatccagccgtcatatcccacctcatccagtaagcggaacagccagggatagttgatctccccttcgtccggttcgtggcggtcgggggccgcggcaatctgcacgtgccggtaacgtcccgcgtaatggcgaatcagatggctgaggttgccgtccacgatctgggcatggaacagatcaagctgagtaaacacgttgggacggtcgatcaggtcgaccatctccagcgtctgatactggctggcatacagatagcgcggtttcgtcgtgggatttaacgcttcgattaatagcctgatgttatggggtgcgaagcgttctgcggcgtaacgcatattgctgacaaaggtgtcaacgtactgctggcgatccgcacccggcggtacggtggccgccatgatatgcacctgggggcagtcaagcgccagcgcgtaggccagcgcgctgtcgatatcggcccgtgcctccgcttcccggccagggatagcgctgacgccccattcgccagccgcaacgttgcccggtgccgtattgaacagcaccagctttaggccgttgtcatccagcagcggttttagctgctcagccgaataatcataagggaacagaaactccaccgcctcaaatccggcctgtgcggcggcggcaaagcgctgcaggaacggcacctcgttgaactgggtagacaggttggctgcaaactttggcattatcggctcctgagttcggcgacgtcgtcagcgctgagatagcggatggcccgatcgcccagagtaaagatcaggcgcgcggtctcttccagttcttcggtattgtccgcggcttcctgcagagatttacccaccacgaccgggccatggttagccagcaaaaacgcacgatagcgcggtgccagctgtgccagatcttccgccagtcgcacgtcgccgggtttgtagtaaggcacaaccggcacatcgcccacccgcatcaccacgtagggcgtgaacgggcggatgcagttctggctgtccagattttgcaggcacgacagcgcggtcaggtagtggctgtgcagatgaacgaccgcctggcagtccggattgttcaggtagagcgcccggtgaaaggcgatttcttttgagggcttatccccggcaagccattccccctgtaacgtgaccgttgacagacggctggcatccagcgctcccaggcaggagccggtgggtgttgccagcagattgccgtcgtccagcagcagggaaaggttgccggctgacccggtggcataaccgcgctggaagaacgacgcaccgagtttgaccatctcttcacgggcctgttgttcagtcatggggaaactccgtttgcgcgcgacggaaaaagtgctcgtcgccaaaattaccggatttgagcgccagcgacagcggctgctgtatatctctgacccagggaacacctggcgagatcaccgggccaatatgaaacgcggtgacgcccaggctttgggcgaccacgcccgaggtttcgccgcccgcgacaataaaacgctgccagccgcgggattgcagttcccgggccacctgcgcaaacagctgctcgaccgcttcactactgcgctgcgcgccatattgctgttggatcgactgcagctgttgggcctcggcggtggcaaataacatcggggccagcggtccatcgctattttctgcaacccagtcacaaagcacctgtgcgtaatgttcatcactgagacaacgctcgacgctgatcgcctgggctggtgcctgctgttgataggccgtgacctggcgatgagtcatctgtgaacaggagccggacagcacgacggcccgctcaccctggggataaccggcacgctgcgcctgacgtttatcgccgctgtcgcctgaccactgacgtgccaggccaatcgccagcccggagccaccggtaaccagccgcctgtcctgcagcgcctggccctgtgctaacagatgctgctcactgagcgtatcaatcaccacatagttaacgccctgctcgcgcagttgatccagctgctgctttatcgccatggcaccctgatccacggtggcggcagaaatgagaccggctgttcccgtactctgactttccatcagccgtagcagattgctgtcactcattggcgtaaccggatgatgacgcatgccagagtcggacagcagctgttcaccgacaaacagatggccctgataaacggtgcgaccgttcaccggcagggccggacagattaccgtttgcgtctcattcagctcagccagcagcgcatcggtgaccgggccaatattgccgccgcgcgtgctgtcgaaggtggaacagtatttgaaataaaaacgttcacagccttgctgttgcagccagcgcagcgcgttgagcgacagtgccaccgcctgatcagccggacaggaacgtgacttaaggctgatcacaatggcctgcgcatcagacggcgcgtccgcctgagggatgccgttaaactgaatcgtggacaggccgttttgcaccagaaagctggcaatgtcggttgcgccggtaaagtcatcggcaatcacacctaaacgtatcatgctttctcctggcgctgcggcagcgtaatcccgctgaagattttaatgaccgcgctgtcatcctcgcacccaaaaccggcattgctggcttcggtgaacatagtgagtgcggtggacgccagcggcagcgggaaatgcagggcttgcgcagtatcggcgaccagattcaggtctttcacaaagatgtcgacggctgaggttgggcggtaatcgccgtcaacaacgtggcgcatgcggttttcaaacatccacgaattccctgcggcattggtgaccacctcatacatcgtatccaggggaatcccggcgcgggcggccagcgccatcgcttcggccccgacggcaatatgcacgccagccagaagctgatgaatgatcttgaccgtggaaccctgaccgatttcgctcccgacgcggtaaaccttcgccgccaccgcgtccagcaccggctgcaacgccgcaaacgccgcatcgctgcctgacgccatgacggtcatgtcgcctgtcgcggctttggcggcaccgcctgacaccggcgcgtccagcatcaacagttgatggtcagccagcccttgttcgatttgctttgcatcctgggcggacagggttgaggagaccatgaccaccgtgccgggtcgaagcctggcagccagtccctcttcgccaaacaggatggcgttaacctgcttcgcgttgaccaccagcagcagcacggcatcaagctgctcagcaaacgcgtgcgctgaggtctgcgcatcgcgcgcgccagcctgacgcagtgtctccagcgccagcggattcagatcgacgccccacgttgacagccctgcccggatacacgactgcgccgcgcccattcccattgaacctaagcctatgacacagacttgtgaaactggcatcggtggcctcccttgttaaattaagtgaatttttgatttctgttgttgatagtgccaataaagtgcgcacaaaaacgtgccttaattcacataaattaacgcaaaaggatcgatgttaaacatttattcacactgggaatgcgccggccccgactgttcactgcctttaacagccggttcagcgggggaaaccgcgttaaaatttccgtgtgtctacgtgagccgatgctctacaatgtgaaaaaatgataaatcgaggtagttatgatccccgttgagcgtcatcaacagatcctggctctggtggcagagcgcggcgtcatgagcattgccgagctcacggagcggtttggcgtgtcacatatgaccattcgccgcgatgtgcaaaagctggaagagcaaggcgcggtgctgtcggtgtcgggtggcgtgcgttccgctaaccggctggccagtgagccctcgcatctgaccaagacggccctgttcaatgagcagaagaaggcgataggacgactggcggcccagcatattccgcgcaacagctgtatttatctggatgccggcaccaccacgctggcactggcacgggaaatcgccgagcgggacgatttgttagtggtgaccaatgattttatggtgaccaatttgctgatggagacaagtcgttgtcgggtcattcataccggcggcacagtatgtcgcgataatcgctcctgcattggcgatgcggcagcgcgcagcctgcgccagttggcgatcgatattgcgtttgtttccacctcaagctggggactgcgtggattgtttacgccggatgaagataaagtggcggtgaagcaggcggtatgtgacgtcagcagcaaacgtgtgctgcttagtgacagctctaaatacgacaaaatcgccacctggctggccttaccgctggagacgttcgatgtcattattaccgacagtcagctgaatgcgacgggacgcgaagcgttgagtacggggagctgggaattggtgatcgcgcgggaaaactgaatggatgctgccctgctctgctcccgtcatcgggaacagaacagggccagggtcttacacttcttcgctaaactgcggaacaggattgcggaaactgcgggtcacaaacgccagataaataataccaatggcagcccagatcaggcccagcaccattgagctttgctccaggtttacccacagcgcacccacggtcagcgcgcccagcatcggcagaaccagatactggaagtgatcgttaagggttttgttacgtttttcacgtacccagtactgcgcgatcaccgacaggttcacgaaggtaaaggccaccagcgcaccaaagttaatcagcgcggtggcggtgaccaggtcaaagttaatcgccatcagcgccacggcgccgaccagaatcacgttcagggacggcgtgcgccatttgggatggatataaccgaagaaacgctccgggaagacaccatcacggcccatcacatacatcagacgtgaaacacccgcgtgcgccgccataccggaagccagtaccgtgaccacagagaagaccaggataccgacctgcaacgctttacccgccacgtacagcatgatttcaggctgtgaggagtccggctctttaaagcgcgagatgtccgggaagtacagctgcaggaagtaggacgccacgataaacatcaggccaccaatcagcgcggtcaggaaaatcgcacgcggaatggtccgctctgcatctttggtttcttccgacagcgagctgatgccgtcaaagcccaggaacgagaaacacagaatggtcgcccccgtaatcatcggcaccacatgggcgttctccgaccagaacggcttgctgctgaccacggttcccgcgccttcaccgtgcgccacaccgtaaatcaccatggccgtaatcccgaccatcaccacaacctgcaggatcacaatcacgctgttgaagttggcaacggttttgatgcccttaaggttggacagcgtcataaagccgaccaacagcaccacgaaaatccacgacgggatacctggcaccagggtttcaaaatagttttttgccagcaggatgttaatcatcggcatgaacaaatagtccagcagcgatgaccagcccaccataaagccgacatgcggactgattgccttttgagcgtaggtataagcggagcccgcagatgggaagcggcgtaccagcttaccgtaactcacggcagtgaacagaatcgcaatcagggcgaaagcataagcggtagcaacgtgaccgtcggtcagacccgagacaatcccaaaggtatcaaacagggtcatcggctgcatgtaggctaagcccatcatgacaaccggcaataacgtcagcgtttttttcagttgagcacgttgtggtgcagcagaggtattaagcgacatgcttcagtcctccttgcgcagcaacctgactgggttgactcacaaggatactgcgcattaagcgacagggagtaaggtttgcggcaagcgcggcgccgtagtcgtcacgaaaacgtgtaccagcctgagccggtagagtattaaacatccccatctttacatcctctatctcacgccaatgcgtgttttcagtgtttatctatccgggtacgcgcccggcctcggttgtgtcagcgaaaattcactctgtgataacgtgcaaaaaaataaccggcgcggtgagcgtcggttatgttctgaatttgcagggggcgtattttgccccaacccaacgcattatttcaagacgttgtcgcatagaatgcaaaatattaatcaggcgttctttaacatccaatcaatttccgtggaagtgattaacctttcgaactgcattagttcataatttttacagctaaaccacactttggcaaacttctcacccagtaacttttgtaaagggttgctgttttcaaattcataaagggcatcactttgccgtatcggtaatgccagcccttccgcctcatgaccgttaccttttaccggctgcggtaaggagagcggcgtatcaagaccgtgcaacatcccggctaaaatcgctgacatcaccagatacggattcgcatccgccccggcaacccgatactcaatacgacgactttctatatcgccacaggggatgcgcagcgccaccgtgcggttgttatggccccaggatgcctgtaacggcacataggcttccggtacaaaacggcggtaggcattcacgttcggtgccagtagcgccatggaagctggcattaaatcaatcatgccggccagggtgcgtttcagcagcggtgagtcgctgccgtcgtcgcaggcaaaggcattatggtcggccgcatccagcatactgatatgcacgtgcatgccactgcctgcatagtcctcatagggcttcgccatgaaggtcgccgtcatgccgtgattttcagccacctgacgaatcaggcgcttaagctgaatggcgtggtcgcaggcgatcagtacgtcccgtgtatggtgcaggttgatttcaaactgcccaggcgaggcttctgccagcgcgccgtcggctggaatcccctgcaggcgggccagcgtgtcgatatcccgtagtacatcggagaagtgatcaaggttgtccagagaatagacctggctctgcatattgcgctcgtcgctgcccggcgcacagggcggctgaataaagccttcggcatcgcgctttttatcgaccagatagaactccagctctaccgctaccaccggaaaaagccctcggttacgcagctgttgccacagccggttcaggacatttcggggttcaacgtcaaagggagtgccatcttggttgcacatggttaacagcagttgtgcaatgtgttgcggatcggcggcagagggaacgagcgtatccggaatggggaggcaaagattatcgggctcgccgagagactgtcccagcccggcgtcttcaacggtgttgccaagaatatccatggcaaacacagaagcggggaagtagcagcccttctccagcttcgctaacgcggaaaccgggatgcgcttaccacgaaaaacaccatttaaatcattcagtaaaatatcaacgtactgcgtttcagggtggcgctccagccagtttttcacctcttgctggaacgcgctggttcgtctctcttcactgtgcaacgtgaagtcttctacttctaccaggttagtcatgatttcatccgcctttaaccacaaaatgggagtgcgtaatgctcaaaaaaacggccacacctctaacatagcgctaacacaaaaagtgtgcaaatgtaacaaatctgtttgaagattcagcgatgggttgctagattgacaaaatattgcacacttaaccgtcagttatgcccttttcgtcaaatattttgaacagctgttgagggggaagcatgggcattatttttgacaagccgttgattggcgtagtgatgtgccagactcatcaccagggccatcccgtccagtcggtgcataataaatatcttgatgctgtcgttatcgccggtggcgcgccgctcgctctgcctcatcagcttatggctgccccgcatctattagaaaacgctatggctgcactggacggcatcttactgaccggcagcccaagcaaccttgaaccctggctgtatggtgaacaaggcgaggaaccggacgcggatgcaggacgggatcgtctggcctttaacctgattacgcacgccgtgggcaaacagctgccgttatttggcatttgccgcggcatgcaggagctggtggtggctaacggcggtgcactttatcgtcaccttaatcagcatccccagtttcagcgccatcacgatgatgatgccgccccgctcccccagcagtacgcacccgctcacgacgtcaatattgaacccggcggattactggccgcgctgctgggtactgcgccgttaagcgtaaactcggtgcatcatcaaggcgttcgtgaagccgggcctcagctgcgcattgaagcccgatcgccggacggactgattgaggccataagcctggccagacatcctttcgcgctggccgtgcagtggcatccagaatggcagttgaaacccgcgacgccttcctttcagctgtttaacggctttattcaggccgcgcatctctacaaacgggaaaagcaacaatgagcgatgcgaccgaggctcccgggcgacgcctgtcgcagattcgccaggcgatgggcttatcccaacggcgcgttgctgaactggctggcctcacccacagcgcgatcagcaccattgagcaggacaaggtcagcccggcggtcagtacgctgcaaaagctgttaaaagtctatggcctgtcgctgtcggagtttttctctgagccgaaggggcaggatgggccaaaagtggtagtgcgcgccggggatctgctggagatcggcagccagggcgtttcactgaagctgattgataacggcaccacccggcgagccctgggcatgctgctggagacgtatcaacccggtgccagtaccggggaaaagttacgtcacgcgggtgaagaaaccggcacgctgctggaaggccagattgtactggagataaacggtcagcaatttcacctctctgccggtgagagttatgtcatcgatacgggcctgccacacagttttaccaaccctgccgatgtgccttgtcgcatcgtcagcgcccatacgcccgctaatttttaacccgggtcgacagccaaggagcttaatatgaattatgtggaaaattactacactgcgacaaggaatccacatgcgccctggccggtattacaggagagcgttcagtgtgacgtttgcatcattggcgcggggtttaccggattatccgccgggctgtttttaaccgaggccggctacgatgtggtcctgcttgaagcgtcacgtgtcggctttggtgccagcggccgtaacggcggacaggcggtcaactcttacagccgtgatgtggatgtgattgagcaacgttacggcaacgataccgcgaaaatgctgggcagcatgatgtttgaaggcggtgatatcatccgtgaccgcatcgatcgttacgcgattgcctgcgactatcggcctggcggaatttttgctgcttttaatgcccgtcagatggcgcacctggccaggcaaaaagcagcatgggcgcgctatggtaatcatgagcttgaactgctggatgaacgtgggattcggcgcgaagtggcaagtgaacgctatgtcggcggtttgctcgataaacgtggggcacatttgcatcccctcaacctggcattgggcgaagccgaagcgattcgccgtcacggcgggcgcatttatgagcagtccgccgcgttaagcgtcaactatggctcacctaatcgggtgaaaaccgctcagggagaagtcagcgccacgttcctgatttttgcgggtaatgcctatttaccttccgaactggagccgcgcctgagccgaaaaagtatgccctgcggctcgcagattattgccaccgaaccgctgtcccgcgatcaggccctggcgctgttacccaataattattcggtagaggactgtaattatctgctggattattttcgcctgagcgctgacaaccgcctgctctacggcggcggagtgatttacggcgcgcgggaacccgccgacgtagagaaaataatccgccctaagatgctgcgcacctttccgcagttacataacgtgaaactcgatttcgcctggagcggcaattttctgctgacgatgtcacgtatgccgcagtttggtcggctggaaaacaatgtctattttatgcagggcgacagcggtcatggcgtcaccgcaacccatctctccggcaaactgatcagcgaagtgctgcgtggcgatgcggaacgctttgacgctttcgccagactgcctcatctgcccttccctggcggacggcggtttaaagtgccgctgacggcaatgggcgcagcctggtatgcgctgcgcgacaggctcggcgtctgacggccggttcatacattcactcattgcccggcgaggggaaaaccgggcttattccagaggcattttttgcgggtcatcgtagcggtactcaaaacccagctcgtgacaaatccgcgaaccgtctattagcttaccgctgtcgtcaccggcttcaggcgcaaaggtcggtggcgtcatgcccaactggcgtgagacgccggggtagaactgcgcacgagacggatgtttcagagagcacaggttgaacgtgcgcccgcctttaggcgtttgtaacagcaacaggatggcctctaccacatcatcaaggtgaaccaaattgacaccatgtgaaccgttgggcagcgccagcttaccggccaggaaacgtcccggatgacgctttggccccaccagccctgccagacgcagaatatccacgctggtgccaggtaaatcatgcagccagttttccagctccaccagcgttttgcccgccgtggtttccggttgcaaggcgcttttttcggttttgatgcctgagctgccgccatagacggatgtcgagctggtaaagataatacgcggtacgttacgggccagcgccgtgtctaccacgttttgcaccgcctgtacgtaagcgtccccgccctctgccgtgcggctggcgggcaaggtgacgaccagcgcgtcaacgtcgaacagcacgtccagatcttccgcatcgcagataaggtcgggcgtcagttccagttgaaacgcgtcgataccgcagcgacgggccgcctcaacgccatccggcgtggttttactgccggtgacctgccagcctctggcggttaacgccgtggctaacggcatgcccagccagcccagtcctactattgcgacctttttcattttgtctcctgctgcagacttcaagatgttctcatcttaagcctccgctgagttgcaaaccagttcaaagtgtttcggcgctttgcgaataacaacattaaaaaagagttgccaatttcaactatcttcgttaggttaattccacacaaatgaataacttttcattatcgagaattttatgacacgcgttcagttcaatcatcatcaccaccatcaccctgactagtctttcaggcgatgtgtgctggaagacgtctaggatcttccagtggtgcgaacgcaagagaacccccggaagatcgtcttccgggggtttttttatgggctgacgcaaatcaatcattcaggacaggtcaatcaaggggacaggaacgatgttagacaatagccgtttacgcatagctatgcagaaatcaggtcgattaagcgatgattcacgcgagctgctggcacgctgtggtatcaaaattaatcttcagcaacagcgtctgatcgcctttgcggaaaatatgcctattgatatcctgcgggtgcgcgatgacgatattccgggactggtaatggacggcgtagtggatctgggtattatcggcgagaacgtgctggaagaagagatgctgaaccgccgcgcgcagggcgaagacccgcgttatttcacgctgcgtcgcctggattttggcggttgccgcctgtcactggccatgccggttgacgacgcgtacagcggcccgcagggcctgaacaatgcccgtatcgccacctcctatcctcacctgttaaaacagtatctcgacaagcaaggcgtcaactttaaatcctgtttattaaacggctcggtagaagtggcaccgcgtgccggtctggccgacgcgatctgcgacctggtctccaccggcgcgacgctggaagcgaacggcctgcgcgaagtagaagtcatttatcgctcaaaagccgtgctgattcagcgcgacggcgagatgccagccgccaagcaggagctgatcgataaaatgatgacccgcattcagggcgtgatcaaagcgcgtgaatcgaaatacatcatgttacacgcgccaagcgagcgtctggaagacgtgatcagcctgttgccgggtgccgaacgcccgactgtcctgccgctggcgggcgatgtcagccgcgtggcaatgcacatggtgagcagcgagacgctgttctgggaaaccatggaaaaactcaaagcgctgggtgccagttctattctggtgttgccaatcgaaaaaatgctggagtaagcgatgagcaaaatcatgacgcccgtgaactggcaagcgtgcagccgcgaggagcaacaggcgctgctggcgcgccccgcgctctcctcatctgacagcatcagtcagattgtgcgcgatgtgttggtcagggtgaaagacgagggtgacgcggcgttacgtgaattcagcgcgcgctttgacaaggtcgacgtaaaaacgctgcgcgtcacaccgcagcagattcaggccgccagcgatcgtcttggtgacgaactgaagcaggcgatggcagtagccattggcaatattgaaacctttcaccgtgcgcagatcttaccgccggtggatgtggaaacgcagcccggcgtgcgctgtcagcaaatgacgcgcccggtacaatccgtcggtttgtatattcctggcggttctgccccgctgttctctaccgtgttgatgttggcgacgcctgcacgcattgccggttgcggtcgcgtcgtgctgtgttcgcctccgcccattgcggatgaaattctctatgcagcgcagctctgcggggtggaagaggtgtttcaggtcggtggttcacaggcgattgccgccctggcctttggcacggaaagcattcctaaggtggacaaaattttcggcccgggcaatgcctgggtgaccgaggccaaacgtcaggtgagccagcgtcttgatggcgcggcgattgatatgcccgccggtccgtcggaagtgctggtgattgccgatgaaggtgcgacgccggctttcgtggcctctgacctgctgtcacaggcggaacacggccccgattcgcaggtgattctgctgacgccttcccaggcgctggctgagcgcgtcgccgacgcggttgaagaacagctggcccagttgccgcgcgccgcgactgcccggcaggcgctggaaagcagccgtctgatcgtggcccaggatatgcaacagtgcctcgacatttccaaccgatatggcccggagcatctgattctgcaaacccgcgcgccacgggacctggtcgaacacatcaccagcgccggttcggtttttctgggagactggtcgccggaatcagcgggtgactatgcatccggtaccaaccatgtgctgcccacctatggctacaccgcgacctgctccagcctgggcctggccgactttcagaaacgcatgaccgtgcaggaactgacaccgcagggcttcctgaacctggcggcgaccatcgaaaccctggcggcggctgaacagctgcatgcccataaaaatgccgttacgttgcgcgttgccgcactcaaggagcaagcatgagtcaggatattgaacagctggcacgggctaacgtgcggacactgacgccctatcagtcggcccgacgcctgggcggcaatggtgatgtctggctgaacgctaacgagttcccgctgccggtgccctttgagctgtcgcagcaaaccctgaatcgctacccggaatgccagccgaaacaggtgatcacgcgttatgcggcctatgccggtctcacgccagagcaggtgctggtcagccgtggtgcagatgaaggcattgaactgctgatgcgtgcattttgtgagccggggaaagatgccattcttttctgcccaccgacctatggcatgtacagcgtcagtgccgaaaccatcggcattgaataccgtaccgttccggcgctgaaagactggcagttgaacctgcccgcgattgccgaacaactcgacggtgtgaaagtggtctacatgtgcagcccgaataaccccaccggtaatctgattgatcaggacgatatccgtcagttgctggcgatgaccgccggaaaagcgctggtcgtcgcggacgaagcctatattgagttttgcccccaggcgacgctcgcgggctggttaaaggattatccgcacctggtgattctgcgtaccttatcgaaagcttttgcgctggctggcctgcgctgtggctttaccctggcgaataagccggtcatcgatttgctcatgaaagtgattgcgccctatccgcttgccacaccggtcgccgacgtcgcgggccaggccctgagcgaggaaggcgttgccctgatgcgccagcacgtggaagagctgaatgccaatcgccgctggctgtttgagcagttaccacagattcgcgccgtagagcaggtttttcccagcgaaaccaactatattttggtgcgctttactgactcgccgcgggtctttaaaaccttgtgggatcagggcattattttgcgtgaccaaaacaagaatcccggccttgcaggctgtctgcgtatctctgtaggaacccgaacagagtgcgaacgcctgatcgccgcgctgcaagccttatctctggagtaagcatgagtcagaagaccctttttattgaccgcgatggcacgattatctctgaacctccgcaggattttcaggtggatcgcatggataagctggcatttgagccggatgtggtgcccgcgctgctggcgcttcaggacgcaggctatcagctggtgatgatcaccaatcaggacggtctgggcacggacagttttcctcaggccgattttgatggcccgcacaatctgatgatgcagatcctgaactcgcagggcattcgctttagcgacattttgatctgcccacataagccagacgatcactgcgactgccgcaagccaaaaaccaaaatggtggaagcctggctggcagagggcgcactcgacatcgcgcaaagctatgtgattggcgatcgtcagaccgatattcagctggccgagaacatgggcattcagggcattcgctacggcacagaaggtcaggactggaaagccattcagcaacagctgacacaacgcgatcgctatgcactggtacagcgcaacaccaaagaaacccaggtgcgcgtcgaggtctggctggaccgtgaaggcggtagcaagatcaataccggtgtggggttctttgaccacatgctggatcagattgccgtacacggcggctttcgcatgaacatcgaagtaaaaggcgatctgtacatcgacgatcaccacacggttgaagataccggtctggcactgggtgaagcactgctgaaagccctgggcgataaacgcggcattggtcgttttggctttgtgctgccaatggacgaatgcctggcgcgctgcgcgctggatatttccggtcgtccgcatatcgaattcaaagcggaattcagctaccagcgcgtgggcgatctcagcacggagatggtggaacatttcttccgttcgctgtcctacgccatgatgagcaccctgcacctgaagacgaaaggtaaaaacgaccaccaccgtgtggaaagcttgttcaaagcctttggccgtacgctgcgtcaggccattcgcgttgagggaaataccctgccgagctcgaaaggagtgctctaatgaacgtggtgatcctggatacgggctgtgccaacctgtcatcggtaaagtgggccgttgaacgtctgggctacgcgccagaggtcagccgccatcctgacgtggtgctgcgcgccgataagctgtttctgccgggcgtaggcacggcgcaggccgccatgaatcagttagaagagcgcgagcttattgagctggtcaaagcctgtacgcaaccggtattaggtatttgtctggggatgcaactgctgggcagccacagcgaagaaaacggcggcgtgccgacgctgggcattatcgaccagccggtttcgctgatggatactcagggattgccgctgccgcacatgggctggaaccagattacctcgcaggccggaaatcatctgtttcgcggcatcgatgaaggcagctatttctacttcgtccacagctatgccatgccggtaaacgctagcaccattgcccagtgccactatggccaggcctttaccgccgcagtgcagaaagataatttctttggcgtgcagttccacccggaacgctctggcaaagtgggcgcacagttgctgaaaaacttcctggagatgtaatgattatccccgcattagatttaatcgatggcaaggtcgtgcgcctgcatcagggtgattatgcgcaacagcgtgattacggcagcgatcccctgccccgtttgcaggactacgcaggccagggcgcaacggtattgcaccttgttgacctgaccggtgccaaagacccggctaaacgccagattgccttactgaaaaacctgctcaacggcgtaaatgcgatcgtgcaggttggcggcggtattcgcacccgggatgacgtaaaagcgttgctggatgcgggcgccagccgggtcgttgtcggttcaaccgccgttaaacagcccgaggacgtcaaagcctggtttcaggaatttggccccgaggccatcgtgctggcgctggacgtccgtattgatgcggcgaaccgtaaagacatcgccatcagcggctggcaggaagcggccggtgtgacgctggaagaggtgatcgaacagtttcagcccgttggcctcaggcatgtcctctgcacggatatttcccgcgacggtacgctcagcggctcgaatgtggaactgtataaagaagtgaccgcgcgctttccgcagattgcgtttcagtcgtcgggcggtattggtgaactcagtgatattgccgccttacgcggcagtggcgttcagggcgtgattgtcgggcgtgcgctgctggaaggtaaatttacggtttcggaggcaatagcatgctggcaaaacggataattccctgtcttgatgtgcgtgacggtcaggtggtgaaaggcgttcagtttcgtaatcacgaaattatcggtgatatcgtgccgctggcccagcgctatgcggaagaaggggccgacgaactggtattttatgatatcaccgcctcatcggatgaccgtgtagtggataaaagctgggtttcgcgcgtcgctgaggttatcgatattcctttctgcgtggcgggcgggattaaaaccccggaagatgcagcccggattctggagtttggtgcggataaaatctccatcaactcccctgccctggccgatccttctttgatcacccggctggccgaccgctttggcgtgcagtgcatcgtagtgggcattgatacctggttcgatgatgccagcggcaaatatcatgttaatcagtacacgggcgatgaatcccggacgcgcgttacccaatgggaaacgcgcgactgggtgcaggaagtgcagaagcttggcgcaggtgagattgtgctgaacatgatgaaccaggacggcgtgcgcaatggctatgacctggtacagctaaagacaatgcgtgaagtgtgcaaggtgccgcttatcgcctccggtggcgcaggtaccatggcccacttccttgaggcctttgaacaggccaacgttgacggtgcccttgcggcatcggtgtttcacaaacagattattaatatcggcgagctgaaacgctttctgatcgacaacggtgtggagattcgcgcgtgttaactgaacaacagttgtcccggttagactgggaaaagacccaaggcatgatgcccgttatcgtccagcacagcgtatctggcgaagttctgatgcacggttatatgaaccaggatgcgctgaagaaaaccctgcaggacggtaacgtgacgtttttttcacgtaccaaaaaccggctgtggaccaaaggtgaaacctctggtcactttttgcaggtcgtcagcattacgccggactgtgacaacgacacgttgctggtgctggcgaacccgattggcccaacctgtcatcttggtacgtccagctgcttctcgcctgctgcccctgactggacgttcctctatcagctggaacaactgctggcatcacgtaaaagcgccgatccggacagctcttacaccgcgaaactctatgccagcggcaccaagcgcattgcgcagaaagtcggtgaagaaggtgtagaaaccgcactggcggcgacggtgaacgatcgtgaagagctgaccaatgaagcctcggatctgatctatcacctgctggtactcctgcaggaccaggcgttagacttcagcgcgattatcagtaatctgcgcgcccgtcataagtagattgtcctctctgctgctcctccgtcaggcgagcagcagcgttacaaaaaggcgcggtggcgccttttttattaaaacggaaaagccgatgctcagtacccatgaaaaattgatcgcgttgctcgatcaacatcaggcacgttaccggctggtcgcccatcagcccagcggcaaatgtgaagccgtcgcacaactccgcggcaccgatgtcggtcagggtgcaaaggcgctggtgtgccatgtcaaaggcaatggggttaaacagcatgtgctggcggtgttgccggccgaccagcaggcggacctgtccaaagtggctgcggcagtgggcggacgccgagcctcactcgcctcaccggcggaagtggacagccttaccggctgtgtatttggcgctattccgccattcagctttcatcccgatttactgctgattgtcgatccgctgctgtttgaacgttacgatgagattgcgtttaatgcgggcgtgctggaccactcagtgatcctgaacacccaggattaccgtgcactttgtggggctaacactgtgaaaatcatcctctaattgccatcaccccggtcgaaaggtactctgcgtaatacaacattacgacaacagaagatcttaactatggcaacgaaaaccctcaaaacccgcctgcgcgctgcgctggcactggccgtgcttgccggttgtgtgttcggcgcacaggcaaaaatcgaacaggtccgcttcgctgtcgatcccacctatccgcctttcgaatcaaaaaccccgcagggcaaactggtggggttcgatatcgacttaggcaacgccctgtgtgcacagatgcaggcgaagtgcgtgtgggtggaaagtcagttcgacggcatgatcccggcactcaaagcccgtaaattcgatgccatcctgtctgacatgggcattacagaagagcgtttgaagcaaatcgactttacccagccgctttacgatacccacactcagcttatcgcacgcaaaggttctggcctgttaccgacgccagagtcgctcaaagggaaaacggttggtgtagaacagggcacggtgcaggaacgttatgcccgcgcaaaatggcagccgcatggcgtcaccgtagtgccttacggcgatcaggcccaggtggaaagcgatttagtagccggacgccttgacgcggtctttaccgatgccgcgcaggccgccaatggttttctgaagcagccgcagggcaaagattttgcgctcgcaggcccgattgttcaggaccccattatcggtccaggcacggctattggcctgcgtaaaggtgacaccgagctgaaaacggcgctggataatgcctttgatgaaatcaagaaaaacggcacctttgataagattcagaagcactatttctcgaccgacatttccattcaaaagtaaggtcatgaagggcattttcgcccttcggcctctgcagggctatactcaatgactttatgggcagcgcttgctgccctgaaccgacaaaaggacattaacacggtatgtaccaacaacatcaccccttgttaagcgcctctctcggcacccagcgtgaaatcatcagttttcattttggcgatgaccctacgcgacaggtttatatccaggcagccttgcatggggatgaaatacccggcatggctgtcgcgtggtttttgaaacagcgtctgcaaaccctggagtccgccgggcggttgaaagcgtcgtttacgctgatcccggtttctaatcctctggcgctcagccagcactggcatggcacccatttagggcgatttcatacccagaccggacaagactttaaccgtaagtttccgtcgcttggcgcctcgctggctaatgaactggccactgtcctgacgccaaacgaaacccagaacaagcggctgattcgcgatgcgatcgatcgccactaccgtgataccgtgcccaaaacggagcttgaagcacagcgtttcacgctgatgcgcatggccagccaggctgatttaatgatcgacctgcattgcgactgggaagccctgccgcatctgtataccacgcctcatgcgtggccggaggttgaaccgctggcacgctggttaggcagtgaagttcaactgctggcgcaaatttccggcggagagccattcgatgaagcctgttgcgaaccctggctgacgctggctgaccgctttggcgaacagtttccgatgccgcagggcttgttacctgtgacgcttgaacttcggggcgtgcgcgacgtgtcaccagagcaggcggagcaggatgccgatgcgattatcagcgcgctacaggaatcgggctacattaccgccagtgaggctgccgtttctgtcgaggtcgcggcaccggttatcggcggtgatgaactggtgtcggtcgccagcggcggcgaagatgtagtaggcgttgacgagagcggtaccggactcggcgctccgggtgtggcaacgagcattgatgaaagcagcattattaaacaacgtcatatcgaagggacatccgccctgtcgcctgcgctgaaaaatccccctactccgcttgcgggttgcgaatatgttcactcgccggtgtcgggactgattctgcatcgtaaacctctgggtgcgcttatcaggccaggtgaagtggtcgcggagattgtcgatccggtaacggaccatatcacaccactggtggcggagttcggtgggatactttatgcccgtcactgggccagatttgccactgcagggatgttggtgttgaggttggcgggagagaagtcggtgaggagtggggatttgttggttcaacattgagttttaatcgaacctgaagcgtttaaattttggctaaatgatttttatactaaaccattatttagctgcttagatgagaaacacgcggatgctaaaggctgatcaaagttaagatcagccttttacttttgttaaacccggttacggtaactggtgagtgaattacgaccaatgacaataacagagcccaataaagcaccgattaaaaacgcaatcatcagagcaatgcctttcctgggacttaaacgtttgatgggtaagtcaggttgagaaatatagcggtaggcttgtaggttctcaacttcaattttaagatgtgtaacagcaagtagcgcgcgttgtgcctcatagtattccttactgaaatcgagcggtttagaattctcattctcaaccatagcattaagcgcattgctgcctaataaatataaagtgtcatcagaaagaaactcagcctgattcacttgcaacttgcctatatcagaagcatttgcgattgttaaagcctgtttgataacttcaagacgatgctctttctgatttaatgcaacttgcttgtaagtatctaatgtatttgtaagttcacgggttttgacacttaagtttcttttaatatcatcgccataatctttgacgacttcattattaatttgagaaatatattgagtcaattgcatttgtgcttgctttgcactatgtgctacgagtgaaatatttagagcatcttcgctccctttgactggatttaatgtcagtgtgacaggcgtttcaaggttattcagcgcccctgcaagcgcactcatagaagcagaaaaacggttaaacagttggctttgaagcccaataagagaaggtttatcttgcggggaatcagcataaacgatactcaaagccgcattgtagttagcaacctgacccgcagcgggaagcgttaaagttgaagttgaaacccacttttcttttacaaaatggagataagcaataccaatcaaaactgaaacaacaatggtggaaataataataattcttccacgccaaagttgtacaattaaatcaattaaatcgataccggaatcatttctctctgctacatacatgccatgccgggatgaatgctcgtcgtttgcgttatttttatttgtcataaattcattaattcagctcgaattaccttcaaatgtgagttaaggctccagagtgataatattttaaaagcctcttaaaataaagaggctttttttttatagttattcaagccattccgtatggaaaacaccttctttatcaatacgtttataggtatgtgcaccgaagaagtcgcgttgtgcctgaatcaggttggcaggtaagaccgctgaacgatagctgtcgtaataagccactgctgatgagaaagttggtgtaggaataccattctgaacaccataagcaacaacatcacgtaatgcttgctggtattcgtcagctatatttttgaagtaaggtgccaaaagtaaattagcaatattcacatcatcagcgtaggcatcagtaattttctgaaggaactgcgcccggatgatgcaccctgcacggaaaattttggcaatttcaccatattgaagatcccagtcgtattgatctgacgcagcttttagctgagaaaaaccttgcgcgtaagagacaattttacccagatataaagcctgacgaactttctcaataaattcagctttatcaccgttgtatttttcggctgcggggccagttaaaacttttgaggctgcaacacgttgagatttaagtgatgaaagatagcgagcaaaaacagactcagtgatcagtgacaacggctcacccagatcaagcgaactttggcttgtccattttcctgttcctttattagcagcttcatccagaatcacatcaactaaatattttccatcatgatcttttttagtgaaaatatctttagttatatctatcagataactgcttaactcaccgtcattccattgtgtaaacgtttcagccagttcttcatttgttaaattaagcgcacctttcaaaagagaataggcttctgcaattaactgcatatcaccatattcaataccgttatgaaccattttcacataatggcctgcaccgtcagacccaatataggttacacatgcttcaccatcttcagcgcgggcagcaattttatttaaaataggcgcaacaagctcataggcttctttttgacctccaggcataattgagggacctttaagcgcgccctcttcaccacctgatacgcctgtaccaatgaaattgaaaccttgatctgaaagttctttgttgcgacgaatagtatctttataaaaggtattaccgccgtcgattaaaatatcgcctttatcaagatgcggtgtcagtgaagcaatagtcttatcagtagcttccccagcctgcaccatcaacaagatgcgacgtggtttctcaagggaatcgacgaaatcttcaacggagtaaaatggagccagtttcttgcctggattttcagcaatcacttcatccgttttttcatgtgaacgattgaatactgaaacagtataaccgcggctctcaatgttaagtgccaaattacggcccattaccgccatacctacaacgccgatttgttgcttagacattcttgactccttctgtgctcttcgcgcctggcgcgattaaaatatggttaaaatcataccccaaatgacacatcttagtaaaaaaaagcgaacgcttgaaaacagaccggaaaaagaatcaagcgtacgtttcatttaatagaagaattcacgggaagtttgagatgcttgcttagtataaacctcaacgcactggttaggtgccataaaaaatgcttactaaaaattttgcggttgttatgctgagcagtatgtacggcctttatttgaggaaaatacaagagtttcataccttgcaatcttgctctgtaacaaatatcaatatcttcacagtacataaaataattttcgttaaaaccctgtacttttttgtaagaagatgatttaaaagctatgaaagagcctgctacccactccatatccattgcctcttcattagcagaaaaattagcaaaataactttctcttttaatgcccaccaatgatgaaaagaaagatataaaagttggatatttacgtattgataaatctctgtttttaaagtcttcgtctttaaaaagagaaattcctgcaacatcagcatcatatttattcattaaagcagttaagtcgtcgatgcttttagtatttatagcgacatcggggttgataagaataaatatatcatcgtcttgcatcccaagaacgtcaacacagtatttaaagttgacattattattacttccaaaaccaagcccataagcattatcgataagatgtatttttatggttttacaaaaatcattcaacaccctactatctgtagcagtattattttttaaaacaacattatactttgctgcgagatcctgaaaaaaaaccgtcttcataatcatgtcagcatgattatgtgaaactaaagaaataaaaatactcataaaatggccatttaatgaagaattaatttcgcagatgaatataaaaagatagctgcacttatcaaaataaataatcgatataacggtttactggacacagcaaaaacattcatcgcgagcacaaagaataaaatatcatatatacagaagaaatcagacaatcttattgctaaagaatcattccctctaaaaaaccacccaagtaacaaactaaaataagaaataaaaaatgacaaataaagtaagtaattttttctaacaagttctttatttttattcaagtaaatccagcgcagaaaaaacataaacacaaaaatttttattaaaacatatgtgttaaacaaaggaatagctgacgtttgatacgaaccatctatatagggtaaaatcctttcttgcaaaaatggaattttcgccatcaactccatgaaaagcctgtaaggatcgataagtacgatgctaaaggatagtataaatgtgataactatgaaattaaaaagattagcgctttgtcttttcctcaaaaacgagtgaagtggaatcactaccaatattaagatcgccgaaagatgaattgaagcggcgattaagaaaaccacaccggcacgcaacctgtatgaatttaaataaaaaaagaaagataagaaacaaaggcctatggccgcgccagcacgatattgtattaggtcatgaattataaaaagtctggataaatatagcgcaccaaaccaaaaaaacatttctgcattgagaaacctataggcgacaaacatttttgtgctaatcgaaatagtaaacaaaatgaatattacgcccagaacgcctaagcttaaaaaataagaaacattcgatataaaataaaaaccaggatcttttaataagacccaagtgtccagataagacaagtttaccgaggattcataccaattaagataggattgaaaatcaggtgaatttgcaaaatcaaagataataaaaacagcaatagcaagaagtaaatatgaaactaatataattcttttgttatttgtcgtcatctttttttaccagaacgaccacatattccgtcccaaatgccttttaacatgtaagaggtatgttgaagaggtttttcagtgaaaaaggcatacaccataaacctcgggcacagtttaataatttccattttcttccactgagaatggatatgtttcattcttaacaaatgaaaaacgtttcgaaaataataatagtgtcgaataggtgaatgattgacataagtccgattcataaccttgaccggcttaccaccaatctcatgactcatcttcaaccaaggcaatcctaatatttgataccctttatgccttgctcgcaggcaccactcaatgtccacaaaatcgatgaacagttcatcaagcataaaaccgatatgttggatagttgaaagcctaatcattgagccagacgttattacataagatgcctgaataggttgattgcccacagccggttgcctgacaattctgtctttttcgcaaataataaactcagcatttttattaattgccttatcaaaatacgaaggagataccagacatgtcttctcatcagtttctttgatatattcgatcagcgatattattaaattatcttcaggctcactatcctgatctaataaaaaagcaaactcataattattttctattaaataagcaaggcctttatttaatgctgttgctattccttgatttccattcaaattgataacttttgtagaaggcaatgtatagctttgtggcttttcactgttatcaacaatgacgacatcatatttttcacttagcctgcgagcagtctctacgttttcaatttcagggtgataaaagactatgatgatgccaaatttattgctatccatttaaaatccacctgccaaagaatgcatgtatttgtttagttttgctttgatgcgtctttttaaacttgagttagaagctttatgtggtaccagattaaaattctttttaaggaacctcgcatcacttctacccaagctcttaatttcaaacatgttagaccacgccacatacattaaggataactgatcccgctttaccccgtttaaatattctttataccattcatccattaacatattgatagaagggtcattttttctaataatgatagaacactcaaagagaccataatgagaaggaaaaccagaccgtttatatttcctcatctgactgtaaatattccattgccagtcatagccgatcaataaacattctgtagcctcttcatataaacagttccgaccaaaatgatcatacataaatattttttcatcttggcttttaactgtctccaccaataaagacaaatcacttaatatttctatattgccatcaatgtatattgttaattcgtaattattaaaataatgaaaaacatgcggagtgattttaattttacgattgatggttttcttatcaagtccggagaatttttcttcttcatctatctgaatcaatttccagggataaggtacatcaatgtaggtatcactaaagcacagataatcaatctcattattaataacagctggctttataatcttatcgtatccaccagtaacacaagtgtaaacggcaattttgttcatttttttaccaagaaattagctaaattacaaagaccccaaattttttcactattatccttgaacccattttggtgctcatgccatattttttctataacgctggcattgaacttgtccgatggtaaagattttaatctatcgtaagcccagtcttttaattcgactcttagccaacgtttcattggaagcgaaaatccttgcttaggtctttcaatcaacgttctgtcaacatatttgtagagcatatctttaaggatttttttctgtactttattatccattttgtaatgtgttggtaagctgtatgcaaactcgacaactttatggtcaagaaatggtgcgcgcgtttccaggctaacagccatggatgctctgtccactttcgtcaatacatcatctgagagataataatttaaatcgtgaagacagactgacgttattccatctttaaattgtggcgaagaatcttgagaaatcggcggatcatttaacatagggaaatctgaatttctgtatttatccatccaaaaatcatttagttgatatggctctttaaaattccacgcgagcgataagttttcagctcgttgcaagtaaggatttaagccttttatttttaatcttttgagcgtgtttgaaatttttgttacgggtaatgccgataatgcatttgtttcccataatttttttagcagcggatactgactatagcccatgaataattcgtcgccaccatcccctgataacgccactgttacatgttcccgagcaaatttgctcaccataaaggtaggtatttgagaactgtccgcaaaaggttcatcccaaatttttgggattttatcaattattttaagagcttcatctggagtaatattataattgaaatgtagtgttttgagatgtttcgcaatttcgatagcatgttgcgattcatcgaactctttgtcaggcattccaatggaaaaagtcgtgacgttttgattattctttttaagtaatgcaacaacagcacttgaatcaatgcctccagataagaaagcccctacttttacatcagcaatagactgtaacgctattgtattggttaatatactgtctagttcctctaaacagttattgtaatcttttttattaaaatttttatcagttactgaagcccggactgaccaatagcagacaggctcgacatcattttttgccaacatatcttcataagtaaaatgcaagtagtgagctgcttttaattttttaatattcttatatatagagtttggcgatgatatgtagtttttgtgtaggaatctgttaacagaatcccagtctatttcttcactaaactccggatgttcttttatcgcttttatttctgatgaaaaaacaaaagacccacccaaatacccgtaatataatggcttttcacccaggcgatcccgcgccagacttaacgttcttttacgaacgtcccatagcgcaaaggcatacatccctgtcaggttctgaagtgtcttagataaaccccattcaataatgcactttaataaggtttcggtgtctgacatccctttccaatttaatgatagcgtgcctgacaatttattacggagctcaaggtggttataaatttcgccgttgaaggttaaaacgtaattaccacaatcactgaccatcggttgatgacccgacgctgttaaatctacaatggataaacgagtgtggcctaaaaataaattgcaagaatcgtcatgccaaatgccatcggagtcaggccccctatgtttaatggtagccagcatattagcaataatatttttgttgttgtgctcaccaataaatccaactattccacacatgacgttctccggaaaaatattcttatgaaatatattacattgataatttgagccaagccaactcccagcaaccaaccttcactgcctaaaaacttcaataagaaaccacccagcaacatggaaataacagttattaatatattaattttaattattttgttacttttattaataagatttaaatagcctgttataacaggaccatagataccaaaaaaaatataaaatgcagccgagtacaaaactctatatgcaccctcgtattgactaccgaatatatagttttctatttgagtctcgaacaaaactaaccctaataaaatgccaagggagaataatgtataaacaccaacgacgaacaggacggtactcttgtattttttaaagtcattattgaagattacagtcaacttaggatacgccgccacatgcgttaatattcccaatgagataaaaagattcatgaatctttcaatcgcagcataaacaccgctctgggtagaaccgtaaaaatacgagacaactaaaacgcctgacattgtgtacagtgctgaaatcatctgcgatataaaaatatcgcgtccatctttaattacaatgaaaggttttaaaattcttattttttctaaatatctcacagagaaaataaatgttaacaacccattaattgcagctgaaaaaaccaaacacaagatagctacagtatagccatcattttttttcaaaaaaaagtaggctagaataaatgttgccagagagcctaagatggagcaaacactgctgattaaaaaatttccattatattgtaaaaaccatgcgctgtttaaaacccatgaaaatggcataataaggaacaaaagatagaccagactgtatttttcctgatttataataaaataaactaaaaaaatgaacgttaccagaaaaaacagcactcctttcgctgacaatattacattaaagaaatattcttttttatcactattttcagctattaatttaggtccagtcatattgaacgaatactggattataactgacatataggtaaccagacttaaaaataccgccagttttccataatcattgacaccaataatttttataatcattggtgatacataaaacactgtcaggccaccgaaaaaaaactgaacagccagaaaaaaattatcaaacactattttcttgtaatgccccatactgctatctcatgttgcgcgtaaaattaattatttatattagcgttgattcttttgaataagctgatgattttttctaaactatcagcttattggtttatattattccgtatacatttagcgcgttttgttaaacttaggttgattgctgtctttattggacagcagaggcgagcccattacaggccattcaataccgatgtcagcatcattccacatcagtcctctgtcactttctgcatgataataatttgtcgttttgtataagaactctgcagaatcacttaagactaaaaaaccgtgtgcaaacccctcaggaatccacaactgtcgcttgttttgagccgacaaatgcacaccaacccacttgccatagaatgatgaatcttcacgtatgtcgacggccacgtcatagacttcacctgtaacacaacggaccaacttaccctgagaatagggtggaatttgataatgcaatcctctgagaacgtttttagcagacttagaatggttgtcttgaacgaactcaatctttcgcccgaccgcttcatcgaattttttttgattaaagctttccataaagaacccgcgctcatcaccgaatacttgtggttctaaaataagcacatctggaatatcagtttcaatcactttcatgcttaatagcctttcaacattttcatcaagtattgcccataggcatttttcaaaagtggttttgctaaagtctcaactttttcagctgatataaactctttacggaacgcgatttcttcaggacaagatacttttagcccctgccgttcttctatcgtcgcaatgaaattgcttgcctcaatcatactttgatgcgttcccgtatcaagccatgcataacctcgccccatcatggctacagaaagtcgtccctgctcaagatagagacgattaatatcagtgatttcgagttcaccacgagtagaaggtttaagattcttagccatttcgacgacatcgttatcgtaaaagtataaacctgtgaccgcgtagttacttttaggtgtatcaggtttttcttccaggcttattgccgtgccttgcttatcaaactcaacgacgccgtatcgttctggatcatttacatgataggcaaaaacagtcgcgccattttctttttcaatagctgcttccataagctttggcaaatcatggccataaaatatattgtcacccaatactaatgcgacgttactatttccaatgaaactttcgccaataataaatgcttgtgctaatccatcaggagaaggttgaaccttatattctaaatttattccccactgacttccatctccgagtaactgctgaaaacggggtgtatcctggggcgtacttataattaaaatgtctcttatcccggccagcatcagcgtagaaagcggatagtagatcataggcttgtcataaattggcagtaactgtttactgacagccatcgttacagggtagaggcgggttccagatccacccgcaagaattatgcctttacgcttttccatatatttttctctttaaacacaaaatgcctgatctcaggcattagcggattatcaaatttttaagtcaatagttcattcagtgtacgcttaacacccatttcccattcaggcaaattaatcttaaatgtctgttggaatttagtattatctagtcgcgaattatttggccggggtgctggcgttggataagcactcgttggaaccgctttaacgctttcaagttcaagcatggcaccgttgttacgcgcttcagaaaatactaatgatgcataatcaaaccacgtggtgataccgctcgctaccagatggtatataccggaaacttcgggttgggaaacggcaacacgaagtgcatgagcagtacagtcggccagtaactccgcaccagtaggtgcgccaaactgatcgttaatgatggacagttcttttttattttttgcaaggttcagcatcgttttagcaaagttacttccttttgctgcatagacccaacttgtgcgaaaaatcagatatctggtactgtgcatctgtattgctttttcacccgccaatttacttgcaccgtaaatattaacaggctccgtgatatcactttctcgccacggtgtttcgcccttgcccgaaaaaacataatctgtcgagtagtgcactatccacgcattaattttttcagcttctttagcaatgacttcaacgcagtccgcatttaataaataagcttgttcagtgtcagactctgctttatcgactgccgtataagccgcagcattaacaatgatgcccggtttgagctgtcttatggtttgcgcaatagcatcaggttgacttaaatcaccacaatacgcttgtgagtgcctgtcaagcgcaacaactttacctagcggcgcgagtgctctttgtagttcccagcccacctgccctgatttacctaaaagcaggatatccattactggcgttctccgtagttctcttcgatccagcttttgtatgcaccacttttcacattgttaacccattcagtattgtgtaagtaccacattaccgttttacggataccactttcgaaggtttcctgaggtttccaaccaagatcgtttgcaatttttctcgcatcaatggcatagcggcgatcgtgtccaggcctgtcttttacataggtaatttgctcacgataggacacttctttggggacgatttcgtctaataaatcgcaaattgcgaatacaacatcgagatttttcctctcgttatgaccgccaatattgtatgtctcccctatttgtccagaggtcacaactgtatagagcgctctcgcatgatcttcaacatatagccagtcacgaatctggtcacctttgccataaacaggtaatggtttaccttcaagcgcattaagtatgacgagagggataagtttttctggaaaatgataaggaccgtaattatttgaacaattggtaacgagggaaggcaaaccgtatgtccgtgtccatgctctgaccagatgatcgctggatgctttcgaggcagagtaaggactgcttggtgcatatggcgtgttttctgtaaacaaggggagccgttgagattcttccacttcgtctggatgaggtaagtcaccatagacttcatctgttgagatgtggtgaaaacgaaaattttttttcttaatgtcgcccagggtcaaccagtactgccgtgctgcttccaatagagtgtaggtgcctacaatattggtttcaatgaaagcggctgggccagttattgagcgatcaacgtggctttctgcagccaggtgcatgattgcatctggctgatgacgctccagaatcgaggtcatttggtctgcatgacatatgcttgcatgttcaaaactgtaacgctcattgctctcgatgtccttgagtgactcgagattgcctgcataagtcagtgcgtcaacatttataacgctgtcgtgcgtatttttaattatatgacgaactaccgcggatccaataaaacctgcaccaccagtcactaaaattttcacgattgctatccagatattatttcaagttcaacattttaagccaatttcaaattaattggctcaaaatgcaatttactttgtgtgttaagtttagtcttcgctacagctaaaaattcgcatcttagccggaataaatctaaggtcagaacttatctgctaatacttcattttcattctgttttgagagcttaattgagtttattctatgaaatcttgctgacttgttgatggccgcattaaaggagaagaacagaccaataaatgccagcagttgccaacaatcacccattctaatgctttccaatacaatcccaatcattgcaagtatagcggcacaggaggtcatgacaatgagtgtaccacgtccggtcagaccgcctctcatcagtaaatggtggaggtgttctctgtcaggcctgaaagggctgcaaccacgccgtatgcgtgagctcatcactcgtaccatatccatcaaaggaaccgctatcaaccagagtgctgtgacaggccgcatcactgcctcagtcccctgagtcgcgatcatgagcaaccaaattactgtaaatccgataagtgtacttcctgcatctcccataaagactttaaatttcctaccccatgggataccaagatttaataaaatataaggtagacaggccgccatcaggcaggtgcaccacaatgcaatttttggattaccaccaagctcaaaaacgatacccagagccccaaatgtgacgcatgacaatgcccctaacaggccatcaataccatcaaccatattaaatgcattgatcgctccgatgacagcaaagagcgtaaatgcataaccaaacatacccagcactaactgaaatccgaacaagacattgccaagcgagtacaggtagtaactgttccacatcattatgcacgccatcaaagcctgaatcagtatgcgaggcataactggcagatcgaaacgatcgtcaagtacgcctacagctaaaagcacagtagcgcagaacatataaatggtgaagtcaggtaaccaacccggctgcatgagataaagtatccaaagtgataagtagaccgatacgccgccaactaagggaatgtgtcctttatgttgctttctgtcgttgggcttatcgaccagtccgaccttgcgcgcgaccttgcgcgcaataaagagcaacgcaaatgcacttagaaaaacacaaacgatctcttgcatgtatgcaccactgctgagttgtcatattttaaccacgctaccgcccctggctatcgcaaccacttgcgtgaacgtagttttagccatcgttaagcatagactgcattacaaaatggcgttgtattgccgggctaatatttttgagaacccagcctaatcgataaaaaaccttacgattctcgtactatacgggtctcgaaacaaggtttaaaaagccactttttgacaattttgtaattaacccggctgcaaaatcacaaacttgctcatttaatctacaaagctctatatccattcgcacagtaggttaagtataacggccatattcccttgattttattcattaaaaaaacaaaaacttgatgttctgatttttttctaatgaaccagtttcatttgctggctaatgtaaaaaaattaactgcctgaaagaaaaaacccccacgttgtttaatgactacatagcattagaacaacgtgggggttttttatacgctcaacgtgacgggattagcgaaacccatccggattcttcgactgccagttccacgtatcgcgcatcatcgcatcgataccacgcgaaacgcgccagtccagttcctggtttgccagcgaggcatccgcccagaacgcaggcaaatcaccatcacgacgtggcttgatttcaaacggaatcggtttgcctgaggctttctcaaacgccttgatcatttccaacacggagaaacctttcccaccaccgaggttataggctttataaccctcgatcttgccaagatggtccagcgctttcaggtggccttccgccaggtcaacaacgtgaatatagtcacgcagacaggtgccgtctggcgtgtcatagtcaccgccgaaaacgcctaacttgtccagccgaccgatagcgacctgggcaatatagggcagcaggttattaggaatacccgttgggtcttcgccaatctcacccgactcatgcgcgccgaccgggttaaagtagcgcagtgcaatggttttgaaatgaggttcagctttggcgaaatcacgaatgataaattcaaccatcagtttggaggtaccatacggactcgtggtaccaccaatcggtgtagtttccacgtaaggcacgggcgcattggcaccgtaaacggtggcggaagagctgaaaataaagttccagacgcccgcattgcgcatctcttccagcagaactaccgtgccggctacgttgttttcgtagtattccagcggcatacgcgttgactcccctaccgcttttaacgcggcaaagtgaatcacggcagagatactgtttgaagcgaacaggtcacgcaggcaggcgcggtcaagaacatcaccttcgataaaggtggctttcttaccggcaagtttttcaacccgattgatggcctcacgcgaggcgttgcacagattatccagtaccaccacatcatcaccgcgctcaagcagtgccagcactgtgtgggagccgatataacctgctcctcccgttaccaaaatagccatcttttctccctttctgccgcgtcagccgcagcgaataatatgtgattacttcgccagaattttcttgatggcttcgcggaactcgcgaccttgcgcattgctacgcaaaccataagaaacaaatgcctgcatgtaacccattttacgtccgcagtcgaaactgtgtcctgtcatcagtgacacatccaccgttttcttcttactcaggctggcaatggcatccgtcagctgaatacggccccatgcacccggttcggtacgttccagttcagcccagatatccgcagaaagcacgtaacggcctaccgctgccagatccgagtttaactcatcgggatgctctggtttctcaacgtagttggtaatggtgctgacatcgcctgggttttccagcggctgctccgtagtgataacggaatactcagacagatcgtagtcggtaaggtgttttgccagtacctggctgttacctgtctcttcaaaacgtgcaaccattgccgcgagattatagcgtaaatggtcagcggtggaatcgtctaacagcacatccggcaggacaacaacaaaaggattgtcgccaatcataggacgtgcgcagaggacggaatggcccaggcccaatggctgcgcctggcgcacgttcataatggtcacgcctggtgggcaaattgactggacttcactcagcagttggcgcttaacgcgtgcttcgagcagagcttcaagctcataggtggtgtcaaagtgattttctaccgcattttttgacgcatgggtgaccagcacaatctctttgatacctgccgcaacacactcatcaatgatgtattgaatcattggcttgtccactacaggcagcatctctttcggaatggctttagtcgccggaagcatatgcataccgagacccgcaaccgggattactgctttaagcttggtcatagttattccatctaatgaagtgaagacatacgtcaattatgccggatggaccggaaaaggaagtataatctttatctgaaaaggcaacactaactcgctgtgaaatcttacaaattcgggtttttacgatgcctgaaccccgaaagatgcggagtaaacacaatccgtaaaggcgagcctgagacgtgttatcagaatttactcaggtgtttttaataccagccgtaaaaagaaacgggcgacctgaggtcgcccgttgttattggcttacagccactgttcaaaccattctggcatcacgaaaagatcgaagtgattaaccagcagcatgagtcccacaaacagcaccgacacagatacccactgtcgggcgtaagggataaagcggatacctatcaccggcttgatgaagaatggatgcgccagggcggaaatcagcacctgtgagatcgacaacgtcagcgcaacatagagcacgtttggccagatgaaggtggtggcaagcacagccatgaccaccaggctggcaacgatgttccagtagaactccacgttagtgcggccattcgcctgggaaatcgccccggtcagtccacccattggacgcaacataccaaacagcagcatcagcgggatcaggtgataaacctgttcatgagatgcaccatagagcacgcgtacaatgaccggagacagaataccgatagccaggtacatcgcgctgctgaagagcattatcatcaatgtgcctttcaggaacagcttctttaactgctccgggtcctgctgcttctcggcaaaacgcggcagtgccaggcggttaatgaccggcgacaccaacttcagcggctgcagcaccagctcttttgccagtgaatagatgccgagcatctcggcccccatcactttaccgaccaccagcgcatcggcctgggtgcggagttggttaatggtctgcgaacccagctgatagatgccgtaacgtatcgcactcaagaaggtttgcttgtcgaattcccatgtaggacgccaggacttctcacccagcgcaatcatgcacagaatgcgggtgaaggcgttgatgaacaggccaaggatcgccgcagccaccgtcagcgaggtaaactccagcatcgccacgacgcagagaaacgcaaacagcttggtgcccatttcaatcttcgccagtgacaccatgcgtttggttttaatgtagtgcgcctgatattgcgaaagatgccccagtaccagaaagttaaggctggtcagcataatcagccccaccagttccggcagatgatagaaccaggaaacaggccaggcaatcaacagcataacaaggccggtacacaagctgagcgagacgttcacccagtagatggtgctctgttcacgccgggtaatgttctggcgatgcaccagataactgctcatgcccatgtcctgcagcacgcctgctaccgccagaatcgcgttgatgatcgccaacaaccccagttcatgggtttcgagtttccgggcgagaatactcagttgggcgacctgtaatacggctgaaaaacaggtgctgccaaacaaccacatcgcctgtgactttattccactcaaaccatttgctccagaatctgtgccagctcgcgatacgcgatgtgctgattaaactcggtttcaactttttgtctggcggccgcaacaaccggcgcaacgtccacttcgccttgagataacttcagcagcgtgtcggccagcgcttcggcatcatcttccttcaccaaccagcccgaaacgttatgttcgattaactctggaatcccgctgtggaaggtggagaccaccggcagccccaccgccatcgcttccatcagggcaaccggaatcccttccatatcgccatctgcagctgttttcgaaggcaacagaaagatatcggcttcattgagggccttgcggatctcttcctgaggtttaaagcccggcatggtgacgcagtcgtccatctcttcgtgcgcgatgaagtcacgcatcatctgatcctggtcgccattaccgatgatggtgtactggaactgcccgccgcgctgtttgagaatggcgctggctttaacggccacgtccaaccctttcttttcggtcaggcgagcgacggacacaatgcgcaacggcttgtgaaaggcatcacgtggctggaaattgaatttttccggttcaatgcccatgcgggtaacgtggatcttctctggcggacaacccattgcaatcagcttgttttgccacagatggctgataggcagcatcagttcgctctgctggaacagattgcgataatcctgcttgtgctcgtcaaggatgtgacggcgggagatatccgctccgtgaaacaccgttgcctgcttacctttcaggatacccagttcacgcagcttgtttgccagcgcaccggcgtagccgaaatgcaccagaaagacatcggcgacgtaggtctggcgcgcgttggcgacaatcgcaggcagcagcagtttgctggactgtgcgccatagcggcgcacgttcagcgaacggagtaacgagactttggtgattttcggcagaaccagtttcaggcgttgccccagcttatcggccagggaaattttctcttctggcagcagataatgggtttttgccgccaggccatattcgtcaaacgcgccgtgccggttcactaagtcccccggaaacaccgagataatctcgacgtcgtaaccggcatcaataaagtgagtgacctggttgagaacaaaggtttctgaggcaaccgggaaacgcatagtgaaaaaagtcagtttcatcacattatcctattacgtttagaatctcttccgtgattctgttaccgacttccctttcgcgcgccacggcgatgtcgacgttttgcttgatggtatcgtagtcggccaggatagcctgaaccttatcaatcagcgaaccgtccatcaggctctgcacatcggtcgccatttgcggcagacctaactgattcatgacgcccatggatttgtgttcatagttgatagcgaccgcaggtgtgccaaagttcattgagatgatggctgagtgcagacgggttccaatggtcaaatgacactcgctgaggagcactcccagctcgaggtcgttaaactcatccatgacaacgtgataatgctcaggctgctggacatggtcgcgtaaagtcagcgccaccatacggtcatcttttgcatagctgtcgatgcccgtgcaggttgataacgccacgacctggtaaccgctggcgatcatggcattgatcacccgaccgaatgcggcttcatactcttgctgcgtcacgccgagacgcttatcaaacggggccagttcgcggaccgtaatcgcaatggttttacgttcacggatgacgctttgccagtgctgcaggctgtggctgggattgtcaacgtggcgggcgcgaaccaggaatgcggtatcgacgccgggcaccactttcgagctggtcacgccgtcgcgcttcatcaggtccaggctgacagactcacgcaaaataagttgatcaacccggtcaaagacaaaattggccagttggttagtgcgggcgttctggaaggggccgactgagtgaccaatgagataaagcggttttttcgccagtagtgcgcagagcgcatggtcaaactgggtgacaccgtagagatcgacgaaaaacgatccgccaacctgaatcaccgcatcgtactgcgccagactttccgtaaaagcttttaggtgcggcggaacggaaaaggatttatacggcccgcctttgcccaggtgcgccatcatgatattcggcatcagtcggttagcgactttgcgtttcacggagccaatcaggcctttacccgaggagttattgtgcaggaagagcttatcctgctgaatatgttgctgaagcagataaccggagctggttggataacggcttataacatcaatatctacatcgttgcgcgcggcctgaattgaatcaatcagtccacgtagaatcgcgccatccccacgattcccacaggtatggttacccaccaataaaatcttcataaaaactccgaataattttttctaattctaccaaccgcccagttccgaaacgggcaaaatgaatacgattaaaaacagcaagttatttcagttcaccaacgtcccagatgctgttggtgttggctgccatcaggcagccctctctcatgacgatttgatagcaaaatacggtaaagcgacctgcttaccgttaataacgacagacacgaatccttcaggtttgctggtatccaccttgtcatcagacaacgcgcgggaggccagcaataaatccccctgctcattcgcgcccacgcccgctttgccattgtgcaggctgaaacgctgtggggcagcatggctgctgctgtccggcgtggccttcgccattttggcatcgacccgcgcacaacggccggtcacaaaacgatctttcgctgtgctcttgatcatcacggcggcagatggcgtccagccggccagtttgacgaaaacctgggtgtcggtatcggttttggcgacataacgcacatccagcaccgggctactgccttccgctgaccagctggcttcggcatggtctttcttacgctgaatatgaatcaccgcccggccgccggtgtttttgccactgatcaggttcatcagcggttcaccgtccgtgccgttattgaactgcgactgaccaaagagttcgatttcccacgaatcaccgacggtcggggaataaagattagccagttcgaaccacacggcctgattgctgttgttttccaacaaccagcgcgaggtgaggtagttgtatttcaggctgccatcaatggcgacgccataggattcaacgcgggttgatcccatctcccaggcgcttaaccaccggtcgccctgctctgaattatcaatccagctaccggattgcaggttggtctgacgtgtattcaggcgggaatgccaggcaatcagcggatttttacaatcctcaaggctgagggcgtcaataatccactgaccgtttgagatatcacccggattgtcgcagtgctctatccagccgttatgaatcagcgactggctgcagcgcggcagattgaggactttgccgcccttacagtgctgagcgttaaagttagacagctcgatggccgtgctgtgatcccagttgcccttcttctgaccggaccagcccgcctggatcacatcaccggtacaggccgaggcgtaccactggtcaatcttacagtccagtgtatccagcaggctgagcgcggtgccgccgacctggttgaagcgcaggcacgcgccacggaaaaactggccgcccggacaggtattacggaacaggccctgtttattgggactggaatccgtattgccattgaaaatcaggttagagatttccacccagcgggcgctgacttcgaacacaaacggggatttaccatctgaaacgatggtggtcgccgggaaataaccgaagttaaccatcgccccggagatacggaagaagcggcgctgttcttcgccgaaatcacagccggacacaaagaaggtaccagcagggaactgcacacagatgggctgatcgctctgttgcgaccactggtacatggctttaatggcgggcgcactgtcggttttgccgtcagcgatagcgccaaaatcaaacagcgacagtcggttgaagtcatcgaccacgcgacgccagtgaaatccgtcgccgctgaaaatcaccccctgatcgtcctgcgccggctgaaagctgccgacgaactcgccgccgcccacttcaagcccggcgtgccagcttttcagcttgatttttgccccttcaaacagcggtcgcgtcttgcgcagatcgtctaccgaggggatctcgccaatcagctggtaacccgcaggctgcgccagacgctggctgaaggccgcctgacccggctggctgacatcaggaatgttaaacaccatctgcccgttgctgtcttccagcgccatcgagtgcgaggggttggctatcagcgccgcattatctttaacgaactggtcaaaattgcctttgttcagggtaatcggctggctgatttgtgccagattaccgttggcatcgcgcaggaataccggtatctggttacccggtttgctggcatcactgccggattgaccaatccacagttttccctgaaagttttgccaaaactgcggcggcatcgcatagacgttttcaggtgtcagaatgggtacatcgcctttaggaatcgcggtggcatcaaccgactttagcgccaggccattgtttttagcggcgtaactggaaaaggtgctcacggagagcgcccctacaagggcggaggctgcggtttgcaagacttctcttcttttcatgcaataaatcccgtcgtcatgaaggctataaactcagccataaaaggtgtcccatgaggcacatcaaaagtgagcttctccagcccgttacaccagtgccagccagctttgtttaatttgcttgccgtcaaatttcagcgcggtttgttgggttttttcgctcatggcgtagaacagcgcatcatcgctggcgagctgttccatccgcgccaggaattcgcttttcttgttcattggcaccaggaaaccgtcttcaccgtggttaatgatctcctgcgggccggttggacagtcataggcgacgaccggcagtgaccaggattttgcttccagcagcaccagcggcaaaccttcgtagcgcgaggtcatcagcgccatatcactgtcgcgatagtaatcattgatgttggtgactttaccgacaaaattcacgctggaagtgatgcccagtaccgccgcctgatcgtgcaactgctgacgtaattcgccgtcgccggcaatgaccagcgtccagtcaggatgcgctttcgtaaagtcgcgccagatatccagtaacaggtcaaatcccttttgattgtccagacggcccacggccagcgcctgacgatggcgcgtggtgcgatgccaggatttgtacactaccgggttaggaatggcctgactgggaatgtgccagcgctgaaacacctgatgatctttatccgtcagcacgatgacgcgatcgtagtagcgcagtagcaggaacttgaggaatttaatgggcttactgaaggagttaatggcgatgtgctcgcaggcataagctttgaaacgcttctttttcagcgccatcaggttccagaaggcaaacatcacgctcaggcgacccatgctgattaaaaatacggtgtcgaagccttcctgctggatgcgggcaacggcacgcttgatgggattgctttccccttcaaagctgacgatctgcctgaccttctcaaaagggtaaaagggttcaccgtgcccctctagcgagtagatggtgacgtcgtgctcatcgccgagacattccgacataaaattacagatattttcggtgcccgcatacgagtaagcgtctttgatcaccaggacaatttttttcatgaaacgttatccacctcaaatttatacacaatcctgccgatcggcttagcggtgtttcaggctaaacagcacaccattcaccatataccaggcgtaatagtaatagatttttaacggattgtttttatagataattcttaatagttcgaggtgccatttggcggctttatttttattacgcgacagggaatcacccagttcgtaataattcaccagaatgctctgaattatgcgggcctgtttataacggttaaacagttcgtagaggaaaaggaagtcttcatggcctttgcgttcaaacaaaatgccacccggcggacggcgaaaacagacggatgagaagcacacccgatactgttttttcacgaagttgtcctgttgcagataaggctttgcgtagcggatatcgtggtcggctttgcgcgttttgtagtgatattccgtaatgaccagattatcgccatcggcaatagcctgcatctgctgacgcagcttatcgctgtgccattcgtcatcgctgtcaagaaaggcgatgatctcttctgtagcggcacgcaatccgacattgcgggtttctgcggcgcccatgttgaccgcgttatcgagaagggtaatacgcgggtcctgacactgttctctcacccactcgagtgaatcatcggtggatttatcgttgatcagatacaggtgccagtcctgataggtttgattgataacggactgcacggcgcgtaataccgtctggcgagcattatacataggcataacaatgccaacggtaccagagtgattattcattttcatacctgaataaataaaatagacggagccaccaggagcctgtccggcagcgttaaaacgtcacgacattcaatggaatcaggagagcgccttttcgccgcctaaacgcgcttttaacttgtctttcacgcggttcaggaagtaagtgcggttgtctttattggtcagcaagaagtagcgtgcaaaactgacgctcgccatcagcgagttgccgtccattttgtagcgcaggggcagcttgaacgctttgtaggtgtgaatatcacgtgcggtaaggtgcggtttcatcgtctccagccaaaacagggagtacttgaccgattcacctttgtgtttagagccaaacttcgtgaccagatgatagttagccagcgggaaagcgatcatttcaaaccggtaacccatgcgatcggcacggatgcagaaatcataatcctgatggcggataaaccgcgcgtcgaactgaattttagcggcatcttcacgcttcagcacaatggtgctggtttgaataaagccataacagccaaacaggtattccgccacagtttcattttcggcgggcggctgcatgggcatgactttcaggaactcaccgtcctgatagatgttcacctgactgaaaataatggtgttctgtttgccttgtgcctcaagctcagcaattttctcgctgacctgctgcagcttgtccgcatgccattcatcgtcggcatccagaaaactaatgtagtcacccgttgccagctcgatgcctttattacgagccccggcaccgttgagtttcacctcagataacaccagattgatgtccagatcctgatagcgctcactgcgcaccacgtcggccagcgcggcagcatccgcggatttgtcatccacgatgatgacctcgaaatgacgatacgtttgtgctttaacgcaatccagcgtcgtgacaatcgattctgacgcgttataagccggaattacgatggagaaacgaatgtccttcattgccagcacctcataaaagtattcaaaaataaacaattcaatcgacaaacgtcgaagaaaaacctgtgatatttcaggcgaccgccgcgctgagtgaagccgttcacgcggtgcggatcgccgggtccgttaccgaatcagccaaaactcctgggccacttcatacccaacaaccgcttgcttggttgaaatggtgttgtagtagaggtaatagagcaggaagaaaaacagcatgccaaacagcgccggcttccatactcgcctggcttgatagatcagtgaggtcaggatgatgggttcaacctgttgcagatagttagaaagacgcgaacctgacgggaagttgtacaggaagatacggatcgccccgccgatagcaaagcttaaaatcagcaggtagttcaggcgatactgcgcatagttttcgcgtttcagctcattgctcagcatgaaatagaagaagataaacaccagcatgatgttcttcaggttcgacactgacaggatgctgccatccattgcataggagggatcgttgttataacccgatgccctttcccctagcgatccaagatgaccggcaatcagggcaataaagcttgatccccccaccaccgagagcggcaggctgaaaccgatgataatcaccggccaccagcgccagtcacgaataaacaggaatggcaccagcgtcaccaccatcacggcggtgttgtggctcataaatgacagaataaaaaaggcaaaggcccaccagtaacgcttcaggtatatcgtccacagtacgccaaggaacagggcggaacttaagccaaaacgtatctggttaatgtctttgttgataaagatgtgcgccgaatagagcgccagcgccagtaccgggtaaggtgacatctttttgaaaaaataagcgtttatcgataccgcgatggcgcagaagacaaacaggaacacgctggcattgtgcgaaactaagctggttacccacgccatcgcaaaaatcagcggttcgtagcggaaaaacgcaacggtctcgaaaaaaccgttgatctggatgcgccggataaagtcttcgaagaaactgcggtactggtagtcatccatgccggtgccaagcccgcgaataccaccaaacacgatcagaataatggccgcaaagcacagcagccaggtcaaaatataatttgtgcgttcgtcttttttcaccaggatttcaaacagcgaaatcagcagcaaaaaccctgatatataccaatatggagccatggtgtgattccttaaatccacaagttctcatgccaacagcggcctgtgctgattaccttccgggttgatatctcagcgggtctgcgccgacatcgcgacagacaaaagcgtgttgatgatgaattctgatgattgacgttagatcgtcgcttattgtgcgttgtatccagaatcacctgtgcaaatcgttatgtgtcgtcatcctgagcctgcgatcaaaaggggcggtcaaacccgccccttttctttcagctcttagcttttcgtcggtttaccgtactcgtagtcgtagtagtcatagccataaccgtacgagttagccgcttttcgtaccacggcgttaaggataatccctttaatttcgataccgttctgggcaaagcgtttgaagctgacatccacttctttcgtggtgttggtttcaaagcgcgccaccatcagcgaggtaccggccagcttaccgataatggaggcatccgttacggccagaatcggtggcgtatcaatcaggactatgtcgtaatttttacttgcccactccagcagttcacccatgcggcggtgcatcaacagctccgacggattcggtggaacctgaccgcgcggcaggaagtcaaaaccgtatggtccttgctggatcatcgccggcgtaaactcagttttgcctgacagcacgttagagagaccggatttattttccgcgcccaacagttcgtgggtgtaaccacggcgcatatcaccatcgataaacaacaccttctgccctgctttcgcaaccagagtggcgaggttgacgcagataaaggttttaccaatacccgggctggcaccggtaatcatcagaatgttgtttttcgcttccatcatcgcgaagtgcaggctggtacgcaggctacgaatcgcttcgatggacagatcggttgggttacccagcgctaacaacgtctcatgcggatcggttttcaccttgtgaccgcgacgtgccagtgcttcggtatctttcttacgttgccactcggaaagcgggacgctggcataaacgttcatgcccagctcttccaactgctctgggttctcgataccgtgatgcagcagcgccttcagcagtaccacgcccacggacaccatcagacccagaatcaggctggcggcaataatcagcagctttttcggcgcaaccggtgaattggcggtcgcggcctgatcgataatacggacatcacccacggtactggctttactgatgctcagctcttgctgacgattcagcagctgcatgtagatttcctgtcctgactgcacatcgcgggtcagacgcagaatttcctgctgggttttaggcatctgcgcaattttcttgttcagctgcgtctgctcgtcttccagcgttttacgcttttccaacagcgcccggtaggttgggtgatccttggtgaacaactgtgaaacttcggcttcacggaaggtcagctcgttaagctggctctgaacactgacggaagaatccagtgccgattttgcttcgagcgacaggtcaacggactcattctcgcgacggtaggtgttgagtttgtcttcggcctgatccagtttgccgcgaacttccggcagttgctgtttcaggaactctaggcttttctcggcctgttcggatttacgctgcacgttctgtaacaggtagttattgacgatctggttcagcactttgctgatctgctcctgatcttcacccacatactgcagtcccagtacgccggtatctttccctttgtccgcaacggtcaggttagacaggatgctgttaattgcctgcagatcgttgagtttggtgacggtaaacgtggtgccaggctccgcattgatatcgctgaccagcatgctcacgtcgccgtgtttttcaaactgccccactttacctttgaacagctcatcgccatcagccgaaacggtatagctgtctttacccgtaacctccagttcaacactgcgtttttcaatagtgcgcgggatttcaagacgggataccgcgacctgtccgggcttgttgcccatcagacgcgacaagcctttaccgatgaccggaaagtagttctgcgaaaccatcgcatccaggccgaggtcctgaacggttttccccagcaccatacgtgattcaaggatctggatttcggtatctgaggccggcgtcgtgggcatgattgactgcagttcattcaggacggtgctgctattcttctgctcaacctgaaccatggcgtcggcgctgtaaatgggcgtcgcaaacagtgtgtaaagcgttgccaccagcatgaaaaaagcggtaacagcgacgatgacccagcggtgatcaataagctgtcccacaagatgcgccaaatcccacccattcgattcctcgcgtggcgcggtcatgactttgttttttatattcatggataatcccaactatcggcttagtacgctgacccatttctgagtggcgtgttccagtaacccgtaaacctcttcaaaggcctcacggctttttctgtacggatccgctatttccttctgattgagccagtgcccaagcagcatcgttttgccgcgtgcagccggatcgatgcggttaacctgttcaatatggcgtttttccatcaccagaatcaggtcatactcccggcacaggctggccgttaactgctgggcctcatgaccgtccagggataaccctttttcggccgccacctcagtcgcggttttatccgccgcatgaccgaccagcgcgccgagtccggcagatgccacaggaaggtgcggcagcgcacgtttgaacaggcgctctcctgtgggagagcggcagatgttgcctacgcagacgactaacacggacttaatcatggctaaaccttagttcgaccagttgcggatgcgctgtgcggcctgagtcgcatcgttaacaccggcgatggttggtatcaactgcgatatcacacggttccaacgcgtcagcggcgtcgaggttacgtagacgatatcgtaaggttcaagttggaattcggtacccatgaccatggaggccgcatctttggtgtttaactgatagatgttggcaattttgctgcgatcagtgccgcgagtcggtcggataacaaacacaccggtcgcgtcagaggtggtttgatccatgcccgccgcgttacccagtgcttccgccagcgtcatgccgctgcgatccattttcagggttgcctgctgtttcacttcacccatcacaaagactttcagatcgtcattgcgcggcacatacagaatgtcacccggataaagcagatggttttggctcagatcgccgttctgcatcaatgcctgcagcgaaacgcgctgctcacgaccgttgtgagtcagaatgacattacgccagtctgcatccgccgctaagccacctgcggcgttaatcgcatccaggacagtgagcgggacgttggtaataggctgctggcctgaagtggttacggcgccggtcacgtaggttttctgtgacttgaacgaggcgatgctgacatcgacctgagggctttcgatgtactgcgccagacgacgcgcgacttcatcacgcacctcaccaacggtacgaccagctacacggactctgccaatgtaaggatagaaaatcgtgccatctgaatgtacccagttaccggtatcgctggcgctgcggtactgacctgcgggggtggtgagctcagggtgatcccacacggtgatggtgagcacgtcaccaatgccgatgcggtattcgtagttctgaatctcggtctggagtgatggattagcctgtgccaccaggggcttgggacgcattctatccaccagcgttggtgttaacgggtaaacgttaacgtatttgtcgatgtcaaaattgttgtcctgctgctcaatgacatcttttcccgaagtggacaaattttgccccggcacgacggtacagccggccataaacgtggcagataccagaacaggtatcattttcattttcattgtaatcatttagatcttcgctatcagttaatgtttgatagaggcgaatacgccgctgtgtaagcgctcgaaaaatgtaaactatcctgaatcaggccctgaacatgtcgttcattattcttagctcctgtcttttaccaataacgcgctttacccgggacggattaaagcaaagcagaacatttctgtttatcaatgccgtaccgcttttttttagaaaaacctgccagccgggcacctgaaaagggctgctatcagagcatggctgacagagtttttttctgcggctagtaagcaccatcacgtttaagtacgacaccaacggttttgaacaaaatcgcaatgtcgttccacagagaccagttttttacataccatgagtcgaaatagactcgcgtttcataatctacatcgttgcgcccactgacctgccacaaccctgtcatgcccggtttggccatcaggtagtaatcgacatcgccagcatagcgagccagttcatcttcaatcaccggacgcggtccgaccaggctcatatcgccacgcacgacgttccacaactgcggcagttcatcaaggctggttttacgaataaagtgcccgactttagtaatacgtggatcgttcttgagtttgaaatctttgtcccattcagcgcgggcaatcgggtccgtgcgtaagacttcctccagcacttccttcgagttaatcaccatcgaacggaacttgaggcatttgaacttacgaccgtttaaacctacgcgctcgtgaccataaattggcggcccaccgtcgcgtccgaccaggaagcccagcaccagcagagccggtagcagcatcaggatgatcgacagtgcaccgaaaatatcgaaggtgcgtttcaggaaacgtgaggtacgttttgccaggttattctgaacacgcagaatcatgacttcatggctgaagatgtaggccatgtcggtgccgtaaagcggcacaccgcgaagcgtcgggatcactgacacagaacggcagttatgcatggccagggatttcagccacatgtcgcggtgctgactttgctcgaactcaaccgcaacaataaactgcgtttcactgttcgtcagattccacagcgcttgctcatcgcgcagcaccgggatacctgaaattaactcctgcgggcaggaaccgtccacgtcatagaaggcaatcacgtcgaagcccatgacttcttcgctctgcaaagcctgccaggcttcctgggcgtttttattgctaccgatgataatggtctgctttttccacaagccgtatttattcagcaggcgtttagacagcgaacggcagaccggaatgatcaccagcgtaataagccaggtcagcaaccagacaaaacgtgacatctgccattgtgacaaggccgtgatcgacagttcgatgacggagaaaatgagaatggtacgaaaaatttcttttaattcgaaccaaaaaggtttgcgataggtgtaatgacgcagcctgacccagaaccagaacacgcaaattacagacaggcagatgtgtgtagcaacttttaaatttaattcccgatcagacatatccgacaacagtgaaggagatgtcatattaattagcatcatcgcgataaataatgccgcgttgaaacatattaaatcagaacaagccaataataatttggtgataagacttttaaacgtaaattcgttatcgcgcatatttaactctttattttatttccttaacccaccacaccagactcttaagcgaccagcattgtcccttaagcccgagcgtttctgaggggagctcctgcggcatttacgccattgtcattgactatgaaaccaataataccgtactcaataccaacagattactctgactttatcagcaacatgctgattaaatatcaaaccgaagcggcgactcagacacgctaccgcccttggctgtcgctgccaataccgccctgattgccactgtttttcgctgcaccgcgtgcgattgcgcacaaaacatccttgtgcagaatgcgttgacattccgctacataccatgacggattatcgcgcaaattacagattcaggcgcaggcgttgactaactcgttgctatactagttattactggcatgtttacaagtagaccccgccatccctggactattttaggaaaaagactaccagtaataagtattgaatccgcccattttcggctttgaggtggaaaaaaatcagatttattccatgttggcaccaggaataatcgcataagaaattcctctgaatgagaaatgcggtgacattaatctgcaacctttttccgctactgtcgtccccgcattaatcaatctgctgaagaattatcctgtaattaatgtatgcggtattcaattaaatcgtaaagaacctgtaaggtcgctatttgtcccctggccctctctccactatcatcagataaagcttatttttagacattcaggtgaataaagcatgttggaggtaatggccgaccccgcgttatgggcaggtttagtcacgctaatcgttcttgaactggtactgggcatcgataacctggtatttattgccattctggtcgaaaagcttcccgccgcgtcgcgcgatcgggcccgggttattggcctgctgatggcgttggtctgccggctgctgctgctggcgtccctttcctggctggtaacactgacccagccattgatgacgctggctaatcacgcctttagcgcccgtgacctgttactgctgttcggtggactgtttttattgtttaaagcgacaacagaactgaacgaaagactagaaggtagcgatgacgacaacgctcaacaaaaaggcggcgctaaattctggccagtagtggcacaaattgtggtgctggacgcgatattttcgctggatgcggtgatcacggctgtcggtatggtaaacgatttgcccgtgatgatggtcgcggtcaccgtcgccattttattgatgttgctggccagtaagccccttacccgcttcgtcaacagtcacccgtccatcgttatcctgtgcctgagttttttgctgatgattggctttagcctggtggcggaagggtttggctttgccattcctaaaggctatctctatgccgccattggtttctcggtgcttattgaagccctgaaccagcttgcgcagtttaaccgtcgcaaggtgctgtctgccggtcgtccgttacggcagcgtaccgccgaagcggttttacgcctgttacgcggcgaagccgaacgggcagaactggatgcaaaaacgtcgtcgatgcttgccgatggcgattcagtcgcgctgttcaatcgtcaggagcgcgtgatgatcgccagagtcatggggcttggacagcgccacgtaaacagcattatgacgacgcgccacgatgttcagcatattgacttaagtgacgatccggccgtcattatggcgaatctcgacagtaatcagcatacgcgcatcgttatcacggataacggcaacgaaccgctcggtattgtgcatgttaacgatttgctgcatcagtcactgcaccagcattctctcgatttacgcagcctgatccgccagccgctggtgtttcatgaacgcatcaccctgttacaggcgctggagctgtttcgtcaggggcacacgcactttgcttttgtcgttgatgagtttggttctgtggaaggcgttgtcaccttgagcgatttgatggaaaccatcgccgggagtctgcccaatgaggcaggtgagaccgatgcgcgctatgacattcagcctaacggtgcgggcggctggattgccaatggccaaatgccgttagaagacctggcaatgtatgtcaccttgccgctggacgacaaacgtaattatcacacgcttgccgggctggtgatggatcgacttcagacgatcccgcaggaaggcgaagaaatcgcactcggcgattaccggttacgcaccctgcaggttgaacaccaccggattcagaaggtagaaatcctgccaaaccccgacgcgccgcactgaagccgcacctttatgggcgcggcgaatcctggcggctgtctttggtctgctgacgatcgagccactgattcagacgtgttttagcctcgttttgcaacttatcacggagcacgtcgtcaaccggcagcgtatattgtggattatcccagctgccgtagatacgaaacgggatcgcctggctggagagcgctgcaaccagtttttcgtcaccctgccagccactcagcgtcaggcccagcgtcacgtctaactgttgctgcaccatattgacactgccgtcgccccgtaatgccagttgcttactggtaccgttaagatggctaaaggtgagttgcccttttttcagtgcaagctggccgctaatttcgtcgatgccctgccctgatgcctgatcgtcactgctgatacggtcgctgacgcgtgcgacggcgcgacgcaccatctgctgcaagtcaatttgtgccagcttgaggtggctcacacggatatccgctttgccctgccagctgcgtttcgcatcctcaagggtaaggttatcacccgccaaatcgccattaagatccaccgttccctgtaacgactgcggcaaggcaagcgcctttaacaagggctggatatcaacctggttcagcaccggcttaaaggtgacatgggtaacgggttgacgaatatcaatgctgccaggaacagagaaactgccctgccctactgagccagacagcgtgcgcagtgtcatcaagccctgttggttaaccgcatccacagcgaatttggtgaggctaagacctcgccacaccgccttatccgcctgcagtttgacatccagatcgatatcgttgagcggcgagtccgcattcgtgggttcgcgctgatcggcaatcaccggcgcaggggcgatctggctgctttgcccactcacctgctgggtcagtgatgagataaaaagcaggttgtccatatcgagtgaagtggcatgaaggtccagcgccagttgttgcggtggcgtgaggttgccttgcgcgttgccgctgagaacgctgtcgttggcgttaagcttcaggtcggtgacggcaaaggtattcctgtcggcattccagcgtccctgaaagctcagcgtacctttaatgccctgcggcggcaggctggcaccagacagatcgtaatccagctgatcgagctgaccgcttaactgatgaggatactgtgatttgtccagccggcctttcagattgactcgcgccgtgcgctggttgcgcgtcaggctggtattcagcgtgatcgtggccacgctggactgatcctgctccatatccagattcagattgcggaaggtgaacgcatcaccgccgggctgttgccagataaacaggctgtccgacagctgaagcttgtcgatatcgaatgaccagcgggcagaagaggtcggctcggtattgtgcgggccgcgcggcgcatcctgcggggcctgtgcggcactgtcaggtgtcacccgcaccacggcatttttcagcatcacctggctgacgctcaactgatgcgacaataaaggcaggaggtttacatccaggcgcatgttgtctgcagaaacgacgggctgcgacgcaccgggcgccgtcagactcatacgaccggcaagaatgctgagttttggccagacatgccagcgcaaatcgccgttgatggtaagttgataaccgctgcgctgttcgacctgttgtaccatgtagctacgaaagtcgttgggattgaccagcaaaaccagcgcggtcaagcctgctacgaccaccaccagtaagatggccagcgtggttatcactcttctcatcacatcctcatgaattagtctttatcgatacgactggcatcagcaccctgctggcctcgatatttcgcgttctcacggcgattataagggcgcgcggctggcccggaaagcggctcaaagcttagtgcaccaatcagcattccggggcgcagcgccaggggcagtttgcccgaattatagaactccagcacgatacggccctgccagcctggatcgatacggtgcgcggtcacatggaccatcaaacccaggcgcgccagcgaggagcgtccgtccagccagcctacgaggtcgtcaggaatggtgacggattccagcgttaccgccagagccagttctcctggatgcaggaagaacgcctcgccttcggggagaacgatctcatcgctcatcacgcgatcgagcgcggcactcacttcgtccttcgggccactcaggtcgataaaggcagcggtatgtccactgaaagtacggaactgattgcctaaacggacgtcaaccgttgcaccattgatacgttctacgggtggccgcggcgtaatcgccagttttccgctatcaagccaggcttcaatatcgcggtcgcataatctcattgcggtaactccatgaagtaagtgtagcgaacagggcgcatctgtgctgttaacctgttcgcgccacgtcctttgagacgtaaactactcgaagaactggttaatcttggccttgaggatatcaatggcgatacggtttttacccccgcgcggcacaataatatctgcatattgtttggagggttcaatgaattgcagaaacatagggcgaaccgttttctgatactggctcatcacggagtccattgaacgaccacgttcattcacatcacgcttcatacgacgcatcagacaaatgtcgagcggcgtatccacaaagatggagaaattcagttcctgacgcaggcgcgcatcggtcaacagtaaaatgccttcaaggatgatgacttttttaggcttaatttgcagcgtttctttcgtacgggtgtgctcgacatagctgtacacgggtaactcaatgtcctgtcctgcttttaccgcacgcaaatgctgtaataacaaatcatgatccatcgcgctgggatggtcataattggttttaaccctctcttccatggtgaggtgactttgatctttgtaataagcatcttcaggaataacgccgatatgttcatcgcccacctggtcgcggatttcacgatagagagtactggcgattaaacttttaccggatgcggatgcacctgcaatgccaacgatcacgcactgatgagacttgtcagtcatacttttaaaaacctgatactggagccagaaactgtgcgcaaactgcgcacccagttaatggggctgaacggagagggtgagttggcgctaagtatagggatttcggccttttgatgccagagaaatggcattctcccttttcagactttccccttttaacctaacggatttcaccgataaactagcagcacaaaacagaatgacgacgcacagcacctgtcgggcctgatgtggctgatgaataagggcgttttgcccgaagaagaataaaggaagactatgctctggaagaccctcacctattttggtgacagtatgttgttgattcccacggcggtgattattgcactgattttgccgtggaaaagcgataaccgccgcaccgtatggtactggatcatggcgtttggtttagccgggttggttgtcagcgtgtccaaaatactgtttcttggttttggtatcggtagcgcccgctttaacttcaccgggtttagcggtcacagcgccatgtccgctaccttgtggccagtgatgctttggttaatatcagggcgctggtcaagccggtggcgcgtctttgctattggtgtgggctatgtcattccattgatggtaggtctgtcacgactggtcattcatgcccattccattagtgaggtactgaccgggctgttgctgggctttacgctcagtaccgcgtttttactgtcgcaacggcaaacggcgctgaagggctttagctggccacaaattgccgcggcgctcctggtcccggtactgctgctggggcacggccggatagccacgacacaacagtttctggagcagttttctgcccgtctggctggcatggaaaaaccttatacaagggccgatcttttccgcgactgataaactgaatggcgcgtgctggcgcgcgccattcaatccaacgaataccgcaatttaatgatttcccccctgttttttctaccaaatgtgctagcattcttccaataacaatggctcgcgcaccgcattccattgcactatcttgctccctgctggatcgataaatgatcgttgagacactggcctcgtcagataaatcacctaacacgtggctacacgcctgctggcttagcctggcttccttcgtccttacgttgttctgtcttgaactaattgtggtcagcggtaaaatttcgccgctctggttctcaacggcactgatgaccatcgtggtttttcgttgcacttcacgccagctgccctttttgcttcttgcctgcttaattggtacggcggtggcaaacgcattgatcatcggccctgccctttcaaatttaaaatttgcgctgcttaatctgttgcaggccctgatgggcggatttttattacgcgcattacttaaccgggatgcgccgttggtttcgctaaatgactggatacgctttgtcattgccaccggcatcatttctccgtttattggcggtacccttgccctgtgggtactgcacgtgggtgaacaggcgtcgtttgccttcttttatacctgggtgatttcagaaattatcggcatgctcgcccttggcccggttttgctgctgctctcctggccactgccgcacgattatctgaaacgcgcgtcgctgtttgaaacgcttatcaccctcgttctgacgctcaccgccagctatttatcgctgcggttcttaccctggccgtttacctttattttggtcgtgctgttctggtgtgccgtgcggctgcccaaggtcgaagcctttgtgctgttttttcttaacgccagctttatggcgttattgctctcattagactggattaaggtcacgtctaccgtcagcgcctatgcagtcatcaccagttggcttccgtttttgatggttttaatcccctgtcatatcatgtcgttagtgatggatgctttccgccatgaaaagcatcacattagcgagagcgaaacccgttttcgtcatgccatggagtattcagccattggcatggcgctggtttctgtagaaggccgatggcttcaggtgaataaatccttgtgcgatacgctgggttatcccgagcatgaactcaccaaactgaccttcctgcaaattacccatcccgacgacatctatgacgatcagaagcgcctggagaagctgctcgaaggcaaaatttattcctacacgctggaaaagcgctattttcgcaaagacggcgaaatagtctgggtacggctgaccatctccctggtgcgcgataacgcgcagcaaccgctctattttattgcgcagattatcaatatctccgaactgaaacagagcgaactggtgaatcagcgtctgatggagcggattacgctggcgaatgaagcgggcggcatcggcgtatgggaatggaacatggtcagcggcgaagtgctgtgggataaacgcatgttcgagctgtttggcatgaaatcctatgaatcgcccagctacgagctctgggtgaagatggtccatcccgccgatcgtgagtattgcgtgatgacgatacaaggcgctattgaacaaagcagtgcgttccagatggagtatcgggtggtgcgtgaggatgagcactactggattcgtacccaggctaatcgcctgctcagtaaagatggccgtattgagcgcatcctggggatctcccaagacatcacgccgttacgtaatttgaatgatgcgctgtttcaggaaaaagagcgcatgatgatcacgctggactcaatcggtgaggccgttatcagtaccgatcaggagatgcgcgtgacctttatgaaccctgtggcggaaaaaatgacgggctggtctcaggacgccgcggcaggcaaaccggtcagcgagctattgcatatcacccatggtcgtcatggccctgaagtcgaaaacctgctgctgaaccacatcccctccgaaaaaaccgcgccctacctgtctgaagagtggatattacacacgctgaacggcgaacatattgatatccattacagtattacgccgctcaaatctgaatctggcaccgagcgcggtgcggtgctggttattcaggacgtcagcgagtcacgtaaagtgatgaaacgcctgagttacagcgccctgcacgatacgctgacccgattgcctaaccgggccagctttgagctgcaacttaagcgactgctttccgacgctgtcgagcatcagaatcagcacgtgctggtgtttattgaccttgataaatttaaggcggtcaacgacagcgcgggacatgccgccggggacgccctgctaagcgaactctcggacttaatgcgccaccgcctgcgcggcagcgacttcctggcccggctcggcggcgacgagtttgccatcctgatgcccgaatgccgggtcgatcaggcctgcgaagaggtcgaaaacatcgttcgcgccgtcagtgactactgttttgaatggctggggcgcgcctatcaggtcggtgccagcgcgggcattacgcaaatctccgcacagaacgcgcagagcagtgatgtcctctcgcaggcggatattgcctgttataacgccaagcgtagcgggcggggccgctatatggtgtatgagcagcaccctctcgcgttgatgggaaaccctcacgccctggatctgacgatgctggatgccttgcaggttgaaatgcaggtatgggcggtcgcgccgccaggtaagcctcattctgccagcgtctggctggtggagattcagctgttcaccgagaaagggttgcttattgatgagcatctgctgcgtaacaacctgaccgatgaggcgctgaaacgccgactggaagacaatatcgttgcggcctttttcggtcagcgtatttcaacaatgagccaaaaaggcatcgccttgatattgccccttgatgtgaacgcgctttacgatccggcctttgtcgaaaacctgtgttttcgctttgcggaatcgggtcttgccgacagccatagcgggattgcgcttaacgccgccagcgtccttgccagcggtgagcgcctgatcggcgcgttgacgaagctacgccaggcgggctgtcgcatcgtgttgcagcattttggccgtaatctggatgcctttaatcagctcaccggcaaggtcgttgactgcctgattctggccccggagctggttgctaacctgcacaataatctgatggatgagatgctgatctccattattcagagccagaccagccagcgtgatattaccctgcttgcaggcccggtttcggttccagccgttctcaccacgctcacccgtctcgacgttgacggcgtctggggaagcgcggtcgcagaacgccagccactgagtaaactggcggaagagtcccttttcgcgattcgctaattctgccgctcaccgcttgccacgacctttcagctgcgctaaagtcgcccccttttttcctgcctgggggcgaaaaatgttcattggattcgattacggtacggctaactgttccattgcggtcagcgaaaatggctcgccacggctgttaacgctggagaagggtcaacgcctgctgccgtccatgatttgctcccctacacgtgaagccgtgacggaatggctctatcgccatcatcaggttgccacacctgaacaggaaagtacggcgctgctgcagcgggcgctacgctacaaccgcgaagaagatatcgatgttttacccgacagcattcagtttggcctgaccgcgctccagcattacatggtcgatcctgaagatgtctggtttgttaaatccccaaaatcttttctgggtgccacgggcctgaaaccgcagcagattgctttttttgaagatctggtctgcgccatgatgctgcacattcgccaacagggtgaaacgcagacccagcagccgatcgaccaggcggtgataggccgtccggttaactttcaaggattaggcagcgaagacgcgaatcagcaggcacagggcattttgttacgtgcggcgaaacgcgcgggcttccgggatgtggaatttcaatttgagccggtggcggcgggcctggattttgaggcgacgctggataaggaaacccgtgtgctggtggtcgatattggcgggggaaccaccgactgctcgatgctgctgatgggcccgcagtggcgcaacctgtcagatcggcgtgaaagtctgctgggccacagcggttgtcgcgtgggcgggaacgatttggatattatgctggcgttcaaggcgctgatgcccttactgggcgcgggcggtaacacccagaaaggcactgctctgcctgccctgccctggtggaacgccgtcgccatcaacgatgtgcctgcgcaaagcgatttttacagcaccgcctgcggcaagatgctgcgcgatttagtccgcgaggcagaaaatcctgtcgccgtcgcccatttactcaaggtatggcagcagaagctgagttatcgcctggtccggaccgccgaagaaagcaagatcgccctgtccgatcgccccgactttacggcatccctggattttatcaccgccggtttacaggccgatatcagcgtgaccaccctgcaggatgcaatcagccagccgctggagaagattctggagcaggtacagctggcgctggcaaccagcaatatcaaacccgaggtgatctatctcaccggcggcagcgcccgctcgcctcttttacgcgccgcactgcagcaggccctgccgggtacgcccattgccggtggagacgattttgcctcggtcaccgcaggtctggcgcgctgggcagaggtgatgtttgcctgaccctgccgggtgagacagctgccaggtgagacagtagaaggacagcgtcaacggccggcgatgtcgccagagtcggtattacggctctgcggtcctcgcgccgctgagacgccctctctacatcattcgttcacctgacgtcacctcatgccttttgctcgccttcctgcgggcaaacgctggcgttttcacgccgctccgcgcggcgtattgccgcctgacacctgctccttctggctttttgcgcttgttgccattgatgaatttaataaatcatttcctgaccacaacagctcatcgcgcgctattctgtggcacactcattcaaatgcgttatgaatacggcccatcaattaaacgacaatatgtcttcagaaaatcgacataattacgcagtgctgacagatatccttaattccttcaaattttcacccgcagggacgactacaattcgtggtttgcaggcaaccttttaagcccgcgccctggaaagacagtgctggagagcaacaacaacaatgaacaaccgataccctgttatgaaaaaagcgttgattgcgctggtggtgattgccgtggccgcaggcggctattactggtggaagcatccggcccaacccgcaagcgacggtgacgcatccagccagtctgcacatggtaaaagaggcagtggcgcgcataagcccttagcgccggtgcaggcggccagtgcggtcaaagagagtgtgccgcaatacctgaatgggttaggcaccgtgacagccgccaacaccgtgacggtgcgtagcagggtggatgggaatctgatggctatccacttcacagaaggccagcaggtgaaagctggcgatctgctcgccgagatcgatccccgtccctatcaggtagccctcatgcaggcacagggtcagctggcgcgcgaccaggctaccctggcgaacgcacgccgcgatttagcccgttaccagaagctggcgaaaacctcgctggtttcccagcaggatctggacacacagagcgctctggtgaatgaaaccctgggcacgataaaagccgatgaaggcagcgttgccagcgcccaactgaatctgacttacagtcgcatcacttcacctatcgatggccgcgtgggtctgaagcaggttgatatcggcaactacattaccagcggcgacaccaatggcctggtggtgattactcaaacgcatccggtggatgtggtgttcagcgtggctgaaaacactatcagccagatcatgcaggcgcagaaaactggcgaacctttactggtcgaagcctgggatcgcagcaatcagcatttgatcacccgcggtaaactgctcagtctggataaccagattgatgtgaccaccggcacgattaaaattaaagcgcgctttgataatcaggatgacctgctctttcctaaccagtttgttaatgcgcgcctgaaggtgaataccttacaggatgccgtcgtgattcccaccgcagcactgcaaatggggaatgaaggccactttgtctgggtgatcaacagtgaagacaaggtcagtaagaaaagcgtgaccgccggtctgcaggacagccagaaagtggtaatcagcgccggactcaacgcaggcgatcgcgtcgtcaccgacgggctggaccgcctgacagaaggggcaaaagtcgaagtggttgccgcgcagagtcgcgccacaaaagagacccgcaccagcttgccgtccaaaggggaatctgagtaatgcaggttatgcctcctgaccacagcggagggccgtcacgccagtttatcctgcgtccggtcgcgaccaccttactgatgattgccattttactggcggggattctgggttaccgctttttgccggtctctgccctgcctgaagtggattatccgacgattcaggtcgttacgctgtaccccggggcgagcccggatgtggtgacctcctccattaccgccccgcttgaacgccagttcggccagatgtccggactgaaacagatggcatcgcaaagctcgggtggcgcctcaatcgtcacgctgcaatttcagttgacgctgccgcttgatgtggcggagcaggaagtgcaggcggcgatcaactctgccaccaacctgctgcccagtgacctgccaaatccgccggtttacagcaaagtcaatccggccgatccaccgattatgaccctggccgtcaccaccagcagcatgccgttaacccaggtgcaggacatggtggaaacccgtgtcgcacagaagatatcgcaggtcaccggcgtcggtctggtgacgctgacgggcggtcaacgtccggcggtgcgcgtgaagatgaacagccaggcgctggccgccatggggctgaccagcgaaacggtgcgcacggcgatcaccaatgccaatgtcaactccgcgaaaggcagcctggatggccctacccgctcggtcacgctttccgccaacgatcagatgaaatcggtagaggattaccgccagttgatcgtcagttataaaaatggtgcaccggtgcgcctggcggatgtggcaaccattgaacagggcgcagaaaacagctggctgggtgcctggtccaaccgtgaaccagccattgtgctgaatgtgcaacgccagccaggtgccaacattattgccaccgccgatagcattcgcgccatgctgccgtcactgatcgccagcctgcctaaatcagtcgacgtgaaactggtcactgaccgcaccaccaacattcgtgcgtccgtcagcgacacccagcatgaactgatgctggcaatggggttggtggtgatgatcatctacctgtttttgcgtaacgtgcctgccaccattattccggccgtggcggtgcctctgtcgctgattggtacctttgcggcgatgtattttttgggtttttccatcaacaacctgacgctgatggcgctgaccatcgccacaggctttgtcgtagacgatgccatcgtcgtgattgagaacatttcgcgctatatcgagaaaggcgaaaaacccatgacggccgccctgaagggcgcgggcgaaattggctttaccattatctctctgacgttttcactgattgcggtgttaatcccgctgctgtttatgggtgatgtcatcggccgtctgttccgcgaatttgcggtgacgctggcggtggcgattttgatttcagccgtggtctcgctcaccctgacgccgatgatgtgtgcccgcatgttgagcgcagaatcgctgcgcaggcaaaaccgcttttcccgcgccagcgaagccatgtttgagcgagtgattgcggtgtacggtcgcgggctgagtcgggtgcttaaccatccctggctgacgttatccgtggcacttggcacgatgctgcttaccgtcttgttatggatcgcgattcctaaaggctttttcccacagcaggataacggcatcatccagggcactctgcaggccccgcagtcggtgtcttacgccagcatggctgagcgcacccgtgacgttgcctcggtgataatgaaagatcccgcggtacaaagcctgacttcgtttgtgggcgtcgacggcaccaatccgtcactcaacagtgcccggttgcagatcaaccttaaaccgctggatgcgcgcagcgaacgtattcctgagattcagcagcgactgcaacagcaaatcagcatgatccccggcgtcacgctgtggctccaggcggttcaggatctgacgattgatacccaggccagccgcacgccctatcagtttacgctacagtccggatcgctggactcactcagcacctgggttcctgcgctggtgagcgccttgcagaaactgcccgcgctgcaagatgtcagcagcgactggcaggatcagggcctggaagcctatatcaaagtcgatcgtgacagcgccagccggttgggtatcagcatggcggatgtggataacgcgctctacgacgcctttgggcagcggctgatctcaaccatttatactcaggcaaaccagtaccgcgtggtgctggagcaggacaacagcaccacgcagggcctgcaaagtctggagggtattcgcctgatcagtaccgacggcggcagcgttcccttaaatgctatcgccagcattgagcagcgccatgcgcctttgaccatcaaccacctgagccagtttccgtctgccaccttctcgtttaatgtggcgaagggctattcgctggaagatgccacaaaggcgataacccaggccgaagaacaacttggtatgccgtcagaagtgatgacgcagttccagggcagcaccctggcgtttgaagcggcactgacgagcacggtgtggctgattgtcgcggctgtcgtggcgatgtatatcgtgctgggcgtcctgtacgagagttttattcatcccatcaccattctttcaaccctgccaaccgcaggtgtgggtgccttgctggccctgatgataagcggcaacgagctggatatcgtggcgatcatcggcatcattttgctgattggcatcgtgaaaaagaacgccatcatgatgattgacttcgccctggccgcggagcgtgaacagggcatgaagccgtatgacgcgatctatcaggcctgcctgctgcgtttccgacctattctgatgaccacgctggccgcgctgctgggggcgttaccgctgatgctcagcaccggcgtcggcgcagaattacgccaaccgctgggtattgctatggtcggcggcctgatcctcagccagattttgaccctgtttaccacaccggttatttacctgctgtttgaccgactggcgcataacctgcgtcgccgcctcggtcacacggaggaacagcagtgaaattttttgcgctgtttatccatcgcccggttgccaccacgctgctgacgctggcgattgcgctggccgggatgctgggctttcgcctactgcccgtcgccccgctgccgcaggtggattttccggtgattatggtgtcggcttctctgcccggtgcctcgccggaaacgatggcctcgtcagtcgccacgccgctggaacgttccctgggccgcatcgccggcgtcagcgaaatgacctccaccagttccctgggatcgacgcgcatcattatggtcttcgattttgatcgtgacattaatggcgcggcgcgggatgtccaggcggcgatcaacgctgcgcaaagcctgctccccaccggtatgccttcgcgcccgacctatcgcaaagctaacccgtctgatgcgccgatcatgatcatgacgctgacctccgacctgttcagcccggctcagctctacgattacgcctccacacagctggcgcagaagctgtcgcagattaacggcgttggcgatgtcaccgtaggcggcagctctttgcccgccgtgcgcgttgcgctgaacccgcaggccctgtttaaccagggcgtttccctggacgcagtacggcaggccatttctaacgccaaccagcgtcgtccacagggcgcgctagaagatcgtcaacagcggtggcagctgcgcaccaacgatgcgctgcaaaccgccagtgaatatcagcccctggtggtgcattacaacaatggcgcagcggtgcgcctgtcggatgttgccacggtgcaggattcggtacaggacgtacgtaacgccgggatgtcacggggtaaaccggcggtgttgctggtcatacgcaaaaccgccgatgcgaacgtgattgacacggtggatcgcattcgtgccgaactgcccgaactgcacgagattatccctgcggccattaaccttgaggtggcgcaggaccgctcgcccaccatccgcgcctcgcttgaggaagtggaacagtcgctggtaattgccgtcgcgttggtgattctggtggtgtttgtgtttttacgctctggtcgcgccacgctcatccctgccgtggcggtgccggtatcgctgatcggcaccttcgccgcgatgtatttatgcggcttcagcctgaataacctgtcgctgatggccctgacgatcgccaccggatttgtggtggatgatgccattgtggtgctggaaaacatcgcccgtcatgtggaagccgggatgaaacccctggctgctgcgctaaaaggcgtgcgtgaagtcggcttcaccgtgctgtcgatgagcctctcattaattgcggtattcctgccgctgctaatgatgggcggattgattggtcgcttcttcgccgaattttctatcacgctgtcggtcgccatcctgatttccctgtttgtctctgtcacgctgacgccgatgatgtgtgcttacctgctcaagccccatgcgccgcgcagtcaaccgcaacgccggggatttggacggctgctgctggcggtgcagcgcggttatgcgcgctcactgaccgtggtactgaaccatgcgcgctgggtactgttgctgctgctggggacggtggccctgacggtatggctgtttatcagtattcccaaaaccttcctgcccgagcaggacactggccggttgtcgggctttatctcagccgaccaaagtatttcgtttcaggcgatgcgcggtaagctggaagactttatgaaaatcgtcggtgccgatcccgatgtgtccagcgtggtaggctttaccggcgggatgcgcaccaacatggggctgatgtttatttctctgaaaccgctgtctgaacggaaagacaatgcccagacagtgattgcccggttgcgtacgaagctggcaaacgaacccggagccaacctgtatctcaatgcggtgcaggatattcgggtgggcggtcgcgaagccaatgccagctatcagtactcgctgctgtcagacgatcttgctgcgcttcgcacctgggaaccccaaatccggcaggcctttaccgccctgccggaactggctgacgtcaactccgaccaacaggataagggcagtgaaatggccctgacctacgatcgcgccagcatggcccggctgggaatcaacgtctcagaagccaacgccctgttaaatgatgcatttggtcagcgccagatctccaccatttaccagccgctgaaccagtacaaggtcgtcatggaagtggacccccgctatacccaggacatcagcgcgctgaatcagatgtttgtgattaacagcgagggcaaaccgatcccgctcgcctggtttgccaaatggcagccggctaatgccccgctgtccgtcaatcatcaggggctgtctgccgcatcgaccatttcctttaacctgccagaaggtgtttccctgtcacaggcgtcggaggccatcgaccgcaccatgaccgcgctgggcgtgccgtccagcgtgcgcggcagctttgccggtaccgcgcaggctttccagcaatcgcagagcagccagctgtggctgatgctggccgccattgcggcagtctatattgtgctgggcattctctatgagagctacgtgcatcctttgaccattctttcaacgttgccctcggcaggcgtcggtgcactgctggcgctggagctgtttgatacgccgttcagcctgattgccctgatcggtattctgttattaatcgggatcgttaaaaagaacgccatcatgatggtggacttcgccctggaggcagaacgtaagggtaacatgagcgcccgcgatgccattttccaggcctgcctgctgcgtttccgccctattttaatgactaccctggccgcgttgtttggcgcactcccgctggtgctgaccagcggagatggcgcggaactgcgacagccgttagggatcaccattgcgggcgggctgatcatgagccagctccttaccctgtataccacgccagtggtgtacttaatgatggataaactgcgacgcaaaaagcgcactcagacaatgaatgcgacgcagcactaaggggtaactatcatgcagagcgtaacggtccgctggcagttatggattgtcgcctttggcttctttatgcaggcgctggataccaccatcgtcaatacggccatcccgtccatggcccacgatctgggcgtgagcccattgcatatgcattcggtcattgtcgcctacgtgttaacggtggcggtcaccctgcccctgagtggctggctggccgatcggtttggcgtcagaaatatcttcttcagcgccatcgtgctgttcagcctgggttcgctgatgtgcgggttatcccacacgctggatcagttgctcgtggcacgtgtactgcagggcatcggcggggccatgatggtgccggtaggcaggctgacggtgatgcgcattgtgccgcgcgatcaatatatgtccgccatgacgttcgtcaccctgcccggccagattggtccgctactgggtccggcgctcggcggggtgctggtggaatatgccagctggcactggattttcctgattaatatcccggttggcgtgatcggcgctatcgccaccttaaagctgttacccaactacgccatgccgccaagacgcttcgattttttgggttttgttctgctggctgcgggcatggcaaccctgacgctggcgcttgatggccagcgcagcagcggcggctccgcgttgttgctggcggcaatgatcctgacaggcacaggttccctgctgttttacctgctgcatgcgcgccacaacgacgatgcgctgtttagcctgaagctgtttgataatcgggtgttctccatcggattactcggtagcctggcgggccgcatcggcagcgggatgttaccttttatgacgccgctttttttacagatcggaatgggtttcagcccgtttcatgccggtttaatgatgattgcgatggtgcttggcaatatgggcatgaaacgcatcgtggtccgtatcgttaacctgttcggctatcgcaacgtgctggtgggatcgaccgtcggtctggcgttggtggtgttgctgtttccgctggttgcgatgctgggctggacggccatgctgccgctggtgttattcctgcaagggatggtgaatgcgattcgcttctcctcaatgaacacgctgacgctgaaagagctgccggacgatctggcatccagcggtaacagcctgctgtcgatgatcatgcagctttcaatgagtatcggggtaaccgtcgcgggcctgctgctgggcgcgtttggtcagtcggcgctggggcaacaggggttaagccaccaggcctttatctatgtttatctctgtatggccctgatcattattctgcctgcgctggtgttctggcgtgtcccgaaagaagagagtaaaagcgtcgatctgcgacgccggagaagtgaatgagatcgtttctgcgcgttggcatcggtgccaagctgtttatggctattttctccacctgcatgctggtactgattaccatgcactggggcgtaaggctgagctttgagcatggcttcgtcgactacatcaaacgcggtaatgaacagcgactgaatttgctgggcgcggcgctggccgatcagtacgaacagcatggcaactgggattttctgcgcaacaatgaccgactgatttttaccatgctgcgctcgctggagcagaatcccgacagcaacaatcagcttccgccgcacggctggcgaacccagttctgggtgctcgatcagcaatataaagtgatggttggtccgcgctcacaggtaccgccagagggaatacgccacaatatcaccaccagcaacggcaaggtggtgggctggatcatcagctcaccgcccgaacgcctgacgcgcagtaccgacattaattttgatcagcaacagcgacgaaccagctggtatatcgtcggcttgtcaactctgcttgccgcgctggtgacctggctgatggcgcgaggcttgctggctccggtaaaaaggctggtggacggtacccatcatctggccgaggggaatttagccacccgagtagaagtcagcagccaggatgaactgggccagctggcacatgactttaacctgctggccagctcactggagaaaaatgaaagtatgcgccgggcgtttatggccgatatttctcatgagttgcgaacgccgctggctattttacgcggtgaactggaggcgatgcaggatggcgttcgtcagctgacgcccgacgccattacctcattgcaaagtgaagttgcattgctgacgaagctggtagacgacctgcatcagttgtctctttctgacgtgggtgcgctggcttaccgcaagcaggccacggatttggtgcagctcattgaggtcagcgcaggcaactttaccgaacgctaccgtgcccatgacctgacactgaaactggctatgcctgaagatgcgcccttctttggcgatcccgatcgcctgatgcagttgtttatcaatctgctggaaaacagcctgcgttataccgatgcgggcggcacggttcaggttcgtctctggtatgacgcaccctactggcacgtcaccgttgaggacagtgcacccggtgtggatggcgatcagcaggcgcaaatttttgaacggtttttccgcaccgaagggtcccgcaatcgggccagcggcggctcaggtttgggtctggcaatctgtaaaaatattgttgatgcgcatggcggaaccataaccgcgacgcacgctgatttaggtggactgaaaatcgcgctacaattgcgttatgttcctcccgtttagaagactatgaatcaggaaaacacctatccgctaatccttgtggttgaggatgaacccaagctggcgcaactcatgatcgattatttacaggcgtccaactaccgtacccaccatctggcgcatggcaatgaggtgctggactacgttcatcagaccccgcccgatctgatcctgctggatttaatgctgccaggtaaggacggcctgacactgtgccgtgaaatccgccgtgactctgaactgccgattattatggtaactgcgcggacagaagaaatcgatcgcctgctggggctggaaattggggcggatgactacgtctgtaaaccgttcagcccgcgtgaagtggtggcgcgggtgaaaaccattttgcgtcgggtgaaacgttcgcctgaagaagccccggttgcgtcgctgctgaaagtgcatgaaagtcgcttccaggccagctggcgcgatgaaccactcgacttaacacctgcggaatttcgcttgttaaaaacgctgtcccttgagcctggaaaagtgttttcacgcgagcagctgttaaaccacctctatgacgattatcgggtcgtcactgaccgcactattgacagtcatatcaagaacctgcgcagaaagctggaaaacctggacagcgagcagcctttcattcgcgccgtgtatggcatgggctatcgctgggaagccgatatctgtcatttgatttagattgattcagatcaatttacttcctttttctcactgcctacaattccgcacctttcgcaggggtaacgcccctgcacgtgccgcccaaggcggcatactgacctgacatcagtgagtacgccatgaaaccagaattactttctccagcgggtacgctgaagaatatgcgttatgcctttgcctacggcgcagatgccgtgtatgccggccagccacgctacagcctgcgggttcgtaacaacgaattcagccatgaaaacctggcgaaaggcatcaacgaagcccatgcgttgggtaaaaaattttacgtcgtcgtcaatatcgcaccgcataacgccaagctaaaaacctttatccgcgacttaacgccggtgattgagatgcagccggacgcgctgattatgtccgatcccggtttgatcatgctggtgcgtgaggcttttccggccatgcccattcacttatccgttcaggccaatgccgttaactgggcgaccgtgaagttctggcagcagatgggcctgagtcgggtgattttgtcacgtgaactgtcgctggaagagattgccgacattcgacagcaggtgcccaccatggagctggaagtcttcgtgcacggcgcgctgtgtatggcatattccgggcgctgtctgctttccggctacatgaataaacgcgatccgaaccagggaacctgtaccaatgcctgccgctgggaatatcagttgcaggaggccaaacaagatgacgtcggcaatattgttgaaatccatcagccggtgacggtgcaggatgtcacgccaaccctgggcatcggtcaacccagtgacaaggtttttctgctggaagagaagatgaaacccggcgagatgatgagtgcctttgaagatgaacatggcacctacatcatgaattcgaaagatttgcgtgccgtggcgcacgttgaacggctgagccagatgggcgttcactcattaaaaattgaaggccgaaccaaatcttattattactgcgcccgcaccgcgcaagtctatcgcaaagcgattgacgatgccgccgccggcaaaccttttgatcctgccctgctggaaaccctggaaggtctggcgcatcgcggctataccgaaggcttcttacgtcgccatacgcatgacagctatcaaaattaccagaacggctattctgtttctgagcgccaacagtttgtcggcgaattcagcggtgagcagcacgatggctgggcggaagtcgtggtgaagaataaattcgtcctgcatgacagcctggagatcatgacgccctctggtaacctgatttgtaccctggatgccttacaaaacagccggggcgagccgacggacgtggcgccgggagacggtcatcgtgtctggatgaaggtgcctccacaggtcgatctgcaatttgcgttgctgctgcgcaattttaccgacggtcaggatacgcgcgcgcctcacgccaccggtgtgacaggttgacacattttgacaaaagcacgagaaggatcacagacggcttaattttgctgctctatagtgctgcctgctaccaatgagtaacaattatcagcagctgtaactggatccacctcattcacccgcccggctcccccgtgcgggttttcttttttctccctttcgcccatcatttttctctccaggctgtgctataaccactacctacgctttagatcttcaaggaacagataatggacaaagaatcgcttacgctgctgatccttaacggtaaaggcgcaggcaatgatgatctacgtgaagcggtcactaagctgcgcgatgagggctacaacattgccgtgcgcgtgacatatgaaaaaggcgacggcgaacgctacgtcgaagaagcgctggaattacaggcggtcaccgtggtggcgggcggcggcgatggcaccgtcaatgaaatcgccaccgcactggcgtcggtaaatgtcgccgaccgtcctgtcttggggattattcccctgggcacggcgaacgattttgccaccagcgtcggcatccccgaagagatcgaaccggctttacggctggctattcagggcaaagcgtacgacatcgatctggcccgggtgaatcagcgtcactactttatcaatatggctacaggcggtttcggcacgcgcattaccaccgagacgccggaaaagctgaaatcggcgctgggtggggtttcctattttattcacggcctgatgcgcatggacaccctgaaacccgacagctgtgaaatcagcgggcccgatttccactggcaaggcgatgcgctggtcatcggcattggcaatggtcgccaggcgggcggcggtcagcgattatgcccttctgcgttgattaatgacggcctgctcgacgtcagcgtggtcaccgcgcaggagttactgcccaccctgctgcattccctcaccggcggcgatgaagataatcccagcatcatttcgacccgtttatcgtccctgacgattcgctcgccccacgagatgacatttaatctggatggcgagccgctgtccgggcaggaattcacgattgatgttatgccgggcgcgttaagctgccgtctgccaccgcagtgcgcattgctgaactgagtgcgccgggagtgaaggctcccggcttaaatgtaaacagttcgtgattacattcacaattttgttacgtcaacttgtatggtagtagtaggacgcgtaatttttcatccttaacgccggaatggcctgtcgtcctctccgctaaaaggatgcattatgctgcaaactgaccaccttcccgctgatgtccagcgcccagcctacaaccgtcgccagcttaaaacccgcatggtgcacatcggttttggtgcggtttcatcgcgcacatcaggcgttatgcagcgataagctggccgaacacggcagtgactggggatactgtgaagtcaaccttaacagcggtgcactcattcaggcgctgcgtgaacaagacctgctctacacgctgacagagaaaagtgatgatgcggtggaaacccgcgtgatcggcattatcaccgccgcgttacacggcaaaacggacggtatccaagccgtgattgacgcgatgtcccagcctgatgtcgccattgtatcgatgaccgtcaccgagaaaggctactgtcacctgcccgccagcgggaaccttgacctgcagcatgtcgatattcagcatgacctggcgcatcccgaacacccgcagtctctgccgggtctgattgttgcggcaatccgccgccgtcgcgatctcggcttagcgccgtttagcgttatgtcctgcgataatatgccggaaaatggccgtgtgacgcgtcatgtcgttatgcagttagcccagcagcacgatcccttactggctgagtatatccaacagaacatcacctttccttccaccatggtggatcgtatcgttcccgccatgaatgacgcggcgtttgacgcgttacgtctgcgcatcggttcccatgatccggtggccgtcgaagccgaacccttctttcaatgggtcattgaggataatttcgtcagcagccgacctgactgggataaagcgggtgccgaactggtgcaggatgtcctgccgtttgagcagatgaagttgcgcatgctcaatggcagccactcatttttagcttaccttggctatcttgccggttacgaacacatcagcgactgtatggcagatgacgcgtttcgggcagcggctcgcgcactgatggtcaatgagcaggcacccacgctcactattcagggcgttgatttacccgcgtacgccgatgctttaattgcccgatttgccaatcgcgcgatcaaacaccggacgtatcagattgcaactgacggcacgcagaaactgccccagcgctttctggacagcctgcgctggcacctgaataacggcacgccttgcccgttactgttgctgggcattgccgcctggatgcgttatgtcagtgcggtcgatgacaaaggcgagcctattgagatccgcgatccgctgaaagcgcaactggcgacatgcgtggccgagagtgatgagggtgaagcacgcgtgcgggccttgctgcgcttgaacagggtgtttggcgatgaccttgccaaaaacggtgagctggttaaacaacttaccgcctgttaccaacagcttgctgcacagggtgcacgcgcctgcgtacagcaggctaccgcaagccagccgcagcactgatgcgatagcccaacgcccggacagactgatttttacatggacagcaatatgacactttcttacaccatcaccaccagcgagccggtaaatcagcaggtttaccgctacctgcgccgcgatatcgtgacctgcgtgattcagccgggcgcatcgctttctgaaaaagaggtttccgcaaggtttaacctctctcgtcagccggtgcgtgaagcctttatcaagctcgcggaagcggggctggtgcagatcctgccgcagcgcggcacctttgtccgcaggatctcggctaaacgggtcgaagatggccgttttattcgtgaggctgtcgaggttgccgtgatccgccgtgcggctcaggaaatcggtgagccgggactgatggcactggaacataatctgcagttgcagcgcatcacggctgcccgtggcgacagtcagatgttcttaagcctggatgatgagtttcatcgtctgatcgctgagagcatcaactgcccgctggcatgggaaacggtagagaacatcaaagccaccatggaccgggtacgttatttaaccctgaacgacgttgcacccgccgaaacgctgattaagcagcatgacgctatttttgccgcgctgaaagcaagcgatcccgagatggcagaggcagcactgcgccaccatctgcaggccatgaagttttcgatcacccccgtcatcaagcaaaacagcgcctggttcgacgaggattaacgccttgccggacagccaggcgcaagcatggcggctaccaccactgatgaaaatggtgcaccggtccaatcccgttgccgacctccagcgaatccgcggcgagtaacgcctgctgtagccaggctttcgcttcgctgatcgtcgcttcccagctgtggtggcgcggccgcaaggctgcgagcgcggcggacagcgtgcagccggtgccgtgcgtatggcgcgtatttacccgtacgctgctaaagcgctgccgtcctgtccgggtcagcagccagtccgggctttcatcgtcatccagatgaccacctttcatcagtaccgcctgacagcccatcagcaacaaggcttcgccctgagtgagcatctcatcttcattgactgccacctgacatcccagcaatgcagcggcttcaggcaggttaggtgtaatcaatgacacctgcggcaacaggcgctcacgtacacaggcgatcgcatccgggttcagcagggcatcaccgctttttgccaccatgaccgtatccagcaccacaaaaggaatgtcccgccgctgcaggccatgtgccacgcgctccacaatgtccgtttcagcgagcatgccaatcttcgcactatcgatgcgcacatcatccagcactgagttcagttgggcggtcacaaattcaggcgcaatacggtataccgactgcacgccgcaggtattctgcgccaccagcgccgtgatcacactggtgccgtacgcgcccagtgcagagaaggtttttaaatcggcctggataccggcaccgccactgggatcggttcctgcaatcgtcagggcattaatgcgtttcatcgcgcgcctccagcgtccagagggcatccagaaaagcaggcgcaaagctgcccggtccatctgctacgtgcgcggccttttccccggccagcgccatcacccggcaggcgcaggcgatgttgatcagtcggtcacctggcaaacaggcaaaggccgcaaccaccgccgaaagcgcacagccagtgcccaccacccgcgtcattaacggcgagccgcccggaatcgcccaggtcagcgtgccgtcagtggcataatccacttcgccggtcaccaccacacaggtatgaaaggcttttgccagctgttgtgctgcctgcagtgcggcttcggccgggtgcaggctgtcaacaccgcgtccgcctgcggcctgctgcgccagagccagaatctctgaggcattgccgcgtaccactgcaggcgactgcgcgagcaactgcttgcaaaacgcggtgcgcagcgtcagtgcgcccaccgccaccgggtccagcgtccagggcgtgccagcctggttagctgcaagcaccgcagcctgcatcgcctgcttacgatcgtgggttagcgtaccgacattaatcagcagcgcatcggcgatagcgctaaattgcgccgcttcttcagcgtcgataaccatggccggcgaggcattaagggcgagtaagacgttagcggttagcgtttgcaccacatcattggtcatgcagtgcaccagcggtgactgacggcgaaactgttgcaggatgggcgcgcattgcgcatcagaaaggtgctgcggttgatgtgtcatcataactcccaaccggcggacaagaaggcgaatgcggtcaggcatcggacttccctacgctggcattatccagatcaggtaatacgggtatttctcagccttcacgaagaagggcaccccgagtcgtgttacgaacagaagcataagtaagcaccctgttttaagcaaggcacttattattttttcgattggatatgcaaacgttttgcatgatctcgatcaaccaccaacctcacaaaaaaaggcttaatgctgcgggctgtaaattcatacgtaatagtcgtgaaaacttttccgctatttaataataatattcgtatctattacaccgccttttttataaataaagcctgccttagacatcgcaacaaaaaacatataattcatgtagttaataaacaaacagaacacttcatactttacaggaagcatgatgcgattcttagcgcttattcctcatcgtcaccgatggaccgacattaacataacccgtcagggtgcggtttctccttctggtcgacactatttttccacttatatttctgcccgctgcacacattgcgatgatgtcattcaccgtgtttactatcgtgatatcagtgatgaacaggcgcggcgctggctgggctaatcataaaattgcgacctggtactgaccggcaggttacgttgctggcgtaatttgctaatctcacgtccaatgattttttacgtgtgaacgcttatgcctttcctgctggatactttaggacaccagatttatctttcggccccgttgtttatcctgatttttctgggattcggccttatccggttcggcaaatggcccgttaccgtcagtgaaggcatgaaccgttttgtgttcaacgtcgccctgccctgcatgctgtttcgcatcatgagtgacttttataacagtcctccggtcgatgtgcgcctgctgctggcgttttttggcagttgcctgttggtcttcattgtggggcggattgtggcctcgcgcctgtttcaactggatggcgtagccggatcggtctttgccctgggcggtgtgttctcgaacaatgtgatgctggggattccggttgccaccgtcctgcttgggcctgcggccctgccctccgtcgccctggtgctggtgtttaacagcctgatactgtggacgttattaacggtgtcggtggaatggtcaaaacagggcagtttttcactgggcggctttaaacgcaccttgatcagcgtgctaaaaaatccgttaatcatcgggattttatccggtaccgcctggagcctgctgcagcgcccactgcccgttattgccgccgaacctctgcgcatgctggcctccattgctgcgcccctgtccctgatcacccttggcatgagcctggcgcactaccggattcgtgaaggcttgaaagagagttacaccatctgtgcgttgaagctcattctgcaaccgctgtgcgtatgggcgattgcctggctaaccggcctgcccgcgctggaaagcaaagttgtggtgctgctggggtcaatggcggttggggtgaatgtgtatctgatgtcgcagaaattcaatgtgattaccgggacgacggccgccagtatgctgttttccacgcttttcgcggcgataaccacgccgctgtggatgatgttaatgacgctggcgggatactaaaaaggccctgtaacgcaggttaccgggccttgatcatgcgcgcgaaaacttagtgcgcaggctgggtgcgaatcaggtagtcaaacgcactcaaagaggcttttgaaccttcaccgctggcaataatgatttgcttataaggaacggtggtgcagtcccctgctgcgaaaacgcctttcaggctggtttcgcatttcgcatcgatcatgatttcgcccatcttgttgcgttcaaccgcaccttccagccagttggtgttaggcagcaggccgatctgaacaaaaatgcccgccagcgccagctcatgggtagtctggttggtgcgatccagatattgcaggcccgtgactttactgccgtcgcctttcacttctgtcgtttgtgcattaagaatcacatccacgtttttcaggcttcgcagtttgtcctgcagcactttgtccgcacgcatttcactggcgaactccagcagcgtcacgtgttcaacaatgcccgccagatcgatagccgcttcgacaccagagttaccgccaccgatgaccgcagtgcgtttgcctttaaacagaggaccgtcacagtgcgggcagtaggttacgcctttggtgcgatattgttcttcgcctggcacgcccatgttgcgccagcgcgcaccagtggcaaggataatgctgcgtgatttcaggaccgcgccggatgcggtttcaatggcgtgcaagccgcctttgaccgcagacggaatcagtttaatggcgctctggctgtcaatgacgtccacattgtagtcatctacgtgggcacgcagggcgccggccagtttggccccttccgttttctggacggaaatgtaattttcgatatcgacggtatccagtacctgtccaccgaaacgctcgcccagtaacgcagtgcgaatgcctttacgtgcagaatagatggccgcagccgcgccagccgggccgctaccgacgatcagaacctcgtaagcatcgcgtttgttcagctcttctgctgcacgcttgtctgcattggtgtcaactttactgacgatctcggccaggctcatacgtccctgaccaaaggctttgccattcagatagacagcaggcacgcccatcacattgcgttcctgaatttcattctggaacagaccgccgtcaatcgcggtgtggctgatgcggggattcagcaccgccatcaggtttaatgcctgcaccacatccgggcagttgtggcacgacagtgaataataggtttcgaaatggaaatccccatccagtgccacaatctgatcgagcaggctttgcgcttctttggacgggtgcccaccggtctgtagcaacgccagcaccagtgaggtaaattcgtgacccagcggggaaccggcaaaacgtgggccgttattcgcaccagggttggtgattaaaaatgagggcttacgcacctgacgatcgttctcttcacggaagctgactttgtcagacaagctcgcgatatcgaccaacagattgcgaatctccgttgattttgcgccatcatccagcgtcgcaatcaactccacaggcttggtgagtttctcaaggtaggctttgagctgcgtttttaaattggtatcaagcatagtgagttcctggtcaaaaaatcgggtgccgcagcacccgatgagaaaatgatcgacgtatcgatgcgaaattagattttgccaaccaggtccagagacggcgctagcgtagcatcaccttctttccattttgccgggcacacttcacctgggtgagacgcgacgtactgtgctgctttcactttgcgcagcagatcagacgcatcacgaccgataccttcagcggtgatttctaccgcctggataacaccctgtgggtcaacaatgaacgtaccacggtcagccagaccttcgtcttcgcgcatgatgtcgaagttgcgggtcagcgcgccagttggatcgcccagcattgcatatttgattttagcgatggtgtcggaagaaccgtgccaggctttgtgggtaaagtgggtatcggtagacacggaatagatgtccacgcccattttctggaactcttcgtagtgatccgctacgtcgcccagttcggtcgggcaaacgaaagtgaagtcagctggatagaagaagaaaacactccatttaccttcaacgtctttctcggttacatcaatgaattcgccgtttttaaaagcgctgtttttgaacggcttaattttggtattgataatggacatgtgatggcctcctttagaatatgtgatgcaggttacaaattttctgggccaacatctaataagcgctcgttatcaataaaataaacgaaagctatcaaacgccgatcgtcatgatctttcagggaaaaaaccgcttttttgcgagcggtgctgttcgtaacgtcactctttacttgcttatgcgccaaataccacgcgtaaaaaccgacggcgcaccgcattctccccaaacggcaccatcgagcagtgtaccgtgaaaaagatgacatttgttctgcttttgcttttttggcaatccctgccaggtttgttaaaaagactaaacggagcatgatgtgcatattcgattatttactgaggccgatcgcccttttttgcgaaccctgtttttggccgcacgccgtcataactggaactggattgaaaacgatgactggcagcttgaagactttgatcggatcatccctggcgaaaccgttctggttgccgaactggacggtcatcgggcgggctttgccgggctgatggaaaacgataacttcctgcatagcctgtatgtcgatcctgcgttccagagtcgtggcgtgggcagcgctttacttgacgaggtgcagtcacgctttacctctaccggagcactgaagtgcctggaaatgaataaagccgcgcaaaccttttatttgcagcgcggctggaaaatcatttcacagggtgaaagcgaacagggcaactatgtgctgatgcactatcccgcggcctcgctttacaccagcgatgccgacgcgcgctaaagcgcccgaaaggcgatatcgcccggaatcacctcgccctgccagtaaagctgggcagccacccggccagcgagctggcgataaagtgccgcgaactcgctgtgtggacgacggatcacggtgggctcgccatcgtcgaggtcttcgcgcaggtgaatatgcagcggaagctgcgccagcagccgggtgccataatcgtccaccagccgttgcgcaccacccgtgccgaaaatcggttcatgatggccgcactggctgcaaatatgaatgctcatattttcaacaacgcccagcaccggcacgttaactttctcaaacatcaccatgcctttgcgcgcatcgatcagggcaatatcctgcggcgtggttaccaccagcgcgccggtcaccggcacactttgcgccagggtgagctgaatatcgccggtacctggcggcatatccagcaccagataatccaggtctggccacagggtttcggtaagcaactgcatcaacgctttgctggccatcggcccgcgccataccatcgcattatcatctgtcacgagatagccgatggagttggttgccagcccgtgggacagaacaggggccatatgcgttccgtcgggcgacgtgggacgctctttttcgcaacccaacatgttaggcacggacgggccatagatatcggcatcaaggatacccacgcgcgcaccttccgctatcaacgccaacgccagattgactgccgtactcgatttgccaacaccgcccttaccggagctgacggcaatgatgtttttcaccccgttgacgccagggtgattcttaacccgtttcagggtggcgatatcatgacttaagcgccagtcaatcgcctgagcgccgcttagcctcagcagctcagcactggtttcggctttaaggtcttcaaacgcaccgttccaggcaaacggcatcagcaattcaatgtgcagcgtgccatcgagaagcgccacatgatgtaatgccttgagggcaatcaggttacgttgaagcgtcggatgttcaaagctgctcagcacgccgaccacaacggcgcgtaaggcttctggtgtatgcggttcccgggattgcgctgtcatccccactcctttttctgctgtgcttgcgctgtgttccagcgaggtaataacaattctatcagatgccgatcgtttcgcgggctgttgcgcatgggaaatcccttgtgtttacgcggctgtgcccatcggttaccatctaagcccgtttttttacttaactgaaagctacgcaaactatgactcaagtcgctaaaaaaattctggtaacctgcgccctgccttacgcaaacggctcaattcatctcggtcacatgctcgagcatatccaggcggacatttgggtgcgttatcagcgaatgcgtggcaatcaggtttacttcatctgcgccgatgacgctcacggcacaccgatcatgctgaaagcgcagcagcttggtattgcgccggagcagatgattgctgaaatgaaacacgagcatgaaacagatttcgccggtttcaatatcagctatgacaactatcactctacgcatggcgatgaaaaccgtgagcttgccgggctcatttatggtcgcctgaaagagaacggttttattaaaaaccgcacgatttctcagctgtacgatccggaaaaaggcatgttcctgccggaccgtttcgtcaaaggcacctgcccgaaatgtaagtcacccgatcaatacggtgataactgtgaagtgtgcagcgcgacctacagcccgactgagctgatcgacccgaaatccgtggtttccggtgcgacgccggtcctgcgtgactctgaacacttcttctttgatctgccgtcgttcagcgaaatgctgcgtgcctggacgcgttctggtgcactgcaggagcaggtcgcaaacaaaatgcaggagtggtttgagtcgggactgcagcagtgggatatctcccgtgatgcgccctactttggctttgaaatcccaggcgcgccgggcaaatatttctacgtctggctggatgcacctattggctacatgggatcgtttaaaaacctgtgtgacaagcgtggcgatatcaacttcgacgaattctggcagcaggattcaaccacggagctgtatcacttcatcggtaaagacattgtctacttccacagtctgttctggccggccatgctggaaggcagcggtttccgtaaaccgaataacctgtttgtgcatggttacgtgaccgtcaatggcgcaaaaatgtcgaagtcacgcgggacctttatcaaagccagcacctggttacagcatctggatgccgacagcctgcgctactactacgcggcgaagctctcttcacgtatcgatgatattgacctgaacctggaagattttgttcagcgcgtcaacgccgatatcgtcaacaaagtggtcaaccttgcctcgcgtaatgccggtttcatcactaaacgttttgacggcaagctgtcagcggaactggccgatcccgccctgtatcaaaccttcctggacgcatcagagaagattggtgaagcctgggcgagccgtgaattcagccgtgccattcgtgaaatcatggcgctggccgatttggcgaatcgctatgttgatgagcaggcaccctgggtggtggcgaagcaggaaggccgtgatgcagacctgcaggccatttgctcaatgggcatcaacctgttccgcatcctgatgacctggctgaaaccggtgctgccatcactgaccgaacgtgctgaagcgttcctgaacagcgaactgcactgggatgcgattcaacagccgctgctgaatcatcaggtcgcgccatttaaggcgctttatggtcgtattgaaatggcgaaggttgaaggcctgattgaggcatcaaaagtggatgcggcagaagccaataaaccggcggtaaccggcccactggcggatgcgcccattggcgataccattaccatcgacgattttgccaaagtggatatgcgcgtcgcgctgattgagaaagcggaattagtcgaagggtcagacaaactgctgcgtcttgagctggatctgggcggtgagaagcgccagattttctcaggcattcgtgcggcctatcccgatcccgcggtgctggtcggcaagatgaccatcatcgtggccaaccttgcgccgcgtaaaatgcggtttggcgtgtcggaaggcatggtgctgtctgccggccccggtggcaaagatctgtttgtcctgtccgtagacagcggtgccgtacctggcatgcctgtgaaatagtcctctggccatcctctgcggtttaccgccggggatggcgcttcagccacacggctgattgctggcaggccaggccgttagtgcgtatgataaaacccgttaaaaacaggagcctgtcatgcacaccgtgctaacgatgagttggcgttatctgcgcgcttttatcattatttatctttgcttatatgcaggaaacggcatagccctgctgctgcccatcaccctgcccggcagcatcatcggcatgcttattatgtttgcgctgcttgcgtcgcaaatcctgcccgtgcgttgggtcaagccgggctgtcatctgattatccgctatatggcgctgctgtttgtgcccatcagcgtgggcgtcatgaattacaccgatatcctcaccgcgcaattcggtcctgttgtcgtctcctgccttgtcagtaccttcgctgtccttgccattgtggggttaagtgcccataaactgcattcacgacctacggccaaagaggttaacgatgagtgatatttggtggtcgttgccactcactgtcggggcgtttttactggcgcgcaagctggcggcaagactgaagatatcgttgctgaatccgttactggtttccatggccgtgattattcccctcctgctgttactgcacatgccctatgcccgttatttcgctggcagcgaggtgctgaatcagctgctgcaacccgcggtggtggccctggcgctgccgctgtatgaacagatgcatcaaatccgtgcccgctggaaatccattatcggcgtgtgcgtgattggtagcctgacggcaatgatttcgggcaccgccattgcgctgtggatgggcgcaaccccagaaatcgccgccacgattttgccaaaatcggtgaccaccccgattgccatggcggtctcccaatcgctgcacggcattcctgcgattagcgcgatttgtgtgttgatcgcgggcgtgctgggcgccgtatttggtcatatgctactgaatctgttaggcgtgaagagcaaagcggcacgcggcctggcgattggtaatgcctctcatgcactgggaacggctcgggcggcggaaattgattttcaggaaggcgcctttagttcgctggcattggtgatttgcggcatcatcacctcgttgctggctccctttgttttcccgctgttgctgcactggtttggctaaaactttgggagagatctcgcaaagttgaaaactgtaagacatgttgcattgtcagagcgacggagatcacatataaaccgatgtctggcataccgctctgatgattgaatgaggcttccatgcatccacgtttccactctgccgttgaaggacttcccgctacgctgcaaaccgcgcttcgcccggtgctgaacgagccgggatttgacgcgatgctgcgggccgagcaggtcaccctgttgcaggcgcaaaccaaactggatgcagatgccctggcgctggcgctgctgccggtcgccgccgcctgcgcggtggcgacgctgtcgcagtttaacgtcggtgctatcgcgcgtggcgtgagcggtaactggtatttcggtgccaatatggagtttaccggtgcgaccatgcagcaaaccgttcatgcggagcaaagcgccatcacccacgcctggctgcgtggcgaatcgcgccttgaaagcatcactgtcaattacacgccttgcggtcactgtcgccagttcatgaacgaactcaacagcggtacagacattcgcatcagcctgccgcagcgcgacgtacagacgctggcgcattacctgcccgatgcgtttggcccgggtgatctacagattatggaacgcctgatggatgatgtagaccagggctacgttgtaacgggcgatgcgctggctcaggccgcggttaaggcggccaatcgctctcatgcaccttacagccgggcgtttagcggtgtcgcgttacagaccgtctcaggccgtatttttagcggacgttatgcagaaaacgcggcgttcaatcccagcctgccgccgctgcaggccgcactgattttactgaacatggcaggtgagtcctgtcacgatatccaggccgccgcactggcccagacgcaccagcctgctctggatcagttttcggctactcaggcgacattacgcgcgctgggttgcgatcaactgacgcaggtgcccctggcaaaagcgtaatgtgcggcacggttttaaacagtttctaaatcttttatttacaaaagctgtacatcggcgagaaatttcataggatctggcgccaggccttcgtcatcacaataaaactggcgtccaccctactctttgattattgcgccaggaaaacttgcaaccggagcatgactgcatggaactcgaatacgaaagtaaacgcccgctatatattccctatgctggccctattttgctggaatttccgctgctgaataaaggcagcgccttcagcatcgaagagcgcaatgagttcaatctcaatggcttactgcctgaagcagtagaatccatcgaagagcaggcaaaacgcgcatggcgtcagtttcaggactttaaaaacaataacgataaacatgtttacctgcgcaacattcaggacaccaacgaaacgctgttttaccgcctgctggacaaccatctcgaagagatgatgccgattatttataccccaaccgtcggtgccgcctgcgaacatttctcggaaatttatcgtcgcgcacgcggcgtattcatctcctaccccaatcgtgcgcacatcgaagacatgctgcaaaacgccaccaagcagaacgtaaaagtgattgtggtcactgacggtgagcgcatccttggcctgggcgatcagggcatcggcggtatgggcattccaatcgggaagttgtcactgtacaccgcatgtggcggtatcagcccggcttacacgctgcccgttgtgctggatgtgggtaccaataaccagcaactgctgaacgatcccttgtatatgggatggcgtcatccacgtatcaccggtgaagaatatgacgcctttgtaaatgaattcattcaggccgttaaacgccgctggccgaaagtgctgttgcagtttgaagactttgcacagaaaaacgcgatgccgctgctggagcgctaccgtgatgaagtatgctgcttcaatgacgacattcagggcaccgctgccgtgaccgtcggcaccctgattgccgcaagccgcgctgccggaagccgcctgtgcgagcagaaggtcgtcttcctgggcgcaggttccgccggttgtggtattgctgagcagattgttgcccaaatgaagtcggaaggtctgagcgacgacgaagcacgtagtcgcgttatgatggtggatcgctttggtctgctgaccgacaaactgcctaacctgctggatttccagagcaggctggtgcagaaaagcgacaatcttaaagactgggatacgtcaagcgacgctatctccctgctggacgtcgtgcgtaatgcacagcccgacattttaatcggtgtgtcaggtcagcctggcctgttcacggaagagatcatccgtgagatgcataagcactgcaaacgtcctattgtgatgccgctttccaacccaacctcgcgcgttgaagctaccccagcagacattattgcctggaccgatggtgcagcgctggtggccaccggtagcccgttctcaccggtttcctggaacgggaaaacctacccgattgcgcagtgcaacaactcgtacatcttcccgggtatcggtttgggtgtgatcgcctctggcgcgtcccgtgtcaccgataccatgctgatgacagccagccgtgcgctggcggattgctcaccgctggtgaacgacggtgaagggccggtactgcctgaaatcaaagatattcagggtgtgtcgaagattatcgccatggaagtgggtaaagccgcgcagctggctggcgtggcagtggtgacctcagaagacgtgctgtcacagtccatcgcgaacaatttctggctgcctcaataccgccattatcgtcgtacctcgatctaaaaattgctgcgctgggtcgtcattgattcagcgcagctcaaatttacaccagccaaacggggtaaacttgcttagcaggtgtagctcaagtagccttgtcccaccaaaacttctgatctcgagtgctcaggcgcatgctgaaacgcgttttcattgctctgcttttcatcatcttaacgatggtggcgacggcgttcggccttgatcgctggatcagctggaaaacggcaccttatatttatgacaacctcgcgtcgctcccccatcgtcaggtgggcgttgtgctgggaacggcgaaatattaccgcacaggtgtgattaatcagtattacctctaccgaatgcagggcgcgctcaacgcctataacagcggtaaagttaactacctgctgttgagcggtgacaatgcacagcaaagctacaacgaaccgatgacaatgcggcgcgatttgattaaaggcggtgtcgatcctgctgatatcgtgctggactatgccggcttccgtaccctggattcgattgtgcgcacgcgcaaggtatttgataccaatgactttattatcatcacccagcgctttcactgcgagcgggcactgtttatcgccttgcatctcggcattcaggctcagtgctatgcggtgccgtcccccaaaaatatgctcagcgtgcggatgcgtgaagtgggtgcacgtctcggcgcgctggcggatctgtttttgctgaagcgcgaaccgcgtttccttggcccactggtaccgatccctgccgtgcatgagatacctgaagatgcacaaagctatccggccgtgaccccggaacaactgctggaactcgaacagaaacgccgttagtcatcccgtcagctcagtgctgcttttccttaactgaaagggctgacgagacttcgcacggcgcttcctgccctgccatcttttcatcctgccgttctactctcagtgttagaaatcatacgaaaaggcaacatcgcatccagcgcccgtcgagggctgaaggcgaacagacgtgcaggagactgttcttcactggccagtttatgcacttatcgacttacggatttctgggtttgcgggtttgcgggtttgcgggtttgcgattttagctgatgaactgatgatattaaggccgtgcccggcctaaagaccagctgacgacgcgcatttgcacggcccaaaaaaaagcggcccggaggccgcttgtatgattgccactgctgttattttttacgcgaatacttcagcgagtcgagcgccactgcaaagataatgatgccgcccttgatgatgtactgccagtaagggttcacaccgatgtaggtcaaaccgtagttgataacggtaaagatcagtacaccggtcaccacgcccgcaacggtacccacaccaccggcgaaggagaccccgccgacgacgcaggctgcaattgcatctaactcatacataaagccgaggttgttggtggctgagccgatacggcccgcttccagcataccgccgaaggcataaaacacaccggacaaggcataaattaaaatcaggttcaggttaacattgacgcctgagactttcgccgcttccggattgcccccaatggcaaaaatgtttttaccaaagcgggttttattccacagaatccagacgaaaacgatggcaaccagcgcatagaacgtgatgtacgacagcttgaaatcaccgaaacgcaggaacccctgagtaaaggttgagaagccgtcataaaagcctgcgataggtgacgcacccacaaagtcgtaatacagggagttaataccgtaaacgataatcatggtgccgagcgtggtaataaaaggcgtcactttgagataggcaataataataccgttaaccagcccaatcactgcaccaattgcacagacgatcagaataaccactgggatcggtacagtttccatgtgtggaaacactttattgacgttatccatcgactgcagcagcgttgccgcgacaaccgccgccagtcccacctgacggcctgctgacaggtccgtaccctgggtcacaatcagcccggcgacgcccaatgcgataataatacgcaccgaggactgggtgagaatgttactcaggttcattaaacttaaaaatgtcgggtcctggaaaataataatagccagtagtaccagcagtacgacataaatgccgccctctttaagccaggttagcgcattcttttttgtagtcgctttcatgttaacagcccttacttcattaaaggtgtaatgacgctaaacgcaatatttcgttctgcgtggtagttttcgtatcaacaatgccggctaccagaccgttactcattaccagaatacgatcggtgatgcctaacagctctggcatttcggaagagataataatgatgcccttttctttctttgccagctccgccatcaactggtaaatctcgaatttggcacccacatcaatcccgcgcgtcggttcatcgagcattaatatttcgggctgagtcagcaaccagcgtccaataatcactttctgttggttaccaccagaaagcgaaccaatttgcgtatggtgcccaggggtttttacccgcatggaatcgatcacccattgggtatcgcttttcatgcgtttattatccagcaggccaatactgttcttatattttttgatattggatataagagaattaaagccaatatccaaaaaagcataaataccggtagaacgacgctcttccgtcaccagcgcaaagccgtggttaatggcttcattggccgtatgattgttaatcgttttaccatgcagtttaatggtgccgcctgatttttcgcgaatgccaaacagcgtttcaacgatatcagtacgttttgcacccactaacccggcaatgccgagtatctcccctttacgcaaatcaaacgaaatatcacgaatagaaggctgacgcagtgaggtcagattacgcacctcaagaatggtttctcccgggacgttgatacgatccgggaagcgctggctcagtgaacgtccgaccatcatggagatgatcttatccatatccagcccttcaagcggctgagtcgtaatccactgaccatcacgcaggatggtaatttcatcgcacagctggaagatctcttccatcttatgcgagatataaacaataccgcagccgcgatctttcagcttacggataatcgtgaacagatgattaacttctttttccgttaaggaggaagtcggttcatccatgatcacgatttttgcgtcataggaaaacgctttagcaatctcaatcatctgcatttgcgagacagagagatgggcgactttatcacgaggatcgatattgatatccagctcgtcaaaaatcgctttggtatcacggtacattttgtcctgatcgacaaagaagcctttgcgtggataacgcccaagccacatgttgtccatcacggtgcgttgcaataccagatttaattcctgatgcaccattgatacgccgttttccagcgcttctttggagcttttataatcaatttcctgcccttgaaaaagaatactgccggtatcttttttatagataccaaataagcactttaacaacgtcgatttaccagcgccgttttcacccatcagtgcatgaacggagtgaggccgcacttttaaattaacgttatcgagagctttcacgccgggaaatgatttactgacgtcggtcatttccagcagatattcgcgctgcgcggtcgtattatcactggccataatttacctggctaaaaaacggtgatgacataaaaaaggcgcagcagctgccgcgcccatctgcaaaaacttatttctggaactgagacaggttttcttgatcgaccggtacataaggtacgcggacgatcttatctaccatcttgaagttggtgcctgccgtagccggtttgccatctgcaaggtttttcgccatatcaatggtcgctttcgcctggttttccgcgtcattcagcacggtacccgccattgcacctgacttaaccagcgccagcgcttcaggtaacgcatccacaccgaataccggaatggaagacatgttgtgcgctttcagtgcttcaactgcgcccattgccattgcatcgttgttagcgataaccacttcaattttcttagcgtttggaccagacagccatgcgtccatcttatccttcgcctgagcggtatcccacatagccgtatccatcgctaacttctgggttttcaggccgtctttgttcagcgtgtcgataacatatttggtacgtgcttctgcatcaggatggcccggctcgcctttcagcagaacatactggatcacgccatctttattcaggtcccatgctggggtcgctttccagtgcttctcaatcagtttgccctgaatcacgcctgactctttagagtcggtacccacgtagtacgctttgtcatagccggccagcactttagcgttaggctctttattgaagaacaccacgggaatatcgttagcacgggctttttgcacgacaacggccgccgcagccgggtcaaccaggttaatggctaacgctttcacgccttttgccatcagcacgtcaatttgatcgttctgtttggattgatcgttctgtgagtcattcatcagcagctgaatgccgcccagtgtattggcttctttctcgatatctttacgaaccatcgacataaagttgtcgtcgtatttgtaaatggtcacgccgatgcgtgtgtcagcggcatgagcagttgcaccaaacatcatgctggcaaccagtgctgtgagcgtgaaaaccttcttattcatggtatctccggtttttttgcagggtctttttttgttcagccgcccagatggcgtcagaacatcaggtagaattattcggcgaggcaggatgcgctttatcaggcggagcccctgctgtgccatgcaaaactcgacttccgtgacttccgtgtaggcaatgcatccatagtgcgtgtcatgaaccatgtaaaccgacgcccggtcggccccctcatgaagagagtggcgttacataatgtttcagtactgttagacgctgccatcatagtgagagcaatgttaattaactgtgaatacaatcacagattgaaaacggttacatcgctgaatcgcctgaattagtgacggactccacaatttgcttttgcgccaccgagtggcggcgtaccagcgtcggcataaagatgtgttttgcactgttgtcgatacagcccgccgcgccctgaagcgccagctcagtggcaagtttcgccatagaaacaataggataacggaccgtggtcagttgaggatcggtataacgtgaaatcgggatatcatcgaagcccaccactgaaaaatgctggggcacctgaataccgttgtcttttagggccgtgagggcccccgccgccatgctgtcgttgtaggtgaagatggcactgaggttgagattacggcccaggagttccaccattgccgcttcgcccccttgcatatcaggctccgcgctggcaatccagctttcctgcgggcgaatcccctgctctgccattgcctgcagccagccttcccgccgctgcgcgacatcttcgataggatggctggaacacagatagccaatgcggcaatgaccctgttgcagcagcattcttgaggccatcaatgcgcctgttacattatcaaggctgacgcaacggtgctcaaaacccggcacgctacggttaatcaccaccataccgggcacctggctcataaaatcagccagttccgcgtctgaaagcgttttcgcgtgcaccaccagcgcattgcagcgttggcgaatcagtacctcaatcgcatgacgctctttctcttcatggtgccaggagttactgatcagaacatgtttatgtacgcgctgtgccaccgtgtctaccgccttgaccagcgcgccaaaaaagggatcggacacatccatgacgaccaccccgatggtatcgctcacctgggttgccagcgcctgtgcattggcatttgggcgatagcccagagcgtcaaccgcctgtaacaccacatcacgtgtttcagcggtgaccgcgctgctgttatttagtacgcgcgaaacggtagcgaccgacacaccggcctgacgcgcaacatcacgaatcgttatcatgcagcacttccagagagataaggcattatgccagttacaacaccggcgctattttgtcagggaagaagagcgtgcagcgtgaattacgtcacatcaatgaaaacggttacatacaattctgtaacctttgtgatggcggtcattatctttcagaaggggaagtggatgaggggcctgccgtaatctgcgtcagacgacgccagacccattccattgggccctgcgggaaatagcgcaaccacagcacagaaaacagcaggttaacgcaccagatggccggtaccagcataaccagctgtagccgtgagaaatgcataaacaagccgaagcggtaaaacagcgtggtgcatatcagggattgcaacagatagttgctgagcgccatcctgcccacgcagcggatggcatagctcagccgccagcgttggagagaaggccaaaagccgaaacataatgcgacatagccaagactgatcaatggactggccaggtcacgcggcagttgcagaaaaaaagcgctccagcggtaatcccagtcgacccaccactgtgctgccacaccgacagtagcgatcagtaaccccagcggcaataacattgcggctacgcgccggtagtggtgcaccggaaaggcgcctttcagccagccacagcgcaccagagcagcacccagcatcatcaatccggccagttgccagccatactgcgccaccagcgccatcaggcccgaggaaaggtggtccagacgaatctgcacggcagccaggccacccgtcagcttccagaactgctcatactgaatcccggcggcacccgggagccacgatggcgaaggttcagggctggagataagcccgaacaccagcaatacggcacatcccatcagatagagcaggacgcccgtgttaatgagcccccgcgttgaaggtacatcacgcaacatacgccaggtgatcagcccgataatgccgtaatccagtaaaatatccccttcccagataaagacactgtgaataaatcccagcaccactaacaaggataaacgggcgctcagccagcgactgccgcgtgacagctgcatttgcagtcctgcgccaaacagcaaggcgaatagcgtcaggaatttgagctgggcaaagatgtcggaaatggcccatgtccaggcatcagagagcgtgacgctgccttgccaggcgggattgagatacgcggcggaaggtaaaccaaagccaataatgtttaacaccagaatgccgagaatggcacagccccgaatgaaatccagcacgaggtagcgttgcatgtggaatcctgaagtatcaggcagacgacagccgcgcccgcctgtcagctttagttatgacgtaccgcgcgcagaaattcctgacgggtgttttggctggatttaaacaggccgcccagcgaggtcgtcgtggtcgcgctggttgcatccttcacgccgcgcgctttgacacaatagtgaacggcatcaatcgagacggcaacgttgttggtgcccaacagcgtctgcagcgccagcaggacctgctgggttaaacgctcctgcacctgaggccgctgtgcgaaaaactgtacgatacggttgatctttgataagccaatcactttatctttggggatgtaggcaaccgtcgctttcccatcgataatcacaaagtgatgttcgcaggtgctggtcagcgtaatgtcgcgaaccgtgaccatctcatccactttcatcttgttttcaatgagggtgattttggggaagttagcataatcgagaccggaaaagacctcatcgacatacattttggcgatgcggtgcggggtttccatcaggctgtcatcttcaagatccagattcagcagctgcatgatttccgtcatatggcctgcaatcaggcttttacgcgtttcatcgtctatttcacgcgcgggtgcacgcagcggcgtttccagtccacgcgccagcagcgcttcgtggaccagtgcagcttcctgacttaaggtactcatcttactcttctccggcaggtgttgcgcccgccgtttgttgccagcgggtcatattactgagcgcgtattgtgaaactttctgtgcaggtaatccagcaatcaatctgattggggatgaaagcttttcatgctgcccgccgccagaccagcagccctgcccatatcaggctggcaccggcgacccacaaggcaggctccaggcgatgtaagaacagcgttgaaagcgaggaaagcatcggccctgccaactgcccaatcgcatatccggttgtcagcagcccggccatgtaacgcatatgttgcggcgccagctcacgggcgcagagcagcgacaactgcaccacgcacagaaagcccccgccgaccagcagcgcgcctgttagcaggccgctgaatccagggagcagcgccgccgccagcacgcccaacgcctgcgcccacagcaccacggctaagcgggcatggctgctgcctgtccggcgagtagcaatgcctaacacaatacccacaactgccgccccgccgaataccggccagacgaactgggccgtggcactgccagggaaacgcgctgccgccatctgtgaaagaaaggttgctggcaaaatatagccaaagccggccagactgtaactcagaaccagccgcttaagattgcgggtcagaaccagcggttgcggggcctgttcgggccgatgcagtttacccgcgcgcggcaggttgcggctgataagcgcgaccagcaccgctgccagcgctgcataaatcgaccaggccagtgctgcgctgacctgtaaactgtgtagcgtaacggccaacaggccgctgacaaaaatgcctgcgcccggcccggcaaacaccgctgccgacaggccgggacggccatggtggtgcaactgctcgttgctccacgccgcgaccagcaccatcgcccagccgctggcccaaccaataacaaagcggatcaccccatgccatcctggcccgtcagccagggctgacagcgccgtcagtacaacggtgccccatattcccagttgcagacgcagctcaacgcgttgatgcgcgcgcatggcatcaaaagagccacacagataccccaggtagtttaacgccgccaccagactggcactggtgagggttaactgatgttcctggatcatcaagggcacctggggggtaaaggtaaagcgccctattcccatagccacaaacaaggttaaaaatgcacttatcgccacgcgaaacgccatctggtacctcagttttttgcgttgaaacttgcttatagcatgaacgatgcttaaactcacaaaaagtgaataatcttaagcaacttgtttacggtaagagaacactatggatttagttcagttacgtatgttctgttccgtggcagagagcggttccctggcccgtgcggcagaacacttgcatcgggtaccgtccaatctcaccacgcgcctgcgccagttggaagaggaattgggggtggatctgtttattcgcgaaaaacagcgcatccggttatcgcctatgggccataatttccttaattacgcacagcgtattctggcgttgagtgatgaagcattaagtatgacccgggcgggtaagcctggcggtaacttcgcgcttggctccatggagagcacggcggcgacgcgcctgcccggccttcttgctgcctaccatcaacgttttcctgcggtcgccttatcgctgatcaccggcacctcgggagaaattatcgatcgggtgcgcgaaggcaccctggcggcagccctggtcgatgggccggttcaacacgacgatctcaatggctgcattgcctttcgcgaggaaatggttttaatcaccgaccttgaccatatcccggtgacctgcgcacgggacacccaggaggataccttgtttgcgtttcgtaacagctgctcctaccgggttaaacttgaagcatggtatcgcgacagtcaggcggcacctaacacggtgatggagattcagtcctatcacgccatgctggcctgcgtggcgggcggtgctggcgttgccatgataccggcgtcggtcctgaaacagatgccagaccgcgcccgtgtgcaggtacacagccttccggctgaataccgcgacaccgccacctggctgatgtggcgacgcgatgccttcacgcccaacgttgaggcgctgaagtaccttattatcgaacaatttcacgatcgtccgctcaatgatgagctgatgcatccattacatgcagcggaatagtgtttccgcgctatttttaacttatcacgaccatccagacgccatgtcgcgtcacaatctgactgtaagagggattgcatgaacatgatcaaaacccgcgccgccgtagcctgggccgcaggcgaaccgctgaaaatcgaagaagtggatttaatgccgccgcagaaaggggaagtgctggtgcgtatcgttgcgactggcgtctgtcataccgatgcttacacgctgtctggcagcgatcccgaaggcgtgtttccggccattctgggtcacgaaggcggtggcgttgttgaagcggtgggcgaaggcgtgaccagcgttgaagtgggcgatcacgtgatcccgctttacacgccagaatgcggcaaatgtaagttctgcctgtccggtaaaaccaacctgtgtcaggccattcgtaccacgcaaggcaaaggtctgatgcctgacggtactacgcgtttcttcaaagacggcaagcccattttccactatatgggcacctccaccttctctgaatacaccgtcgtgcctgaaatctccctggcaaaaatcagtaaagaagccccactggaagaagtgtgcctgctgggctgcggtgttaccaccggcatgggtgcggtgatgaatacggctaaggttaaagaaggcgataccgttgccatctttggtctgggcggtattggactgtctgcaatcatcggcgcgaaaatggccaaagccggtcgcattattggtattgatatcaacaccagcaagttcgatctggcccgtaagctgggcgcgaccgatctgattaacccaaaggattatgacaaacccattcaggatgtgattgttgaactcaccgacggcggggtggatttctcatttgaatgtatcggtaacgtcaacgtcatgcgctctgcccttgagtgctgtcataaaggctggggtgagtcggtgatcattggggtggcgggtgcgggtcaggaaatttcgacgcgtccgttccaactggttaccggtcgtgtctggcgtggctctgcctttggtggcgtaaaaggccgctcacagttgcctggtattgtgcaggattatctggacggcaaatttgccctgaatgatttcatcacgcacaccatgccgctggaagagattaatgacgcctttgatttaatgcatgatggaaaatcgatccgctccgtcgtgcattttaataagtaatcgggggcgctatgacatctactctggagctgctggaagagcatcgaatttttggcggctggcagcagcgctggcgtcatcagtcacaggtgctgaactgcccgatgacgttcagtatctatttgccaagcccgcgcggtgattccccaccgccggtggtgtggtttctggcggggctgacctgcaatgatgaaaacttcaccaccaaggcaggcgcacagcgtgttgccgccgagctgggtctggtgttaatcatgccagataccagcccacgcggtgagcaggtcgccaatgacgagggctatgatctgggtcagggcgcagggttttacctcaatgccacgcaacaaccctgggcaagccactaccgtatgttcgattacctcagtgaagagctgcccgcagtggtcgccgataactttaaagtcagtgaacgtcagtcaatcatggggcactccatgggtggacatggcgcactgatgctggcattacgtctgggcaatcgctttgcgtctgcctcggcgtttgcgcctatcgttaatccgtgtgacgttccctggggccagaaagcattcacggcctatctgggagaggatcgccaggcctggcgcgcttatgacagctgtcagttgatgcataacgttcagcatcgcctgccgttgttgatcgatcagggcgacagcgatcagttcctggccgatcaactccagccggagcgcttagaagcgattgctcaggagatgggctttccattaacactgcgtatccagcctggctacgatcacagttacttcttcattgccagttttgtcgaagatcacctgcgcttccatgcgcaacacctgttggtggggtgatataaaaaaggggattgcctgagcaatccccggattctacgccagcccttcctggaccagcccgtcaatcatgacctgcggtgttcctcgcgaacagtgctcaatgcggccctgcacgccataaacctgcgccagcgtagcgggtgtgatgacgtgatccggcgcgccttcagcaatgagtttgccctctttgagcatcaacgcatgctgagcgtggcgcaaggcgatattgatatcgtgcaccaccaccaccgtaaccatattgcgcagcgcggtttcgcgccgtaccaaatccattacgtggaactggtaatttaaatccagcgcgctgagcggttcatccaacagcagcagcgcaggccgacgaataagcgactgcgccaggccaaccaactgtttttgtccgccagaaagctggtcgagataacgcatggccagatgagcgatgcccaactgctccagcagcaccatcacgtccgcttcgctggcggcactgtgtaatccacttgaagcacgctgcgccacaataatggactccagcacgtgcaggtgaacacccgccggcagggattggggtaaatagacgacctgcctggcacggcgcgcgaaaggctgggtcatcaggtcttccccgtttagccacagttcgccctgccctttattcagcccggccagtgcacgcagcagcgttgatttgccgcagccgttcggtccaagcagtaccgtaatctcgccacgcggcaaacgcgcgacattcaggttttcaatcacctgacgtttagggtaaccggtggtgaaaccgcccaggcttaaaccttgttccatcacacattcccccgatggcgcagaataatactcaggaagaacggcacaccaatcagcgaagtgacaatgccgaccggaatgatcgcgccagggatcaggttcttcgacgccacggaagccagcgacagcaccagtgcaccggtaagtgcgctggcaggcaaataaaagcgatgatcttcaccaaacataatgcgtgcaatatggggtgcgaccaggccaataaagccaatggggccaacgaaagcgaccgccagtgcggaaagcacgctgatgcgcagcagagtcgccagacgcaagcgacgcacatcgataccaaaactgatcgccctgtcttcccccagccgcagcgcggtgagcttccagctactgagcatggagaaaggaaccagcaccgcaaaggctgcactcagtacgcccagtttttcccaggacgcgcgcgccaggctgcccatggtccagaacaccagtccctgcagcgtatcttcactggcgataaactgcatcatcgaaaccagtgcattaaaggtaaacaccagggcgataccaaacagcaccacacctgaggaggacacctgggtccagcgtgtaatcccgtccagcattaatgcggcgaacagggcaaacagaaacgcgttagctgaaataaaccactgtccggaaataccgggaatacccacgcccagaataatggccagcgcggcaccaaacgcggccgcagaggacacgcccagcgtgaaggggctggcaaggggattattcaggatggtttgcatttccgccccggccaggccgagcgccaggccgacaactatggccattaatgcatagggtaagcggatatcccagacgatcacccgtgtacccgcatcaacgctctcgggagacagcagtgtgtgccacagcacggataaagaaagccctgccggaccgagcgtaaaatcgagaatgagtgaggcgagtattgctgtcagcagcgcgcccagccagaacaggcggcggcgcacaacctgatgatagtttgtcagtgtgtgctgatggccctcttcagcaccgatcaacgaggattccgttgtcatgattcaacccagtaatggctccaaaattaaaaacgcagccacaatagtgcaggtgataataattatcaattcatcgaatgttaacagtgatgacgtaaggtaaaaagcgcacggctttcaccgtcgcttctggtcatttatcgtcttgatggagagggaattccatctcactgtatttgataatgcgaccgccccgcaccagcctgtaacccagccagataagcagaaacagcggcagaccaatataggtggttgccacaccataccagtcaattctgtcctgcaggaacgcctgataattctgccctaaggtgatcatcaggcagaggataaaggcaaaaatgggaccgacaggaaagaagcccgaacggtaaggcaatgcattaagatcccgcccttgcgccacataaccacgacggaaacgatagtggctgatcgcaatccccaaccaggcgatgaagccggtcatgccggaggtattcaacagccagagatagacttcctgattgccaaatttcgaggtcaaaaagcacaggcccgccaccaccgtggtcgcccacagggcatttcgcggtacaccgccttttgacagtcgggcaaaaatacgcggcgctttgccttcacgagccaggttataaagcattcgcgttgaggcgtacattccggagttaccggcggacaataccgccgttaaaatcaccgcattcatcaccgccgccgccgacagcagaccggcatttttgaacaccagcgtaaacggactgacgctgatatctttaatatcattgtgcagcagctgcggatcggtataaggcagaatcaggctgatgatcaggatagccagcacatagaacagcagaatacgccagaacacctgacgcaccgcgcgcgggatattcttagcgggatcttctgattcacccgccgcgataccgatcagctcagtgccctggaatgagaaaccgacaatcattgccacaccgatcatcgaggcaaacccacctgcaaagggcgcgtcccccacctgccagttatgccagcccgcattttcggcgccgcgcataatgccgacaatcatcagcacgccgaccaggataaagatcaccacggtgacaaccttgatcagcgagaaccagtattccgtttcgccaaagcccttcaccgagatgtaattaatcaggaacatcaggctcaggaacagggcgctccagatccagcctggcgtatccgggaaccagtaattcatgaccagttgggaggccaccagatcgacagcaatcgtaaccgcccagttgtaccagtagttccagcccagcgcgaaaccgaagccttcttcgacatattttgcaccataggtagcaaaagagcccgataccggcataaacgccgccagttcacccaggctggtcatcaggaagtagaccatcaggccaattaaggcataggagagtaacgcgccgccggggccagcttgagagatggtggctcccgatgcgacaaagagacctgtaccaattgaaccgccgatggcgatcatggtgaggtgacgtgcttttagatcgcgtcgtaacgcaggttgttgtgttgtatttgagtcattatgcatgtgtaaacattacgctgggtaaaaataaggcgcgattgtagcagcaaaggccgtgctgtatagcgaatgctatacagttataagttaccttcatgattcacgggaaattattagcggcgatgcctgtttccctgaatttcaaggggttgaaccgctgatttcaccaccagatcggctctctgcgtttattcacggcagtaggacaaaaaccgcgtcagggcctttgagatgtgtttttgccgatgatgaatgcgataaagcgtacgcgtcagattgggcaacggcgtattcagttcgataagcgttccggcgctcagttgatcggcgatgacgcggcgggacaaacagctaatgcccataccgtgccggacggcatgtttgatcgcttcagaattccccagttccataccgagctggaacgtcggtaaatgggacaataagagataatcaacgatttcacgggtgcctgaaccgcgttcgcggagaatccaggtggcatcggccagggttgtcagtgtgaccggctgctgcaaaatcggagcatcgggcgcggcaaataccaccagctcatcttcaagccagggttcactcaccagttccgtcatatggcacgggccttctattaaccctacgtctactcgaaaatcagagacggccgtgatcacgtcctgactgtttccgacactcagctctaaaggcaaggtcgggaaatcacggcggtagccggcaatcatcccgggcagcaggtaattccctatcgtactgctggcataaatacgaatcgcaccgttatcttctttaaataactgttcgatttctgtggcctgttcaagcagccccacggcgcggggatagagtaaccggccatgctcgttcagtaccagccgcttgccgacgcgatcgaaaagctgaacgccaagctggttttccagatcggccagggccgcgctgacggctgactgagacaaagccagcacctgggaagcctgggtggtggaaccgcttttcagcacttcggtgaaaacttcaatttgccgcagtgtaatgtgcatgggaactcctgaatgacttaacgctgtacaaggtaaatgatcaaggctatccacagcaggaacaccaccgccagcacgctgaacacttttttaccgcgtacgcgttgttgccgggcacgctccgcgctgctgtcacgcaccgccttcggcagcattttcagcaacaccatgacacccgtgggaatgatcaccgcatcatccagtagtcccaccaccgggattacatcaggaatcaaatcaatggggctgataccgtatgccatgagtcctaccgccaggcctttacaccacagcggcgttcgcggatcgcgacaggcatagacgagcgttaaaacatctcttttgataagcgtaatgaaacgccccagtcgtgcgaacagcataaaccctgccttatcacttatagcggtagattataaatatataatcaatttcacttttaacaaacctggcgtgatgatgcgtactcaaccaggagcgtaatcatggccgacatcagcatttctaaatctcatcccgtgcagcaatggctgccgggcctgttgttatgcggtacaattgccgccgtcaccgccctgctggctcaggtgccggccgtctcgcgtctgggactgggttcattaaccctggccattatgctcggcatcattatcggtaacacggtgtattcacccatggccggtcaatgtgatgcaggggtgctgctggcaaaacaaaaattgctcaggttgggcgtcattctgttcggattccgcatcaccttacagcaaattacggatgtcggcctgagcggcgtactcattgatttgttgacgctcagcagcacattttttatgacctgtctgctgggaagacgcctgctgaagctggatcgtgacaccgtgtggttaatcggtgcaggcagcagtatttgtggcgcagcggccgtgctggccacggagccggtcttaaaagcggccccgtcaaaggtggcggtcgccgtggcaaccgtggtgctgtttggcaccctggcaatctttatttatcccctactgtggccactggttcatcatcttttccccacggtgagtcttacccagtttggtgtgtttaccggttcaacgatccacgaagtggctcaggtggttgccgccgggcacagtattgcgccagaaaccgaaagcagtgcggtgattgcgaaaatgctacgggtgatgatgctggccccctttttactgttgctgagcggtgtgcttcgacgtgaacaggcaacacagcacagggcgcagcccattacctttccgtggtttgcgttgctattcgtcgctgtcgccctgttcaattctcttcactggttgcctgccgggtgggttaacgcgctcaataccatcggcgggatactgttgaccatggccatggcggctctgggtttaaccactcgctttactgccctgcgcgcagccggatttaagcccgtgctgttgggggcgctggtattcggctggctgattgttggcggcggcagtattaatctgctggttcaacattttatggcgtgagcgcgcgaacatgtaagtctctgaccggctcgacgtcgagccggttatcccggcgcttcggcgcgggcttgacacaatggcgacggttttgcgagacgtgccgaacattaccctgccgctgttaggtgaacattcctggctgctttattttacgccgatggatgtttacgagccgggactcatgaagataaaaaataccacgcctacgcctcacgatgctctgtttcggcagtttctgacacagccagacattgcccgggattttatggcgatccatctgccgccatcgttacgcgtgctctgcgatctttctactctgcaactggaatcaggttcgtttgtcgaagatgacctgcggcagtacttcagcgatgtgctgtacagcctcaaaacctcatccggcaaaggctatatccatgtgcttatcgagcatcagtcaggtccggataaacacatggcctttagattgatgcgctatgcggttgccgctatgcaccgtcacctgcaggccgggcataaaacactgccgttggttatcccaatgttgttctacaccggtaaacgcagcccctatccgtattccctctgctggctggacgaatttgccaacccagacatcgcgcgggggctgtatacaacggctttcccgttggttgacgtgacgattatcccggacgacgagattgcgcgccatcgcagcatggccgctttaacattactgcagaagcatatccaccagcgtaacctgacggcgctgatggacaggctggtcacccttctcctgaacgaatatctctcttcatcgcaggtaatatcgctggtaaactacatgatacaggtgggcgaagcgtcggatgcgcacacctttgttcataagctggcacagcgggtgccgcaacacggagaggctctgatgaccattgcagaacagctggaacaaaaaggcatcgaaaaaggcaggaaggaagaagcgctgaagattgcccagaccatgttaaataacggtcttgaccgccctactgtgatcaaaatgaccggcctgaccgaagaagagttagcgaaactccgccattaatcctctgccttattctgacttctgacacacatgcgcggtggggcaacggctgatttccccttgcccaatcctctctctgagcgcgttctcgcgttaatggctgtcaggaacgcgcgcttcccagcccggctgttctcccggtctaaaccgctcctgacctggctaaaaatttcctgcgcaccgcgctttgccatcgcgccatcgtgtatcatgccgttaaatctgagttaaatccttcaggagaacggcatgaagtatattggcgcgcacgtcagcgcatcgggtggcgtggatcaggcggtgatccgcgcccatgaactggaagccacggcttttgcgctgttcactaaaaatcagcgtcaatggaaagcggccccgctgtcagatgacacgattgcggccttccgcgctgcctgcgagaaataccagtttgcgccgggccagattctgccgcatgacagctatttgatcaatctgggtcatcccgtcatggaagcgttacaaaaatcccgcgatgcgtttcttgatgagatgcaacgcgccgaacagctgggtctgacactgttgaattttcatccgggcagccatctacagcagatcgatgagctgagctgtttaaaacgcatcgctgagtcaatcaatatcgccctggatcaaacccacagcgtcaccgccgttatcgaaaataccgccggacagggcagcaatctcggcttccgctttgagcacctggcaaccattattgaacatgttgaagacaaatcccgcgtgggggtttgcattgatacctgccatgcttttgcgggcggttacgatctgtgcagcgaagccgcctgcaccgaaacctttgctgaattcgatcgcattgtgggttttaactatcttcgcgggatgcacctgaacgatgccaagagcacgctgggcagccgggttgaccgtcatcacagcctgggtgaggggaacatcggtaaaaccgtgttcagctggatcatgaaagatgcgcgttttgatggcatcccgctgattctggaaaccattaatccggatatctggaaagatgaaatcgcctggctcaagtcagagcaacgttaaaaaaaaggagccttgcggctcctttgtagtttttaactatcaggctttcgccagctcttcttcaggacgcttcagtaccgcatagcctaatccggcaatcgctgtaccaatcaaaatcgccatcagataaccgagcactggggtaatcgcaccagggatgagcagcacgaacaagccgccgtgcggtgccatcagtttggcaccaatcgccatcgagactgcacccgtcacagcaccaccgacgatacagcatggcaggacgcgcatcggatcacgagccgcaaaaggaatcgcaccttctgaaataaagcacagacccagaaccagcgcggctttaccgccttcctgctgacctttattaaatttacgacgcgcaaccagcgtagccagacccatggccagcggtggcaccataccggccgccataatcgcggccatcggcgcgtaggtctgtgaactcagcagcccaacgccaaacgcataagccactttgttaaccggaccgcccatgtcggtacacatcatgccacccaggatagcacctaacaggatcgcattggcggtacccatattagccagccagctggtcaaagcactcatgatgcccgcgaccggtttacccaccacatagatcatcagtaaaccggtgatcaggctggcaaacagcggaataatcaggatgggcttcaacgcctccatactttgtggcagcttcactttgccgctaatcagcctggcagcgtaacctgcgataaagcctgcgataataccgccaaggaagcccgcgttaatactggtggcgatcataccgccaatcagtccaggcgtcagaccaggacgatccgcgatagagaaagcaataaagcccgccagaaccggaaccatcagtgcaaacgcactgccgccaccgatttgcatcagcgccgccgccagcgtaccgggctctttaaaggccgtgataccaaaagcaaacgacagtgcgatactcaaaccacccgccactaccattggcagcatgtaagatacgccggtcaacaggtgacggtaagcgcccgcgccgccctctttcttctcttcctgctgactgttttgcgagccagaaggttggtaaggcttcgcttctgcaaccgctttatccagctcctgtgcggtctttttcagagccagaccggttgaggtgcgatacatcggtttacccgcaaattttgccagatccacttcgatatccgctgccacaatcaccagatcggctgcggcaacttcttcaggcgtaatcgcgttacccgcgccaacagagccgcgggtttccacttttacccaccagccacgtttggtggcttcggtctgaatagcctcggccgccataaaggtatgcgcgacgcccgttgggcaagcggtcacggcaacgacgcgttttggtccattcgctggcgcagcggtagagacaacagccgcggcaggtgctgccgcgctggcttgccagggcttagcttcagccttagcacgattcaggaactgttcaggttcgctgaccgcctgttgtacatcacccagccaaacggactttccgttcagcgcggcatcatccggcacagttttaccggtgacgatcaccagctcggcctctgccgggttttcggttagtgttaaaccagcctgcgcagccgcagcagccaggcgttgttttgccatgtaggcagaagccagtcctgttgaaggatcttttatcagcagcgttttcactatcgctctcctgctgtcagttaacgggttgtaagtcgacgcgcgccatcattgcggccaactgggtacgatcagtaacgccgacgttgctctggctgacagccatcgcggctaccgcagtagccagacgtaacgtatgttcactggattcacgcattaacaggccataaatcaggccacctaccatggagtcacctgcgccaacggtgctgacaacctcgcacaccggcggtttagcaatccattcacctgaggcattgacccaaagtgcgccttctgcgcccagagaaatcaccacatgtgcaatgccctgctcacgcaactcatgcgctgcgtcaatcacgtcctggagcgcagggagtttgcgccctgcccagatttccagctcgcgacgattaggtttaaccagccagggcgcagccttcaggcctgccaccagcgcttcgcgactgctgtcaaagatgatgcaaggacaatgcgtacgcagttcagtcatccagcgagtaaaggcatcgggatcgacgccttcaggcagactgccgctcacgcagaccatgtcaaactgacccagccaggttaatgaatcgctggtgaagcgatcccagtcctgcgccgtgacctggaagccagaaaagttaagatcggtcacatcaccggtttgctcggtaagcttgacgttgatgcgcgtacgaccattgacgacctgaaaacggttggcgatacccaactcactgaagagttgctgaaagccatcctgattgtctttgccgagaaaaccgccaacggtcacgtcgatgcccagatctttcaggactttggcaacgttgatgcctttaccggcagcatgcaaaccggtggttttcaccagattgacttcgccacgttcaatttcgggcgtaaaaccaactaaatcatacgcaggattcaacgtgatggttgcaacacgtctggtcatgccgccccctcacctaaaccactgttaatggcttcttcaatggcattaagcgcctgctgtgcatcttcaccactggcagtgaaacgcaggcggtggccttttttcacgcccagcgcgacgaccttcatcaggctgcgtccatttgctggtttaccgctgccatcaaggttggtaatcgtgatgtcgctattaaactgtttgatcacgctcaccagcgccgtacccgggcgcgcatgcaggccatgctcattgcggatagtaaactcagccgttagttgatctgcctgctcgtcaacttcgctggtcagcagggcataaacgcctgctgcatccgctttcagcaaacggtcggctttgttgttctgtaacagtgcgctcagatagcccaggacctctaatggtcgttcatcaacagcggccacgcttactaacattgccacggattcaccctggtgctcgaaggcattcgccgcgcggctgacagccactccgctttgcagattgcccttgccgctgtcacttaaccaaataccctgacccaggcttaagggattgcctgacaccacgtcggcaacatagctggcatcgaccacgccagcggcctgtaagcgtccggcattgagtgcctgcaatgtcatcaggtcgcgtgcgttaacgtccagcgtaattaacgacgtatcgaagctgaattctgctgattgcttctcacccatcagcagcgcacgaagatcctcggcggaggcggttttgagctgttcagcaatgctgtcgtcgctgagtacatgggtcagctggcgcagcaacgccaggtgttcatccgatttcgcggcaatgccaatcgcgacataggcagtttgatcgtcaccccaggcaattccctgtggaaactggaagacctgaacgccggttttcagcaccagatcgcgcgtgtcggtggtgccatgaggaatggcaataccattacccaaaaaggttgaggtttgctgctcacgcgccagcatgccattgacgtaaccttccgccacgttacctgcagcggtaagtgccgccgcaacctgacgaatcgcatcttctttgttttgggcgctggctccggtatggatggcctgcaattcgagctggaacataattctcctcgcttgctgattgaatcgtttcagctcattggtattggaacttgctgtctgaacccgtgaaggttgttacagcaacgctgaaacgtttcagggattgttattcagcttggctttacaggcaagaaaatgcgtaaacgacataacagatctttgacgttacgcacaattcagagaggttgggaaattatcttaaaaatagtgctgaagtctggacgacacaaggtcagtcttttcaggaggatttcagcagcgtcagctgacgccgcaaacacagtcaccttaagatcaggaaggcaccttgcccgacagtgagaggccatccgcacgtgcacaacagcatggaccgcacgttaatccccaggatgaggctaaaggttagaacagcatggctaaaccggcggcaaaaagcatcgacaagccggtggccagtaaacctggcaaaataaacgggtgatcgattactcgtcggcccagacgagtggagccggtatcatccagcgcaacggcggccagcaacgtgggatagttaggcaagataaacagggacgcggttgccggaaaacagatgacaagtgtggcgggcgcaatgcccatactcaaggccatcggaaacagaattttggtcgatgccgcctgagaatagagaaaacatgatgccagtacgataatcagtgccagtaacactgtggaatccagaaaatagcgcgcggccatatcctctaaccacaggcaattgctctccataaacgtggaacccagccaggccacgccaagtatacagatacacgacgtcataccggttttaaacaccgacgaccccggaatcgtatgcacattcacccgacagaacatgacgatagccattgccaccgctaacatcacggcaatgcgcgcctgtccgctattgagcacagggcgagtaatgatttccagtttggggctgctgataatggcataaatcagcaccgtcaccaggccaataataaaaatcagaaccgaacgtctgccgtgaatagcggaatgcgttagctgcacggttttcaccgcattatcctgatgttcaagctggtcagtgtgacgtaagcgatcccaccacaggtaaaacaatgcggaacataagagcgccatgaaggtggcaggaatggtcacggcaatcagttctatatagccccagccgtgcggcccctgttccagaataccagcaaaaaaaatcacggctgccgaaatgggtgatgccacaatgcccagtaacgatgcggcgacggaaagcgctaatgcgcgggttggacgaagatgattatctttagccactgccacaatcacgggcatacaggcaaaagatacctgccctgtactggccatcatggttaataaccaggttgagagcggcgccgtaatcaccaacagccgtggataacggcgcaaggcacgctcggtcagttgcaccagataatcaatgcctcctgcctgctgcatggccgagatggcgacaatcaccaccatgataaatatcattaccagcatcggcaggtcgccaggtgtggcacccagcgcgcacagcattaatactcccgccccgcctgcaaaccccacaccgatgccgccaatacgcatgcccaaaaacaggaaaaaaagcacggtcataaactgtagtattagcatgattccattccttctgactgcggttgacaccgttaccgcccacactcaatgccggtacaggcttcatttcccccgtaaggttgcatcaggttatttgtcgatatgtcctacagagaaatggaacacggcttaataaccgttttctgcgcatcgggtgcactgaggggcgtaaagtctttttgcgttgatgcatgatttctctggatgcctgccggtaagcagaccgggacatctcagagaaatacgttgaatcgcgctacgtcgttacgacaggcagttcccacactgaggcgtcctgcctgccagactcgcccgttttatttcacccgacccagctcagcagcacgcattgccgcgtgaatctcttctgccgcgccttcacccagcggtaacagcggtgaacgaacagtggcatgttccagaatgccacgcgcaaccagcgcatgtttaagtgcgacagtgccttccatatgtgaaccacgatggtacacggctttagtcacaggcatcagtcggtcatgtaatgcacgggctttcttataatcctgcgctttaccggcattgatcatttcaatcagtggctcaggtgcaatattgccgtagcccaccaaaaagccatcaacatcaaaaatggtatgcagtagatattcatcatggcaggtcagaatctgaagatcgggacgttcacggcggatgacagggatttcagtatcccaacgacgcatgttgcgtacaccatttttcatcgcaaacacgcccggctgagcggaaatatccagcagtgttttcaggttataggtggctttagtgacgtcgggatactggaataaaataagcggtaagccactctcttcataaacgacgcgatagcgatcctgtggcgcgccgtcctgataaccaaaacgcaaccagccgtgtgaaggataaagtaaaccggcagccgcccccgcctcaacagcgcgttttgcctcacgtgccgccacttcggttccttccccagtaataccggcaatgacggggatcttgccttcaacggattttacaaatgcccgaatgacgtcggcctgctcatcctgggtcagaaacgtgccctcacctgcgtgccccaggaccaccagcccttttacgccgtcaatacttcccagccaactgcccagacgttgaatagcgtcaaaatcaacttttccttcgcgagtgaatggggtaacaggtgcaggggttaagcctctgaggtcgatattaatcataattaactccttgatgtaatagacgtttactcataagtgcagtcaggatgaaaaatgagtgcaaacgttactgcaatcgttttcatttaggttaagttcgcaatgtaatctcatcgcgtcaaccagctactgttaataagtgcggcagccatcacaaaacacccaaggagaaaatcattgtctgcgatccagatcgcagaggattcatgaccgcattactctcgcaatgcagtcattggtcagacgggctactaatgaggggaagcggtggattttcgcggaattagcgtgggaataatggtcgataaatgtggttcattcttgccattgatgagcatatccacggcattacctgcaatatgctccagtggcgtacgcactgaggttaaggcgacaggcaaccggctgacgagaggaatatcgttgtatcctaccagtgacagctctttgccaatggtgatccctgcatgatgcgccgccgccatcacgccaatcgcaatctcgtcattgacggcaaaaatcgctgtaggccgcgaggaatggtttaacatcgacgaccccacctcttcgcccgactggatattaaagtcagaggaacgacaccactctggtcgaacagacaaaccggcttccttcattgcccgttcaaaacctttccgacgattcaacgcattggaggcaaaatccggcccaccaatcataccgatttttttatggcctaaatcgatcagatggcgcgcggcaaggtagccgcccatttcgtcatcacccacggaagaggggctcacgccgtcggtgcgcaataccagtacgtgcggtatttcgcgttcccgcagcgtctgcggaagcggatcgcccagacggcaggttgatagaatcagtccgtcgacgcgtctgtccagtaaggattcagcggacgctttttcctgttgcgggtcgtcaccacaggtcgccacgatggcaaagtagccgcgtcgtgaggcagcagtggcgatagcctcaaacaacatcgccgtcaccgcatccgtcatgcggggaaccagtacaccaagcgtaccggtatcgccccttcgcaggctggaggcaacataatcgcgccgatagccaagttcacgagcaacctggcgaactttttcagctgacgcactttttgactgtggaagcctttcatccagaattcgcgatacggttgaaatgcttacgcctgcggcattggcaacatcacgcatcgttatcagccttttatccgactgttccttttcctggctttcctgatccatatatcactccggggattaatgtgggtggcaaagatccatctgcagacggcaacaatatacaacagacgcgataacaacgggatacgcggttaacacgcactgttgggtgccgcacttatccttctcttaatgctcacaaggtgccattttcagccattacgctcttatagttctcctccgccgtagcctgtccgcaaactcgatgagaaagagtatgacctgattcacgcttttttgattgcctgagagcggaatgtgaactcgttaacaattaactatgccgcttgattgacgcagcagaatattaaaccaacgataacccatgtgaaaacgattgcattaacgttttcatattatcagtttgcatatttttttatgcaataaccatcagtgagtgggcggcaaacgcatggctccggcacggtcgttgtcttgcacgtttgccccctatccatcactaaacagggtgtcactatgtcaactcaggttatcgcttcccacgccagtcccgccgattcatctgtattactggcgcggcttgagcgattgcccatcacacgccggttaatggctattcgtgttgtggtggggctgtccactttttttgatgcctataccattattgctatcgcgtttgccctgccacaactgacgcaggaatggggactcacgccgacatttgtcggtctgatcattgcagcaagctatatcgggcaactggtaggtgcgctcttttttggtacgctggcagagaaaattggcaggattggtgttttgcgtatcaccatcattatgtttgtcatcatggatgccgcctgcctgttcgcctggaacggctggtcgattctggttatccgttttttgcaggggctgggaattggtgcagaggtcccggtcgccagtgcctatatcaacgagtttgtcggtgcaaagaaacgcggccgtttttttctgctgtatgaagttatctttccggttggcatgatgtgtgccggtcttatcgggttctttctggtaccggtttatggctggaaaatcatgtttctcattggcctgatcccctcagccctggcggcacctttgcgctggttaatgccggaatctccgcgctggttagtctctaaaggccgccatcaacaggctgaaaaagttgtccagtccttcgaggcagaagctgtacgtcgtggtatgccattacccgagcccgtcattaaacctgtaacggtgatacccgcgtcatccagcggggtgaaagcccttttctcaggtatctacaaatcccggacgtttatgctgtggggtttgtggttgacggtttataccatcaataacggtatggttacctggtttccaaccatgtataaaaccctgttccacctgccgttagaaaccagcctggcctatgggtggatcacctcggcctgcggcgtcattgcctctgtaatttgtgcctttaaaatcgatcacgtggggcgtaagcgctggtacagctgggcatttatgctggccattattccgctcatcgtgctgtgtgtattaggggctaatgcgccctggcagatactgatctttggcagcatcgcctatgccattttgcaaactatcgccttctcactttatctctattctgccgaactctatccgacccggcttcgggcgacaggtactgccttttccagcgcctggctacgcgccgggtcatctgttgggccattaatggtggggtttattgtgtctggttttgggatcagatttgttttcattacgttcgccgtcattgccctgatcggtggcgtgatcaccctgctgttcgcgattgaaaccaaagaaaagtcgcttgaagagttatccccttaaccaggcaacatcacgccgataaggaagtcagttacatcgccatcatccggcctggcctttctctgacgcatccgggtttggccatgcgccaccgagagcctggtcagcgcatcgttaacagcctgattttgggacgaacagaaggaaaaaccaaacgcgcggtgatagctcgacaacagggaggacgaaaaaggttatggcgcagtgatctgctcaaggtgaatcagatattccatggcgtaatgacgattgctgccgcacatctcaaccgatggctgaagtcccgcgcacacctctggccgcaggggagatgcaaaaattttgcagaggttattatccgcgagctgaatgcagcgcgtattagcgggtttaccctgaggcataccaggaatgggcgaggaaatgctgggggcgatacaacaggcaccgcaatctgtacgacattccatctttcacatccgggatagggtaaaccgcggacgataacagaatggggattaccccgacatcacctttacagaaaaagaggtcaacgcttaagcgaacggcattgcggtttatgctgaaatcgccgttgcaagaggaagacctcgtaaaacctggcttatctactcatacaacgggcctgttctgccctgccactcgctatcgacaacaaaatttttcgcgctatcttgcctgttaagaggcgcgcgagtaacgttgcgcgcactattactttgcgagtgagaacagcaatgccaaaagcgaatgaaattaaaaaaggaatggccgttacccacaatggaaaactgctgctggtcaaggatattgacgtccagagccccagcgcgcgcggcgcggcaacgctttataaaatgcgctttaccgatgtccgtaccgggatgaaggtcgaagaacgctttaaaggcgacgagattatcgaggctatctctctgagccgtcgcagcgtcactttctcctatattgacggtgatgaatacgtctttatggacgatgaggattacacgccttacgccttcaaaaaagagcaaatagaagaagagctgctgttcattccggaaggtggcattcctggcattcaggttctcaccatggacggacaggttctggcgctggaattaccacaaaccgtggacatggacattgtggatacctcacccggtattaaaggcgcgtcagccagtgcccgcaccaaacctgccgggatgagtaccggtttagttgttcaggtaccggagtacctcagcaacggtgatcgcatccgaatccatgtggcagaacgtcgctatatggggcgcgcagactaattgcctgcgctacaggctggcggctgaatgatgttataatataacaatatcatcttctttattttacaggagccgctggcatgacgcgcgttaaccttcttaccggatttctgggcagtggtaaaaccaccacgctgcttcatctgttagcgcataagcccgaagaggaaaactgggctgtgctggtgaatgaattcggtgaagttggtattgatggtgcgttactcgccaacagcagtgccatcctgaaggagatacccggcggttgcatgtgctgcgtcaacggactgcccatgcaggtcgggttaaacaggctgttaaagcagaataaacccgatcgcctgctgattgagcccactggactgggccatccgcgccagttattacagatgctgacctcgccagtttatcagccctggctcgaactgcaggcaacgcttaccctgctggatgcacggcagcttaatgatgaacgcgtggcgaaaaatgaaaactttcgcgatcaactggccgccgccgacattattgtcggcaataaacgcgatcgctggagcgaagccgatcggcagcgcctggagcagtggcttgccgcacaccaggacgatcgtcagtttgttactgccgagtttggtcagattcccctcactttgctcgacaggccgcgagggaaagcgcgcgccattccgcatccggcccactatcatcatcacccagccccgaccagtggtattgccgcaatgcgactcgacgggcacgcaacctggcgtcgggcggtcaatcagggtcagggttatgttgcctgtggctggatttttgatgatgaaacggtgtttgatactctgccgttgctggagtgggcacggcttgccccagttgatcgggttaaaggcgtgctgcgcattgcggagggtgccgtcagcattaaccgtcagggagaagacgttcatattgaaatactgggttcaacaccgcctgacagccgcgttgagatgattcattcctcatctgccgactggaatagtctacaatccgctttgttgaagattcgtttaagctgacatggttaaggtcggcggttattttttattagggcagaattatgcacgcaacacgccttgtcaccatcctgctgctgaatgcactgggaatgatgctgtttttttcctggtatttaccgcccggtcatgggttttggtttgatatcgataaagggattttcttcgctttcaataatgagatggttaattacccgggctttgccctgctggtcgcgatcaccaacttccgcggttttgacgccgtgtcattactggtaatgggcttgctctatctgtggctatggcaacgggaaacaccgacaggccgacgtcgtatgctggccattggcattacgatgttgctgacagccgtcatcctgaatcaggccggtcatttgctaccggtgaagcacgccagtccaacgctgttttttgaaggggttcatcgcgtcagtgagttgaccggcattccagccaaagacgcgtctaaagacagttttccaggcgatcatggcatgatgctgatgatcttcgcggcatttatgtggcgctattttggctttcgcacatttttagtcagcgtggtcattgtggtggtgttttctcttccacgcataatggctggtgcacactggtttactgatattgccgttggatcactttcggttacgctggtgggattgagttggtggttattaaccccggcaagtgattacctggttaattggttttatcacaaattaccgggtaaaaataaaccccaacagtaattcattagctcgggcggaataatgtttacattataaaccgcccttatttataaaaaaccgaatggaataattagcaagctaactagaaatcccctttctgaaccctatgataatccagcatttagcgtcagccctcgccactcgcggcgctaccgcgcttctgttaacccgcactatgcctggaattagcgccagatcatccctttcctcaggttatcagccctgaataactgttgataaagtgaacaagttatttaagtttgataagtatcaaaaaaacctatcagaatttgattaaaagctctcgccacggcctctgtaatcggttaatctcggtcgcagtgagaaagaagtagcagtattaagcacgctttcatcggtaaaatgtggtgatttacacaattttataattaaagcattgtcttgttctgactggcttattaatctcattccgttttgtcatctggctggcgacaatcttgtcgtaaggacttcgaaggaaaacccgtataatggtcaagtctcaaccaatactgagatatatctggcggatagtgcccgctctggcgctggcaacacttctctcagcttgtagcagtacccataacaccgtaaaaaacgagaatcatgaagttaacaaccagaatggttttttacttcaagcgtctcaggatgagttcgaagagatggtgcgtaacgtcgacgttaagtcgcgcatcatggagcaatacgcaagctggaaaggtgtacgttaccgtcttggcggtgataccaagcgtggtattgattgttccgccttcgttcagcgcactttccgcgaacagtttggcttagatcttccccgctccacctccgagcagcagggaacgggtaaagaaatttctcgcaccagactgcgtccaggtgatttagttctgtttcgtgcaggctccactggtcgccatgtgggtatctacctcggcaatgacaattttgttcacgcctcaaccagtagcggtgtcatgatctccagccttaatgaagactactggaaaaagcgttatagcgaagctcgccgggtcttaagtaaaaacccgagctagtgctactctcgaacgtcctctcagccagagaaaaacagaacgctgcctttgcagcgtttttttttgaatccctcgaatccgcgtaaaaatacttgtttatcaaaataataacgagacattattaacagactcgttatattctcagacgcaaatattcgggcgattgcgcaccattaagttttgtattttgatcaggggaagcacttcatgccattgtcgcgggcgctgatacgccaggcaacttatcctcgtcgaatcgcgtggaatagcgcgattgttggcagtctgtttttttgttgttaacctctgttttacttaccgagacccaacatcaacgggaaaatcaacataagcagctgctcatcgacagcagcaacgacttccagcgtcacgtggcgacgctgattacagataccctttctcccctgcttccgttcgtcaagtcagaatgttatatcggcaatcatgagttaactgcgcgtgccgcgtttgctggcgacatacgcgccatcattttagtgaaagacggtaacgccttttgctcttcagccaccggcagcttttttcagccactgagcgcgatttcggcccgtaccgataccacacgcgaccgggatatccgtttattgccgggtacccctatgcagccgacgaaaccggtactggcgatatggatcaagcaacccggcaccctacagtctggcatctttaccaccttgaatctgagcctggccgattaccaaataaaagcgtcctcgcatcctgaaattaccgggattgcgatactcgcgcataataccgcgatgaccagctggcaaaccactctcgtaagaaatcatcaactccctccaccgttaacgcagatcactatggacgggctgccgttccagtttgcactctacggctcaaccttatccgcaggcgattttcagaccattatgttgagtagcctgttgatgtcattactcgctggctgtacatgttggtttttactgacccgggttcagcgacccggtaaagaaattactctgggcatccggcgtggtgaatttcgcgtcgagtatcagcctttaattacggctcaggatggcaaatcttacggtatggaggcgctgctacgctggacgcatccgtccggtgaaacggtctcacccgatatttttatcagttacgctgaagcacaaaaccaaattatccccctgacccgacacctgtttgaactggtcgcccgcgatgcacaccagctacgtcatagcttgcccaaaggaacctgcctcagcttaaatatttcccccctgcatctgagcgcctgcagtttccgtgacgatgtcctgtactggcaggacaatatgcctcacgatcattttcagtacgtcttcgaaatcactgaacgggccgtagttgaaaacggcaatgcgactgaactgtttcactggctacatcagcggggaattaaaatcgcagtggatgattttggcaccgggcacagtgcgttaatctatcttgaaaagtacccttttgattatctgaaaatcgatcgtggatttgtgcaaagtattggcaccgaaacgatcacttcacccgtgctggatacagtgttacaactggctaaaaggctcaacctgatgagcgtggctgaaggtgtggaaaccgatgaacaagccagttggctgatcaaccgcggcgtcacccatttacaggggtatttcttcagtcggccgttacggccagagcaggtaagagactattttcaacgtcataacagtcaacccacgcgttaatcaccgtcgattatcgctgcggtgcaagacactcacaggagagaacatcccttatgccgctccgctttgtcattttgctgctgtgtagcttgctcatcaccccgctgcatgcgtctcccgttcagacaagttacacctttgctcaactgggatcgccgaagtaccccagagacttccgtcactatgactatgtgaatcctgcggcaccaaagggcggcaaaattgtcctgtcggtcatcggcacttacgataacttcaaccgttatgcctcacgaggcaaccctggcgtcggtaccgggccgctgtatgacagcttattcactacctcggatgacgaaaccagcagctactatccgctgattgctgaatcagcccggcatcctgatgacttcagttggatggaaattacgctcaaccctcgcgcacagtttcacgatggttctcccatcacggctgacgatgtggcctttactttccaaaaatttatgaccgagggcgttccacagttccgaatattttatcgtggtgtaacaattaaagcccttaacccccagacggtacgaatcaccttaccggccccggataaagacctgatgctggggttgctgacgctccctgtgatatctcaaacgttttggcaaaataaaaaattcaatgagccgctcagccagcctccgttgtcgagcgggccttatcgcgtaagtaagtggaaactgggccagtttattgaatttagtcgggtcaaaaactactgggcggcggatttgccggtcaatcgtggccgtttcaattttgatgtcatgcgttacgactattatctggatgacaacgttgcgtttgaggcattcaaagccggtgcctttgatctgcgggaagaaacgtcggggaagaaatgggccacccagtatctgggtcgtaacttcgataatcagcagatcgttaaagagaccacgccgaatacggcctcaattgatacgcgctggctggcgctgaataatgaaaaacccttgtttcacgatcgccgggtacggcaggcaatggcgctggcttttgatttcgaatggatgaataaagcactgttttataatgcttttaagcgagccagcagttattttcagaatacgcagtacgcggcgcaaggcgtgcctgatgctgcacagcggaaaatactggcaccgttcaaatcacagttacctcctgaaatcttcactgaagcctatgcgcccgcgaaaactgacggcagcggctacgatcgcgctaacctgcttaaggccatgtcactgctgaatcaggctggctggcatatccacaaccagcgcctggtgaacgataaaaccgggcagccctttaccgcagagttgttgctgcctgccggtgcgaatagcgagtgggcgcttccctatcagcatagtctgtcgcggctgggtatcacgttaaccctgcgccagattgacagctcgcagtacctgcgccgcctgcgtagcggcgactatgatatggtcagtaatatttatcatgctatgccgacgccctcacgcaatctgcaggccaactggcagtcagactatattcagtcttcgtggaacacggcgagggtaaaagatcccatggtcgataatgttgtcaaacagatcatcgctcatcaggacgatgccgacgcgttgctgccgttgggacaggcgctggaccgcatcttgctgtggaatgcgtatatgatcccgatgtggtatagcgccgagcagcggcttgccttttgggataaattttcccatcctgccgttaaacctgcctacagcacaggtgtggataactggtggtatgacgtgaataaagccgggcgactgccggccgacagacgctgaggagagcccggttggcacgttattttttacgcagactgttactgattattcctaccttgtgggcgatcattacgctcaacttttttattgtacagatagcaccaggtggcccggtcgatcaggcgctggcaaatattcagtttggtcaaaccagcgggctgcccggtgcgggcggcggtgacagcggcggtacgcaggccagcctgcatcgtctcacgcccggggataatcagtatcgcggcgcgcgtggtctggaccccgaggttatcgcggaaattgagcgacgttacggcttcgataaacctatcggggaacgctatcttacgatgctgtggaattatgtgcgcttcgactttggcgacagcctgttccgcagcgcctccgtattgcagttaatcaaagagagtctgcccgtttctgtcagccttggcctgtggagtacgttgattatctacctggtgtcgattccactaggcattaaaaaggccgtgcgtaatggcagcacgttcgatatctggagcagcaccttcattatcattggctactccattccggcgtttctgtttggcattgtcttgattgttctgtttgcgggcggcagctatttcgactggttccccttgcgcggactgacctctccacagtttgatacgctcccctggtacggcaaagtaaccgattatctgtggcatatcgcgctgccggtactggctacggtgattggcggttttgccaccttaaccatgctgactaaaaacgcatttcttgatgaaattcgaaaacagtatgtggtcaccgcccgggccaagggcgtttcggaacggcgcatcctttatcaccatgtgtttcgcaatgcgatgctgctggtgattgccagttttcctgccacttttatcagcatgttttttaccagttcggtactgattgaggtgatgttctcgctgaatggcctgggcttactgggctttgacgctaccgtccagcgtgattatccggtgatgtttggcaccttgtatattttcaccttgattggtttgctgatgaatatcctgagcgatttaacctataccctggttgatccacgcattaatttcgaggggcggtaatgcacatttccccgatgaatcagcagcgctggcagcgctttcgtcataaccgccgtggctactggtcgctgtgggtttttctgcttatcttcgtcctttcactgtgtgccgagttagtcgccaatgacaaaccgctgctggtgcattatcagcaacgctggtacgccccgctatttttcaactacagcgaaagcgatttcggtggtgagtttgctaccgcggcagattatcaggacccctggttgcaacagcgtattgaaaagcagggatgggcgctgtgggcaccgattcgctttggtgccaacagcattaattttgcgtcacaggtgcccttcccttccccgccatcatggcaaaactggctgggcacagacgcgaacggtggcgacgttttggcgcgtctgttgtacggcctgcgtatttcgctgctgttcggcttactgctaactctgttttccagcgtgattggcatcgtgatcggcgcgatacaaggctattttggtggcagagtggatctgattggtcaacgcctgattgaggtctggtccggtatgccgtcgctgtttttactgatcttactgtccagcgtcatccagcccagcttctggtggctgctgctggtcaccgtgctgtttggctggatgagtttagtcagcgtggtacgcgctgagttcctgcgtacgcgtaactttgactatattcgcgccgcgcaggcgctgggcgtcagtgacggacggatcatgctgcgccatatattacccaatgccatggtggccacactgacttttctgccttttatcctgtgcggttccatcaccacgttgacctcgctcgattttctcggctttggcctgcccattggttcgccttctctcggtgaactgctgctacagggtaaaaataacctgcaggcaccgtggctgggtttatctggctttttcacgctggcgattctgctgtcgctgcttattttcattggcgaagccgtgcgcgacgcttttgatcccagtaaaggagtctgaatgagcgccccgctgcttgctgttaatcatctctccgtcgcctttcgtcagggcaaacagctgcatcaggtggtggaggatgtttcgctgcgcgttgaagcgggtgaaaccctggctctggtaggcgaatccggttccgggaaaagcgttactgccctgtcgatcatgcgcctgcttcatgacgccgcggtgacctatccccagggggaaatcctgctggctggggaagacctgctacaggcatcggagcaacggcttcacggtctgcgcggtaatcagatggccatgatttttcaggaaccgatggtgtccctgaaccctctgcacagtattgaaaaacagttatacgaagtgctttcgctacaccgtgggatgcgacgtgaagccgcgcgggcagaaatactgcgctgtctggatcgcgtcggtattcgccagccggcctcgcgcctgaatgattttccccaccagctctccgggggagaacgccagcgcgtgatgatagccatggccctgctcacccagccgaaactgttgattgccgatgaacccacgactgcgctggatgtaacggttcaggcacaaatccttaacctgctgcgcgaactgcaacaggaactgaatatggggatgctgtttattacccataacctgaaaattgttcgccaactggcggacagcgtgagcgtaatgcgcgctggacgggtggttgagcacaaccgcagccaaccgctgctcacgcagccacagcacgcttatacccagcaactgctggcggccgatccggaaggtcgtgccgtaccccttcctgcagcgacgccggttatcctgaaagtggataatctgcgcgtcggttttcccctgcgccaggggttatttaaacgtaaaacgggcgagaaaatcgccgtaaataacctcagttttagcctgaaacggggagaaagtctggggctggtaggcgaatctggctcaggcaaaagcactacgggtctggccctgctgcgtcttattgcggctcagggcgaggtctggtttgacgatcggccactgcatcagctgtcacgaaagcaactgttgccgttacgtcgccgtattcaggtggtgtttcaggaccctaattctgcgctgaatccccgtatgacggtgcagcagatcatcgccgaaggcctggcggtgcattatccacagttgagtgcggcccagcaggatgaacgggttaatgcggtaatgacagaggtgggtctggatacagagagccgccatcgctacccggcggaattttcaggcggccagcgtcagcgcattgccattgcgcgcgccctgattcttgaaccggaactactggtactggatgaaccgacgtcgtcgctcgatcgctcagtgcagaaacagattctgaccctgctgcgcggattacagcaacagcgtcaactgagctatctgtttatcagtcacgatttagaagtggtacgctcactctgccatcagctgatcgtacttcgtcagggcgaggtcgttgaacaaggcgattgtgaagcgctgtttgccgcgcctgcacaggcttatacccgcgagttgctgggttccgtcacgctcagtgaccaataaaggtttccgcaatagccacgccctgattcttcaggcaacagttcgtggcgctctcatcacaccggcggataaacaggcagggttgcccttcgcactcggcgatttttccgtccacctgaatggctgccagcatgtctttgagttcgtgcagaatttcccatgccgggacgccatcatggctgatcagccgcagcgcgatcacatcatgctcttctgagccgacatcgtcggtttcaatcacgccacgacgatcgctaatccagcgaaaccgctgtggcaagcgatgcacaaccgaaagttgcaacatagtgatcagtatctccagagaatgaagctcaatttacaaccaacggtgtctgcatcgagagccgttaaatcatgctaacgcgcagatcctgcaaggcgtcctgtaaaagcaaatttgagagttaaatctcactttgggctatatgtaccgcgtttaatgataactaacaatcattttagacccaatttgattactttatttgctattttttttcacaaataagaaacattattttataagcggataaaggcggatcgcagcaaggcgcgacgcccgcttagcgggcgacggaacgaggacgtgaagcgtagagaaataacaaaacagagagggtcgcgcacagcgcaatggttcccaccataggccaggcactgttaaaactgaacagagacagcagcgcgccagccagtgcgccgacaccaaagcgtaacgtacccgccagagaggaggcggtaccggccatatgcggaaactcatcaaggatgacggccatcgcattagacgacaccatggaaacacagccgataaacatcgcaatgcccaataccagcggcaggaaccccagatcgaaagcgctcaccatcaacaaccagatgcccatcgcaaactgcaccaacaacccaaaacggaacagggcgacggggccaaaatggcgcactgcccggctgttaatcagcgtcatgatgaacaaaaacacaatattcaggccgaagtagtagccaaaactctgcggcgaaatgtgattcagttcgatgtaaacaaaagggccggcattgagaaaggtgaacagccccgcaaacgagaatccgcttgataacatatagctgaacgcccgcttatggcgaaacaggataacgaaattccccagcgtggtgcgcaggtgaaagcgctgccgctgctcaggtttaagggtttcgcgaatctgggtcgccaccagtacggtggtgataacggccgctatcgacagcgtccagaaaatggcgtgccagctccagattaacagcagccagccgccgataatcggggccagcagcggtgcgatggtggtaattaacatcacgaatgacatcatgcgcgaaaagtcctctttcgagtaactgtcgcgcatcaacgcattgattacgacgctggcggcggccgcagacaggccgtgcaaaaaccgcatcgcaataagctgttcaatcgactgcgagagtgcgcaggccgccgccgcacaggcaaagatcagggtacccagcgtaatgaccggcttgcggccatagctgtcggccaggggaccgtagatcaactgaccgatggcaaaccccaggatgtaaagattgagcgtcatctgcacgctcccggcggacaccgcaaactggcgcgcaatttgtggcatcgctggcagatacatgtctatcgataacggcatcaacatcgctaacaggccgagaataacgaccaggcccatcggcgaattcttttccttacgcaccgggtttctcgctatttctgtttaagttcttctggcaagccaatgctggctatctcttctgcggttaacgggcggtattcacccggttctaacgtgtcgtccagcgcaatcgcgccaatgcgttcacgatgcaggccaacgacccggttacccacggcggcgaacatacgtttcacctgatggtaacggccttcgctaagcgtcagcagcacctcagtgggcgtgatgacctcaagctgagcaggttttgtcaggtgcttttcattatgcagttgcacacctgcgctgaattgcgcggccgtatcctcgctcaccggcgcttccagcgtcacacggtaggttttctcgcaatggtgacgcggtgaggtaatgcggtgtgaccactgaccatcatccgtaagcagaactaaaccggtggtatcaatatccaaccggcctgcggcatgcagcttaaatgccatcggttcttcaatgaaatagataatggtgggatgatcgggatcgtccgtggaacagacataaccctgcggtttgttcagcataaagtagcgcggcccggtctgcatctgtaacacgttgccgtcatactcaacctcgtgatcgggctggagtttgaaagcggtgtcgcgcaccacgtcaccgttaacggtgacacgttgaccacggatttcacgtgcagcgatagcacggctgatttccagttgctgagagatgaatttgtcgagtcgcatgaattcgttttgcctgttactgcggagggaaactaaaacggcctgtttaaccgttgaaaaagtatgagaagtatatcctgaactgcgcctcgctgacagcgcgtttacagtggattcgtggcataattgcggcagattttacaaaagtgagcagcatgtcttttaccttacgcccttatcaacaggacgcggtcgatgccaccatcgcccacttccgtcgccatcatgaacctgccgtgatcgtcctgcccaccggggccggaaaaagcctggtgattgccgaactggcgcgcctggcacgcggtcgggtgctggtgctggcgcacgtcaaagagttggtggcgcaaaatcacagcaaatatcaggcttacggacttgaggccgatatttttgcggcagggttgcagcgtaaagagagccagcgaaaggtggtgttcggcagcgtccagtccgttgcacgtaatctcagcctgtttgacagtgctttctcactggtcattgtggatgagtgccaccgtattggcgacgataaagagagccagtaccaacagatttttcatcatctgcgccagcacaatccccagttgcgattgctgggtctgaccgccacgccgtttcgcctgggcaagggatggatttatcgctttcattaccacggcatggtccgtggcgatgagaaggccctgttccgcgactgcatctacgaactgcctctgcgctacatgatcaagcatcagtttctggtgccgccagagcggctggatatgccggtggttcaatatgatttcagccgcctcaccgctcaggctaatggtctgttcagcgaagccgacctgaatcgggaactcaaacagcagcagcggattactccgcatatcatccggcaaattgtagagtttgccgaggatcgccacggcgtcatgctttttgcctccaccgtggagcacgcgcgcgaaattctgggcctgctgcccaagaacagcgcactggtgtcggcggaaacccatgcgcacgagcgcgatgcggtgatcgcggcgtttaaagcccagcagcttaaattcctggttaacgtcgcggtgttaacgaccggctttgatgcgccgcatgtggatctgattgcaatcctgcgccccaccgagtcggtcagcctgtatcaacaaattgtgggacgcggtttacgtttgtcacccggcaaaaaagattgcctgattctggactacgccggaaatccgcacgatctttttacccctgaagtcggcgcgccaaaaggcaaaagcgacaatcagccggtgcaggtattttgccctgcatgtggtttcgcgaatacattttggggcaaggccacccaggacggcatggtgattgagcactttggccggcgttgccagggcgttctggaagacgatgaaggcgagcgggaacagtgcgactaccggtttcgctttaaaaactgcccggactgtaacgctgaaaacgatatcgccgctcgccgctgtcgggaatgcgacaagattctggtcgatcccgacgatatgctcaaagccgccctgaagctgaaagatgcacgcgtactgcgctgcggcggcatggcgctggaacagggtaaggacgacaaaggcgaatggttgaaagccacctattttgatgaagatggcaccagcgtcagcgaacggtttcgcctgcaaacgcccgcacagcgcaaagcgtttgagcaactgtttatgcgccctcatcagcgcgcccctggcgtgccattaggctggcaaaccgctgccgatgtgctggctttgcaacccctgctgcgccatcccgattttgttgtggcgcgcgccaaaggccacttctggcagatccgtgaaaagctctttgactaccagggacgctttcgccgcgctaacgaactccgttaggccggattagcgtttgcccctgctgcctattacggctataatgccgcccgcttttgcatgtgcataagcagtgttgaataacccttctgttactgggtcgcctgtagcaggaatcataaagagacgtatcaatgttcactatcgaagcagcagaacgtaaagagcagggtaagggtgcgagccgccgcctgcgcacagcaaaccgtttcccggccatcatctacggtggttcagaagcagcggttgctatcgaccttgaccacgaccaggtgatgaacctgcaaactaagccaggcttctacgatgaagttctgactctggtggttgacggtaaagacaccaaagttaaagtgcaggctgttcagcgtcacccgttcaagccaaaactgcaccacatcgacttcgttcgcgcttaatcgccgaatgggttgaacgtagaagggccggttgcgaaaccggcccttttattttgtctgttacccgccggaacgcattgccccggcctggcattacttactgctggtgcggcgttgaagctgttcgcgcaggttaggtggcgttcctttaatggtcaacgtatccgttgccgggtcccagaaaatgcgttcaccaagtaacagtgcgtcgaagttcagggtcagaccgccgccgctgccggcaaacttggttaactggcgtaacgtaccgcgatccgccgggaaatgttcttccagttcatagccctgttcctgggtaaaggcttcaaacgtcttttcacccagcggagggagctcgcctgataattcttttagcgcaatctcttcgcccgcctgaagctgctcattacagtagctgtaaacctgctgacggtaattttggcgttcgtttttatccagattcgactcgtcacagtagtcatccactgcctgtaacagtccccggttttgcgccttggtgtccagtccgacttccgcacccaggaagtccataaagaaatcagaaactttgcgcccgacgcgtccacgcaggaaggtcaggtaacgggttgattccggattcgtttcccattcggtcagatcgatacgtgccacaatatcggcatgattaatatccagataatgggtactactgatatccatttgttcgttgacgcgcatactggactggctgttcaacaccgccaccagtaaatattcgaccgccaggtagcgatactgaataaacagcaccacgccgccttcggcgaacggatattttgccagttcatcacgcagacgtccggtcgcagcccggctaaaagcgagaaaatcatcgttacctttgcggcagttgcgcagcgcttctgccagttcgctttcagcattaaacagcccgtaagctttacttttcgcactgtaaacacggtgcagctcttccaccatcgcttcgacggtgttggtggcaggcagtaacgaatcacgaagcaccagctctaactgattttcatcacgtttaattaactgatgcaaggcaatctggtcgatatccagactcatggtaaactctcctaatagcacaggcgcgtattcaaacaccgccagcagcagctttcaactccatgcatcatgcgaacagtgcgctttcgataaatttgcggaaaaaagtgcgctgttccggtactatatcgccttttgagacgagataacttttcgctatgccacaatcatcccgttacagcgaccaacgcgttgaacaactcctcgcggaaatggcgcaggttttgcaaaaagaccaggcacccaccgacctctccctgatggtactggggaacatggtaaccaacctgattaacagcgatgttgcgcctgcgcaacgtcgctctctggcacgttcttttgctgatgctctgcaggcatcggtagacgacagcacccattaattcgctgatctgacgtaaaactatggtaaccaaccgacagcgctaccgcgagaaagtctcccagatgattagctggggacactggtttgctctgttcaatatctttttcgcgctgattctgggtagccgctatctgttggttgccgactggcctgcctcgttggcgggacgtatctatgcgtacacaagctgggtgggtcacttcagctttattgtgtttgccgcttatctgttgattatcttcccgctgacgtttgttgtcatgtcgcaacgtttgatgcgggtgctttcgacggtggtcgccaccgccggcttaacgttgctgatggtcgacagtgccgtgtttaaccgtttccatttacaccttaatccggtggtatgggaactggtgattaaccccgatcaaagtgaaatggcgcgcgactggcagctgatgtttatcggtgtgccgctgattttcctggtggagattctgtttgccacctggagctggcagaagctgcgcagcctgaaccgccgctcttttggcaagccgctggcagcactctttatcagcgccttctttgccagccacttaatgtatatctgggctgatgccaatttttatcgcccgattaccatgcagcgcgcaaatttgcccctttcctatcctatgacggcacgtcgctttctggagcgtcatggtttgctggatgcgcaggaatatcagcgccgtctggtgcaacaaggcgatcctgaagccgcagcagtacagtatccgctcagtgatatcacctttgcggataaaggcgcgcgcgataatttgttagtgattacggtggatgggctgaacagcgccagtagtgacagcgccctgccagcattgaaccagtttgccagccagaacgtacgctttacccaacatttcagcgcgggcgataatgcagaaaaaggcctgtttggtctgttctacggtatctcggccagctatatgaacggtgtgctggcacagcgaacgccgtccgcccttctcaccgcattgagcacccagggctatcagtttggcctgttctcatcggatggatttagccagccactttatcgtcaggctctgctgtccgactactcgctgcctgccagtgaagaacagcccaatgccagcaccgtctcgcaatggcaaaactggctgggcgctcaaaagagcgatggtacgccatggttctcctgggtggcactgcatggcccgacagtgagcggtgataacgccaaagcacggcagcgcagctatatgcgtcaggcaccggcgctcaatgatcagattcaggccattctcactacgctgcagcagcgtgacttgctgaaaaacaccgtggtggtcattacggcgcagcatggcgtgccgctggatggcgatcccgataatgaaggcaatcgccaaatcctgcaggttccactggttattcactggccggatacgccagcacagacagtgacgcgcctttccgatcatcaggatgtgatggtgacgctgatgcagcgcttgctgcacgtcagtacgaatccggtgaattatgcccagggcgaagatctgtttgctgctcagcgtcgccatgactgggtcaccagtagtgaagacaacaagctggtgatcacgacgcgtgacatcacgctggtgctgaacaataacgggagctaccgcgcttatgacgccagtggaaaagtgctgaaagatcataaaccggagctggcgctattgttgcaggtgctcacagaagagaaacgttttattgctaactgattaataatgcggcagttagttgcccggtagcttgcattcgtacgaagaatcagtagactagctttccaaagttcggcacgtagcgcagcctggtagcgcactgtcatggggtgtcaggggtcggaggttcaaatcctctcgtgccgaccaaattatcccttaaaaagcagcctgttacggctgcttttttattgcctgcgatttgcgatggtaaaataatggtaaaaccagccatcattttgctgtgatcagatatcagaagcgtgtgacatgagacaacgccgcttcgcacatcatcgtccagtacatttctgccctcgtgccccaaaaacgtcccacgcccgcacccaacaaaagcgcaggctccaccagcaagatgccaaacggcgtcaacctctgtgccggaaacggaccgcgctttgtcattgaaaacagcgtcctgacagattccctgcgatatctacaggaccaccggtttactgctacgtatcttgttatcgtaacctcaggatgccggagaggatctcaaacgtgagatcacgtttgatgatgagcctgcccgtcaacaggcgacgccaaagccagcagtgcaaagctggcaagccagtggccgccgctataatggctgcccaccacatgagggagactggctgtcagatgccgttcagctgcggcctgaagcagcgagacagcgggatgagcgtttggcaatgcaacagcaagatgcctgaagcaccaggctctgctgagattcaatccgtcaagatgagtgatggtaggatcggtacgatcgctgacctctgcaggctgcatcagcgcggtctgactggcgatatcaggtagaaatgcgtcgaaccagttggcgaagttaacggtgactttactcattaacatggcttccgttaatgcaccagaaaggtattcgtccccaccgggttcataatgtgctggataatcggtgtcctcgcggtaaaagcgttctgcaacattaacgatgacgttttccagcaagcggtcctctaaagtgcgtgcgtaatccagtgctaacatcagcgcgaaggcagaattggtgtgggtcccgacccggatagcgtaggtcagcttactgaagtagtcgataaagcgacggcgaatgtcctgcgtcagtggctcaagcctctgataccactgtgcagcctgcggcaaggcagattttttcagctccccggataagccaagcaaccatgcataaccgtaaggacgttcgaacgccgtgcgaaacggtacggtaaaataagcacgttcctgcgcgatattttcttcagtaaaatgcgcatgaaaaacagcaatgatttcatcacggcatgacaacgtgggataaaggctcagggctcggagcaacagccagtaaccgtgtaccgcagagtgccagtcgtagcagccatagaaaaccggatgcagtgcacgtggcgacaaggcatcactgtcatcaagcattaagtgtacaagatgactgggatattcctggcgcaaataggttaatggcatccgggcaaacgcatcagcccaggatggcgttaatttcatcatcattccttacccgagaaagtgttaaccgtctcaagattccccttaccgccagtcagtgacggcaggttcattgttggcttaaaacacatgatcgctgcgggctctcgcgcgtccgcaaacgctggcatcaacatttgaacagcggtcagcctgcccgtaacgtccgccaaagcaacaagcgccacagatcggtttcgtcgggtgatgacctcatctctggcgcgtaccgccaacgatgaggttatccactttaagcgtgggttgtcccacgcctaccggaacattctgtcccgatttaccgcaggtggcgatgccacgatccagggccagatcgttaccgaccatgctgatctgttgcagcgtttccggccctttgcccgtcagcgtggcgcctttgacgggtgcagtaattttcccgtcttctatcaggtaggccagcgcagtctggaagctgtattggccgctgacgatatccacctgcccgctgcccaaattcgccaggaataagccacgtttgacggacgcaatgatctcctcaggctcatactggccgttgcgcataaaggtgttcgtcatgcgcggcatgggaagatacgcataggactggcgtcgtccattgcctgtgggaggcagtttcatcagccgtgcactcaggctgtcgtgcatataaccctgtaaaattccgtcttcgatcagcgtggtgcactgcgtcgggtgcccctcatcgtcggtattcaatgaaccacggcgtccctgcagcgtgccgtcatcaacaatattcacgcccggtggtgccacccgctcgccgatgcgccctgagtacactgaggtacccagccggttatagtcgccttcaaaaccgtgtcccatggcttcgtgcagtaacatgcctggccagccggcagcaatcacgaccggcataccgccggaaggggctgcgacggcctccaggtttatcagcgctgaatcgaccatcgtccgcaaagtaataagcaaatcttcatcgttgaacagggtgaagtcgccgcgtccccccatgccggtactggcagactcccgaacgcctcgctgctctacgatgacgccaatttgcagcagcagcatcgggcgaatgtccgccgcctgataaaaatcatgtcgcatgacgaagtttactgaatgggacaacgcgaggctggctgtaacctgcaccacccggggatcaagtgcgcgcgttaaccgattgattttttccagcaggttaattttctctgccgaatcccatgtgagtaagggatcaccggcgctaaaatggacggcctcgggtcggccgggtacgggttcggggagagccagccagccttgcttagcgatggttcgtacggattttgcggcttcccgcaaatgcttaagatcaatatgctgagaatacgcaaaggcggtctgatcgtgttcaattgcacgcaggccaaaaccctgatcgacattgaacgagccaaaattgacgaccccgttttccattgaccaactttcctggcgcaggctctggacatacaaatcggcgtagtcaattcgatgcacgagcacccgacccatgacgtcgtgtagcatggcatcgctgatgccatagggttccagcagttgctgtttggcctgcaccaggcgagtagttgtgcctgtttgactcatagtaaaactcctttggcttagcgtcctgccacctgaaggtgatcaattaatacagacccggaagtcagagcgccctgagtagtaacatcgctcccgatagccacaatgttacggaacatctcgcccaggttgcccgccacggttacgccatcaacggcgtaacgtatttcaccttcttcgacccaaaaaccacgcaggcttcgcgagtaatcaccgttaatcagccttggcccgccgccgctaaaatgggtgacgatcagcccgctatggagttttttcaccatcgcggcgaaatcgtctcccttctgcgtcaaactactggtcagtgacaggttacccggtccccagccactgccggtggggaccctgtccagatgccgcgcggcataggcggagaggaaaaaccctgtcagggcaccttgttcaacgacctgtcgggttgtgccactgaccccgtcgccgtcgaatgatcgactggcgagcccctgcggcgcaaagggatcttcggtaacgctgacatgatggctaaagacgtcttcacccagcctgttggcgagaaaactgttgcggcgataaaccacactatcgctggtcgcctggaccaaatgttcaagcaaagacagtgcgcatttggcgtcaaacaaaaccggacagcgtcggctgccctgaagcggtaaggtgtccagcgccgccagcgccccgcagcctgcccgatgtccaatatcttcgggtatcatcagcgattgtgcctgccgggcactcgaaaaatgaaaatccagcaggctgcgcccctgtttactggcgagcgcccgcgcgcccatcaggtgattgctctggcgctcactacaggtaaaaccacgactgtccatcatgaaacaatccgacagcccggaatggacggtaacaccgtcgctgaccacgccgtcgccggctgaaacaatgccagcctcaatacgctgtgccagtcctgctgcactggcctcatcaatatcccagggatgccagaggtcaaggtggtcagatttgcgacaaaggtagtgctccgccgccagcccggcaaaacgatcttcgccggtgtaaccggcaatgcggcatgcggcctgcacagtctcacgcagacttgtaggcgaatagtttgtcgaacgggtcgtcccctgatgatgtccgcggtaaacggtaaggaacatgctggattggctggcgcgtgtacgggtttttaatcgcccctggcgcatctcaatcagcagacccgtgctttcgttaaacacgacctgggcatcggatgccccctcctgtaaggccagcctgatgacgctatccgccagatctgacagctgaacccggctgtgcgcaaaagtattcggcataacagtcccctgtttatccgtcatcattacaagtccggtgcttcagtgagcaggcgatttaacaccgtctgcagttgtgtactcagcggcaacgcgagttgggacagcgtttgatgaaacgcattttctttactgataaagtcagcgttcagcgactgccactcctctctgagctgagcaatctcactctgactgagcttgcccgttggcgtctgacgttctttagccataaaccagttcatgcgctccgctggcgtagcgcggtcagcgtcgctccagcccatctggatttgcataatatggtaatgcgcccagctcatattcttcgcaatgatgccccactgctccgcgtgggtcgtcgcaggcagcggtgcgagatagttgagcagcgtggcgactatcatttccagctgtcggtccggcttctgatagtcgttcaacagtaaggccgcctgattgcgaatatcaatccaggcctgcggggccgtttcacgcccagcgaaacgatcggcgcacagcgcgcgccactgcgccagtaacgtctttaactcaggagctcgcagatgattatcccatgggaagaaagcctcactcatccaccactgcatacatgccgagggaaccagccggtaatctttacctgcacgcaacgcctgaaacaggccgtgcacctgttcttcggtgagatattcactgcgatccatcagacagcctaaggccacaggcaacccggtgatacgttcaaaagcgtggctgccgggttgatgcaccatcgccgccgagagcgtacctttatcgttaatccagtagctgctttgtccggtagtaatctccccggcggtagcatgtcgcagcgcgcgcgcggcaataaacgcgaacagttcgttgtcatcatagaaactgccccactccagagtctcgtcctgctgcacattcactgctggcaacgacacgttgacctgattattcgccagccattcgttgagttgggccagagactgagcaccaaccaaccgaaccggatctttagcacggttaaacagcaataatgtcgggatacctcgcacgccaaagcgctgcataatggacgggtacttttccacatcgagcttagcgaccaacaaattgcccgcagtattgcgtgccagcttatcgatggttggcgacatggcgcggcaaggtgcacaccagggtgcccacagatcaacaaggaccggcacctgagcgtcagccaggaatacatcaagttcagtgtcggttaattcaatggatttatgcgtcatactgattcctttgaaagcgttaacgctcatgtacgggagtgagagtgagaatatggtggtggaaatgttcaagctctttacggtgtgccacgctaatcagtgtgcagttgggcaactgatcgattaacgcctgataaagtcggttttctgtctgcggatcgagcgcactggtcgcttcatcaagaaacagcatatcgggtcggtgcagcagcacccgcgcgatggccaaccgctgttgttcaccaccggagagcacctgttgccagcgatcgaactgtgttaatgacgcggcgcgtgcttccagacagcagtcaattaatgcctgctggcattgcgcatcggtgaatgtgtcaggttcatgaggataggtcagcgcactttttagcgtgccaaccggaatataactcttctggggtagaaaaagcggacggacagaatacggggctgtaatcctgccttcgccatacggccacagtccggcgcaggcacgcaacagcgtgcttttaccacagcccgaacgtccacgaataacccaacgctcaccggcctgtacctgccagtgcggcaaatgggacaggacagagccgtctggccgctgtagcgtcaggttctcacactgcaggttccggccctcgtgctttagcacaatacctgaaggtttatcacgcgctttgtttaacgcccaaagcagatcccggagtcggttcgacaacgccatccagttggtaaaggactgataagcctgcgggaaaaacgaaagcgtgctgagcaaggttccataagccatggtaatttgcgtcaggccgcccatggttattttgccggacagcaggagtggcagtgccagtaacgtgggcagtggggaaaatatctgtgaaaaaaaactctgataaaaattgagcctgaatgttttacgcatcataagcagggtattctcacgcacccgctcaaaacgtgagaatagccgccgccgctcacgcccaccgcctttaaaaaaagcgatttgctcagcgttttcacgcacctgcatacccagaaaacgaaaatcggcttccacggtttgtttattcatattcacgccgatcagcactttacccagccagtgggccagcgcgagatgggcaatggaatatatataaacagcaaacaccatatagccgggaacagataacgtcctgccacctatatcaatggataacgcgccggacaatccccacagcacaatggtgaaggtgaccatactcaccaccacattaataatgttggtagaaagattaattgtcacttcggtaaagagattaatgtcttccgcaatacgttgatcgctgttgctgataacattatcccgctctaactggtaataagcagggtgttcagtccagcgttctacaaagcgggcggtcatccatgtccgccatcgcaacgtaagatagtttatcgccagtacgcttatcaaaggcaataccgtggttaacgcgccgataatcaggctttcaaccatcgttttgctgatcatcggccagttaagtgccaccagcgcatcggttagctttccatgcagcttattgagtgcaacaaacgcaaatgtcgtggtgaaattaatcgtcaggataatagccagtaataagatggccagccatttttccgacgatatccagaaaggacggattaattgccacacgccgggtcggttatcatccgatggaattttatttaccacgttattatactctggtgatttacatgtatcagaacgaataagtcagcgtcaggcgtgctgtcctgtcaggtttcacactgataaactgaggggttgaggtgtaataatagagcgtgcgattaaatatattattcacgcccagcgtcaccgtatatttaggctgatgatagaaaacggaggcatccgtttgtgcccaaccgccctctttaaaataattgtttctgtaaccgttccaggtactgcttgctgcctgaaccccgacacccgcacccagtccctgtaatttcccttgctgtatttcataagttgtccagaggctcgcggtatgttttggctgacctacaactttactttggtaaccgataagtgccgcgttgtcgggatcttttgactgggagaaagtataactggtggtgatattccagcccggcaatatctgaccattcaaatcgaaatcgaaacctttggtttcccttccctgtgtcccgactggttgaccggcaaaattcgtaatgatgagatttttttgaataatgtcaaaggctgacgtcgtaatcgtcaggttatcgtcgagcagactgaatttaaagccggcctccttcgatttgcctgtggaaggtgcaaatgcgcttccggtccgggggtccagcaatccagttgtctgaaaactgttgagtaaattagcatagacggtgacctcaggcgtaatgtcataactcacgccgtagctgggcacccatttcgtttcatctgaaaaggtaattaaagtgcgcgtcggtgaaacataggccgtcgattttgacgtccattgcgctcgcttggcggacaattgcagatgcagttttttccagaaatcaatctggtcctgaaggataattcccttttgttgttcgagcgtattatagtttttagcagttggatcaggtattggcggaaaagaaagactgtcaggattgttataatttcccgtcgtgaagattcgcccctgagccagttcccagtcggtggtctctgtatgttggtaatcataacccaccagaacattatgcgttaacggcccggtatcgaatttgccccggatatcgttctgcaggcttaaggacgtcgtgtcctgtctgacaccaagctcgtggctcactaaattgccattgcgcgcagcattgtaaatttcatgaacgcggaaattatttacgctgtccacataagtggctttactgttaaacgaccagttatcactcaaatcctgtttcagttcataataggtagttttagaatcaagagagaagtggtcatccttatcacccaggcgatattctggcagtttttggatgcggccatcactgtaaagggttgctgcagggcctgagtttcttgtattagtgaattcggccccgactttaatatgtgttttttcaccttcccatgcgaggaccggtgcaaggtagtcggcacgattaccattaaaatccgggaagctgttatcggagtgcatggtggatgcattaaggcggtagcggaacgttttatcgtcgtttaacggtccgccgagatcgattgcggttttgagttcgccgtatttggctacctcgacttttatcgtgtgcagcggataagccgtgggggctttgcgaactacgttaaccgaacctgcaggagaactgtttcctgctaataccgcctgcggccctttcagcacttctacgcgctctacgccatcaatgctggaatagcccaacgggctgccgttaatctggctgccggggttggcaacgccatcggttgaaccagacgtgatgttaaaaccacgaatactgacgccgttttgtcccctgtttcctgagctgaaattcactccccccacattgcgcagtgcatcttgtacagaggtcgcctgctgatcgtcgaggacttttcgactgataacctgaacagactgtgccgtatcctgcagcgataaattggtgcgcgtcgcggagctcgacatggcggggttataaacggtttcatcttcgcttcgttcggcctcaccgttaacggtaatggtcggtagcgtctggccattgtcgcgcacggcctggaagtccgaggcagccttaaccggcgtagcggtgctcatcgcgtagatagtcagtgtgccgttaggcgtggtcgtgacggagagcggtgtcccctgcaactgatgcaatatggcctgtttcagcgtgaaggaacccttgatctgtttagcctggtaaggcgcgaccagtttcggatcgaacgaaatagtttgatggctttgttgcgctatcgctaataacccctgctccagagatcccgctggaacagaataattgatttgtacgggggaagcagcgtatccctcctgcaaggtaagcagaggaagggccgccatggccagggcaatattgacagccaatgccagacggccttgggtaaaatacgttttccttgcatgttgaggtacttgtttcattgctacagctccagcgaaaaggtaaagggttgaagcatattgttatgagtcgattattcttctcagtgtgtatgtgcaatgaagattaaaaagtgacaccggatttgagtatttatgtgaaaaaaatcacttaagttaaaacattaaaaatattaactgtttaatttcaaaataaatttataacttattcatcattatgtaacgcaaacccaccgatagcagacgatcaattagcgccctcttagggtgcttaatcggggattagcttctgccaatagacctgcgcggtaaatcagtcatcaatggctgatgtagaagaaaatgaaacgcattaattaaaaaatgcataaccttttcatttattatgtttttttaaacatacaggcagagccagcagtattaacgcaccattacggtgcattttagtagctggcgcttttactgtcgggatggaagggtaaagacagattcacggttatcgcacatgacgttttataaaagactgaaaaataataaataaaaaaaataaattttaaaatccgacaccaggaaacatattggcctttcttttgctaggtaggcaaacattttcccgccttaaactgcgcctgaacagggcgcgcaaaaagtgggttccgtttctcggtctctttgtaggctctgagagtggtgtgacatttttcagatggggtaacattatgcctgccgacctgaccgaccgttcagacatattaacgcttatttttcgcagtgattaccgctggctgaccgataaattacgacggcgtattagttacggcactatggctgaagatatcgcgtctgaagcatttctgcgtctggcggcaatccccgaattgacgcacatccgcgagccacgggccatgctgacaacgcttgcccagcgtgtgttatacgaaaactggcgcagacgcgatcttgaacaggcttaccttaaagcgctggcggatagcccgcaacattgccacccctcacccgaagaacttgagattgtgattgagtcgttactggctattgatcgcgccctggatggtctgtccgtcaatgcaagaaaagcgttcctgctcaaccagcttgatggcatgacctatgcggaaattgcacaggagctgggcgtctccgccagcatggtgcgtaaatatgtggcgaaggcgctcacgaattgttatctggtgaccaacggtcaactgaaataaacggcggaacagcaaacaatgaaactcacccagcgtcccgatgacgccgcgcaggaagcgattgaatggatggtgcggttgcgctctggcgaagccacggacgatgatttccgggagtatgagcgttggcgctattccgaccatcgccatgacgacgcctgctgtaaaatagaagccacgctgggtaagattcagaccctcaatcatgccatcccgacggaaaacctacgtcaaacgctgctcgccccctcaagtcgccgtaaattcctgcaaaaagccagtggatttgccgcaatcgcggtggtcagtggattagtgttgaatcaaaaatacccgttgccctatctgttatccgatgtgcataccgacaccgggcagcggcgcaggattcagcttgatgacggtagcacactggatatgaacgcccgcacggcactgaatattgcctttggtgacacgttacgtaatctggaactgcgcaccggaggcatcattgcccaggtggtcagcgatcaacgtcctttcattatcgatacccaggcgggacgcattcttgcccaggaggcgcgttttcatgtgcgccaggactctagcggtatccatctggccgtgctggactcggtggtgaaagtcaccaacctgcgtggtaacagtcggcaggttcaggcaggccatggcctgtggtttgatcacaaatcctttattccgctgggcgtaacgccttatgaggagacagcctggactcagggacgcctggaagtcaaagatgcgacgttaggttccgtgattaactcattaaaaaattatagccccgccgtgatccgcgtagaccaggccgtggctgacctgcgcgtcagtggcaacttcccgctcgatgacgtgccttatacgctcgacgcgcttgctcaaaccatgcctatcgcgattacgcgcaccaccgattactggatcaggattaaagctgccgaatcctaaaaagattgtctttttttacccagccggtgtcatttttcctttctcattgcacatacagggtaagtcttcctgaaactgccgcagagaagtcatttacgggcagtagagatttatcgcgaggtagtagtgaaagcagagcgcctgatttttaaagatcatctttcagtgtctgacataccgacggctaccctgattgctccgcaaggcgcgcagaatccctttaacaaaaatatgccaaaactggcgattagcgctgtggttatggtgcatctggcactcattgccatggcgattacgcacaccacgcaataccgacctctgaatattattaatcctgcaacacaaaccagtattgaagcgaccatggttgaggcacccgccgagccgatcccggttccgcaggttgtcaaagcaccgcctgtattaaccgccgataacagtacccgtgagatagatcaggatgacactcagcctgtcgtgccaccacctgaaaccaaagtcgtgccgcctaaacccaaacccaagccagtgatacggcacaaaaaattaccggaaaaaacgcgcccgattgagccggttaaaccttcaccggtacaaaatgcaaaagtggcggatcggacggcgattcctgcaacctcccaagggcaaatgttgaaaagcgcccccaatgcggctcctaaaaatgtcgcgacagtgggttgccaggtgccggcaccggactatccccgtcgggcaaaacggcttcaggaacagggcgaagtgcttatccgcctgataatcaatgccgatggcacggtgaaacatagcgaaattgcccgaagcagcggcttcgacgatttggatcaggctgcaatggaggcggtttcccgtgtcaggtgtaatccctatatggaaaacggacaggcgatttccatcatgacgattcaacccatcacgttcaaattatccagttaatcctgttggatggtgctgagcggtcgcttttctttttaactgaggatgcattatgaatgagtttggcattgaacacgtatggcaacagggcgacatcattacccgtggggtggccattgtcctgctgataatgtcggtcatgtcctggtcggtgattattataaaatgcatacagggcgcgggaatgaaaaagatagctcaccgctccaagcatttattctggagccaaaagacactgccagcagccattgatacgcttggtgccagcggcaacaatccgtttcgcgacctggcgattgccggccatgccgccatgtctcatcaatataatattgagacaggcatcagcaacaatcttgatatcggcgactggctgacccgggccctgaaaaacagcattgatgacagctgtgccaatctgcagtctggcctggggattcttgcctctatcggcagtaccgcgccgtttgtgggtttacttggcaccgtctggggcatttatcatgcactgcagtcgatcagcatggctgaccagcctgatctggctcacgttgcaggcccggtgggcgaagcgcttatcatgacggcgtttggccttttcgtggcaattccggcggtattagggtttaacgccatcagtcggcgcaaccgtgcccttcagcattccatcgcgcgtttcgcaaacgatctgcatgcttattacctcactggctcacgcattgcgtctactgtcgaggaactccatacgggtgataaacgccagtcgagtcatattcagccgttccgcgccagtcagtcagtgtaagtccggccgtatcaggagacgctaaagatgagtatgtcaggtaaatcgccgttcgagttagatgaagatccgctggtcaatgacatcaacatgacgccctttattgacgtcatgttggtattgctgattgtctttatgattacgctgcccgtgatcaatccagcggtaaaagtcaatttacctaaggctaacgccagcctggttgataagaatgttaaatcagtcgatatttcgctgatggctaacggcaatatcgcctggaataaagaaacacttgatgacgcggcctttaaagccagattgcaggacgcggcgaaactgcctgaagcgccacatttacgcatctatgccgatcagggcaccccttacgggcgcgtggcatttgtgatgacaagtgcacagagtgtcggtttaacaaagtttgatttcgttgtagataaaaaggtgccggcatcctgatgctgtcttgaggcaaaacacctttctgacaacaggatacatttttcggcctgcagggaaggcattctgcattgatgctcgttaatgacaaaggataaaagacgtttacgtgggttaattccctggccagcacaggatggcctcattagcgctatgcgggatagtggataaaggcaaatattatattttcactgcaagcgcaacgaagactatttcaaggaaaggtgagtgtcctgattcattgaaagtaagcgcaaatgaatgctgcggccattaaaaatgccagcggagcaatccacgcgccatcagagggtgaatattaatggcagcactcagaatggcggggttattcttctgtggcggataagcggcagtgaaagatattgggcagtcaaacgtatagaaaatacaggttatcttcacgtctgattttatcgcgcaaaattgcggttatgtcagacagataatattttttgcccccatcctgcgctgtaaaaaaaccaacctacacggttggttttttacgcgtgacgtagcctgatatcatccgctccggaaacgcaatgctggcggacatgctgctattcagggctgcagatcgatcaccaccatattccagctgagaggcggaagtgacacctgtttctggcgacgctgtgcatcggtgacagtgcgcggctgcggcaccaccttatccggctcagtaaaggtatttttagcgtccagcgcatggcccgctaacacgacatgttgtgataatgtcccctcaccaaactcatcgagcacaaaggtaatgtctgccgcatcatgggcgtgcgtgttcagcgcgaagaaggcgatctgctgtttctcttcgttgtaaacggccgcgctctgaacctgtcgggtttcgccatgcacggtgttcaccgtaggaacattggcaaaatagcgtaatgcctgtccccgtccatactgactcaccatctggaaaggccagaagatggtctggcgaatcacctcaccaccggggcgggtgaagatgggagcaatcacattgaccagttgagccagggacgccatttttacccggtcacagtgattgagcaacgaacacattagcccaccgaacgtcagcgcatccagaaaagtataagattgttccagtaatggcggcgcttcctgatacaggttgttcgggtcgataaagtgatcctgccagggctcgccttcgatagaccagatattccattcatcaaacgacagcatcatctttttatcgctgcgcagtttggctttaacatagtcggccgttgccgtaatggtatgaataaaatcatccattttctggaacgaggctaagaaatcctgtggatgaccggtgctgttttcaaagtaatgatggcatgacaggtagtcaatctgatgataaagcccctccagtacaatgcgatcccattcgggatagctggcctgaagcgaattagaactgccgcatccgaccagcttgatatcccgatcaacccaacgcatgatttttgccgtttcacgcgcttttttgacgtaatcttccgcactcaactgcccggtctgccactcgccatccatctcgttgcccaagcaccagagcttgaaattatagggtttttgccgaccatgctggatacgcagatcgctgagtgcggtgccggatgccagattacagtactcaatgaagtaaccggcctcctgcggcgtgcctgtgccgagattgacggcgatcatcggcgtaacgccatacttttcgcaccaggtggcaaactcatctatgccaaactgattgctttctttggtcagccacgcgtaatccagccttaccgggcgcgctgattttgggccaataccatcgcgccagttgtatcccgaaacaaaattaccgccgggataacggacggtgctaatccccagctctcttacccgttcgcccacgtcctgacgaaaaccctgttcgtccgccgtggcatggcccggttcatagatgccgctgtagacggcccgtccaaggtgttccacaaaggaaccgtacagggcatcgtccacccgatcgatggtgttttgtttttgaaaaaagtacttaatcattttcttcccttctgttttcacaatggattacagctggagactcagtcgggatgagtcgagaacagatcgtcttcaatggttttcattttggcggtagtcaggatatagcgcgtgcggaccagccacacagacagcagataaccgaccacgggaatccagaccatcagtgcgtaaatgccatcgatcgcactgcggctttgttcggccacattggcctgataaccggtaaacgacagaaccccgcccacaatcgcgccactgacggccagggcaattttgagtgaaaacaggttgccggaggcacagattccggataagcgcttgcccgttttccagtcgccgtagtcatcgacatcgccaatgaacgaccacaggatgggtgcaccaatctgatgaatgacagacaggataaaaaaccagatgaaaaccagcacactactctgggcgggtaaaaagaagaacacgatcgacattgccagggctgtcgatttagcggcctgataaacctggactttacaccagcggttggtgaaatacggggtaatgtaagagccaagaataccggcaataatgccggtactcagaaacagcgtggcgtaatagtcgttcagtcccatcacatactttgcgaaatagatacaggccgcgccgcgtacaaaagaaggaatgcagtcgagaaacatggcaaaaacacaaacaacccactgatcgttttttgtaatttgccggatgatcgcgaaaatcgactccccggcattgctcttaggtgtgatgcgctctcgggtggtcgcgacgcaaaaaacaaacagaaacagggagatcacggcaaacagcgtgatgacccagaagaaaccaatttgccggtttccgttaccgaaaaacgccaccatcggcagtaaggtcagggtgcagaacaagctggcaagccctgcgcccataaagcggaactgctggcaggaaacccgttcctgcgcattggtggtgatcaccccgcccaacgagcagtaaggaatattcaccccagagtaaagcagcgacaggatgagataggtaataaaggcatacatgacctttgcatggccctgtaaatccggcgtgtaaaacatcaccatacagctaatggcaaagggcacagcaaagccaataatccacggacgaaaacgcccccagcgcgtcgtggttttatcaatataagcgccgtaaaaggggtcgaaaaccgcatcggcaaaacgtacaacaagaaatatggtcgccacaacacccggtgccagtccaaatatatccgtatagaaaaaagacaagaacatggttatcggattaaacagcatattacaggcggcatcaccggccccaaatccggccttttcaacaaagccaacgcggcccgaacgcaccggctgggcacgataagcggtatcactgtttgacgtaatattcgttttcatttatcacctttcaccttcctgaaaagaggtggcgataagcatatgttttagagctatttttggcctacgatgaccctcgcataagcaaaatcatgactatattttccatatatttagcttatgcaggcataaaagccggaggacattcccccattgtgtaacctcctgtgatggagaacggtgtgatttcctgtatataaatatcgtgctgaatggtggcaaaaagggcattaagaggagagtaaagaggaataaaacagaatcgcttcactcaccctcttgtgggtttgaattaactaatcatttaagtaaaagaggttaattaaaatattgctcaatcgatataaacctgatgaaaagcattatcgttaaataatgaaaattaaaaatatacagtgcagaaacatgcatatttaatgttgtaaaaacgcggtgaaagtgcccttacggcgtcaacgtaccaggctgaccgacgatacatcctcatcgtgcagcacgcgtttcctgccgcgtgcagaaagcagcccaccctcagagcaggcgcggggccatctgctctgaggttgggctgccctgctgcggcggtctgaaagcggcggtcagcgctgccacagtgcaacctcgaaatgacattatgaataaattccattaacttactcgtcgcaggaagcccaaacgcacgctacgcttatcggcatcattgggtttgtggttgaatacaaacaacattttcaggcatacgattaacatgaattatttgaacgacatacaacactatattgaaaacaaacctgcactttctgttactattaacctcgttgtgttgatcgtcgcgggcctggttgcgcatctgatttgtaagttttttgtggtaaaagtggtacgtaaggtgttttttagtacccataagaaacaggtgccgctcgataaagatgtcaggttgtctgaaaaaatctctaatttcattccggttatcaccgtttactttctgctgcagtttatgccggacttgcccgagcatctgttaatcgcgattaagactatctgcggcattttatttatggtttacctgtcgctgtttttcaatgaagtcctggagattatcaatatctcctatgttaaaaagtcgaaacgtaaaaatcattcgattaaaggttatattcaggtcggcaaaatcctggtgcatatcatctcggcgattatgatcctggccattatgtcgaataaatcgccagtgattattatctccagtctcggtgcggtggcggcggtgctgatgttgatatttcagcataccttgttgtcgctggtggcgaatattcagctgtcatccaatgatgtgctgcagttgggcgactggattgaaatcccggcgaacaacatcagtggtgaagtgattgatatcgcccttcacaccatcaccattcgcaactgggacaacacgctttcccgtgttcccaccaaaacctttcttactgaaacctataccaactggcaggccatgttctcatccggtgctcgccgaatcatgcgcagtttttacattgatcagacgtcgataggttttgtggaccacgccatgctggagcccatgacgcagattcgcggcatcagtgagcaactctccaaacttatggatggtcgggaactgaatgctgtaggtgaccgctggtttgttgaaaacggtatgactaacctgatgatcttccgtcactatcttacagcctggctggctcagcgagatgacatcaaaaaagacatgtatatcgtggtgaggtcgatgaagccttcttctgaggggctgcccattgaaatctattgcttcacgtcatcaattctgtgggtcgattatgaaaatacccaatcgacaatcttcgaatatatctatgccatcgctaacgtcttttcattgcgcatctaccagcgcccgtcaggaagcgacctgagttttctggcacaggagcgtcagcaaccggcaacccataatgaagcccagacctgagaagcctttgccctgcctgctctttttcagacgtgagcagggctaaacaaattcggtccgccaggctgtccagccccgcctggcgcttatcgttggtgtatcggactttcctgaaaaattgcgaataaatacaacattaattataaaaatcatttatttattaataaaatgcaaatgttgattacttcacaaaaacaacaaatatgacagcctttcattaaattgaaacaattctgtcatgaaaaaaacgtattctgtttgctcctgaaatcgagggtacagatatgatcatcaaagctaaaaacctgaaggatgcagaaaacttactgcactcgggcatcaataaggtggagctggcatacgacatcggttgtgacgatttctttcgtctggcaagtcagtggtgcgaacgcggtgcgcgcatcagtaaaagccaacagcattttgtcgtttcagtaaaaaacttccccatcccgcccaacgattgattataacaagctaccaacctcacaccgcctccctgttgttacagccaggcaccgtgtgatttcaagcgccaaccagaacttttctaagccgctcatcactgagcggctttctcgtttctcagtgcccctgtctgacgctcgccgccgatgatcaacgcgctcagcacggtgtgactgaccgagcctgagacgatctcagcaaaaattataaacccgtatcggtaagcttgacggcatccaggctggcgtggtcgcgttcgttacccgttaactcgtagaggacgccatcacgcatctccagcaggcgatcggcgtggataaagtagtggtcatcatggctgatggcaaaaacggtttttcctgcagcctgcaacgcgggcaataactcacgatagaaaacccgacggaaatgcgggtcctgatcggcggcccattcatccagcagcaggacgtcgcgttgctcagcgacggccagcagcagcgccagccttttactctgccctttcgacaactgcaaatttagtattttattcccttcaattttcagcttgtcctgcattttgagcttttcgagccattgctgaacccggccaggcgaagcgggatcgcctttgctgtctatcagacggtcaaacaaatgcacatcggtgaagaccgctgagaagtgtttccgccagctatcaaggtcgctgacatcaaccggtttgccgtctattagcaggctgccggactgaggccgatagagtcctgtgagtaacatggccagcgtcgatttcccacttccgttaccgccaattaaaaacaccagctcgccacgatgaagcgttaaattaatcggcccgacctggaaacccttctccccgtagtgaaaggtgatatcacgcagctcaagggtttgccacacggtgtcgccagaaaaggcaggaaagtccggttcatacggggcgaggtcaaagctgttgagtttgcgaaaggcgacctgagcactgagtagcgtcggaagtgccccaaccgctgacagcagtggcgtacgcagaaacagcagcgtcagggaaaaggtggctgccactgccgtattggcccatcccagactgttggccatgaaaaataccatgccaatcgcgccaagcatcatgatgtttgaccagttaacggcactgagatgaaaggtatcggcacgcacgatatggtgccggtaatcactggcatcctgctgatataccttgtcgtagatcagtctggcgcgctcacggttaagctggagctctttgcgtccctctatgacggtctggtaatcgcgatacaggttgtcttcaacatcccgcaattttgccatgtgctgatagacgcgcgacaccagcatccagccgcctgctatcgtcacgaccaaccagccgctggtcaccagtaacatctttggggacagccaggcaagatagagtgccgatcccagtgtgataatgattccctgaattaactcgggcaaacggacaaaagcaagggtgatggcccgtacatcgctggttaatcccgccagcagttgtgcgctaccaatctgttcgatgcgctccacgcgcgtgtccaggatgcgcttgataaattcaccacgcatacgccagacaaactgatggcccagccaggtcagtgccaactgcgaggccagcgttaccgccatcaacataaccacctggaacaggaacgcgggcaggaccgtcagggaggtattaatcgcgacaatcatctcgctgttaataaacgcgatcatgccaatacctaaggcggcactcagtagcgtgagcagaattacgccaataaaaggccagcgatactggcgaaaaaccacatttaacagtgccataaaaccttaccagacatgaaaatcagccagcagtgtaaagtgatggcaaatgatagcaatcgttattcgcaccttgcgcgacgggttaaaacgcccgtcggaaagtgaggttatagcgaaaggcgccggtgagcggatggataccggctttaagcggtaagataccgtgatagcgcaggcgcgaaggcccgccccagaccaccacatcgccatgttccagcaaaacccgctgtgcatggtcacttcgctcaaagccaccgaactggaaaaccgcgggtaagcccagggaaacggagacaatcggctggcgcaaatctttctcatccttgtcctggtgcagcgtgagcttagcgcctggctcatagcggttaagcaggcaggcatccggattgaatcccggaaagccggcttcttcagcggattgtcgggccagcaaacgaaacgcgtccggcatggctggccactgacgctgactgctgctgtcctgctcgctatagcggtagccgcgcgcgtccgtagaccagccgaaatcgccgcagttggtcatcgcaaccgacatgcgatgaccacctggtgtgatgcggtgttcaaacggattttgcacggcaatcgccatcatcgcctggtacagtgcttccgcctcatcgcgggcgcggcggcgtaaaattaccgcgccctcagccagcggttcttgccagggtgaggcgtcactaaacagatccagcatagatgttctctctgtcagtcagatggaataataaaagcggaaaactggggcgacatccagctgacaaagttgtctccttgcttgctgattaagtacaccgccagtttctctttgattgccagcgctttggccttttcagtgcccaataccattaatcctgtatcccaaccatcggcttccagcgcggtggtggcaatcacggtcgccgacaccagcttatggtcgattggccgccctgtagcgggatcgataatgtgtgaaagccgtttgccatccagttcataatagttgcgatagctgcctgaggtactgataccgtgcccctgcagatcgacccgcgcctgaacggcattttcccggtcggtcggtttctgaatcgccacccgccacggctggttctgcgcattcattccacgcgacaaaacagcgccgcccaccgagaccagataattattaatgccttcctgctccatcaggcgcgccagatggtccgttgcaaaaccttctcccaccgtggagaggtcaacatataagcctggcagatctttttgcagccactgcccttctcctccctgaatcacccgcaaatgttgcaagccagtcagggctcgggccgcggcgatctgctgatcgtcaggaatatggctgggctgcttatcgggaccaaagccccataaattaaccagcggaccgacggtaatatccatggcccctgcggttttcttgccgattcgcagggcaagcgtcacgatatcagccatgttttcactcactggctgtggcgtcgtggcacggctctgattaaagcgcgacagcacagaggtgggcttccaggttgagagttccgcatcatcggcatcaagccgttgctgaatgcgctgctggagcacggctttacgtccggcatcaacccctgccaggctaactcgccacaccgtccccattgttttcccttccagcaccatggcgtcttgctcttttgacgacgggttatcacaccctgccagcagcaccattgcggccactaacagcagatttatcttaaaggtcatcaatattcatccgtaacaggtaatttatgcatatttcaaagcacaaacactaagtaaagtaacttaaatatggttgataaaacttatgcgttctaccagactagctcgttccgctcgatcttgagggcgtcagaaaaaggagtaacagatgattttattaatccttgccgctgcgttgggcctgttcgtgttaggaagttataaaacgtggcagcagcgtcgaaaccgcaatgtggcgacagcctatctgcgccgccgttgatcgcctctgcaccatttaaggtcatccgcccctttatccgcgcgctattgtagcaagatcccctgtttttccgtggctatgagagcggtcggactggcacgattcctgcaccagtcatatcgtctgatttgctgagaggtgtaggatggagaagacagagactgcgatgactacgatgcaaaactggttaagttttgctgcgttcaccttgtcgggtgtggcattcgagggggcgagatatggcaacgttatcgtgccgcaggatgaaaccgggccagaacagataacgaatgaataaaaccagggagcgcatttgcgctccctgtgacttttagaactggtaaaccagccctacgcccaccacgtcgtcggtattaattcccgccgctttggtgaagtcgttgtcgtccagtaagttgattttgtaatcaacataggtcgacatgtttttgttgaagtagtaagtcgcaccgacgtcgacgtatttcttcagattctgcttgccccagttctgcacatcggtaccgcgtgagttcacgtaggccagagaaggacgcagaccaaaatcaaactggtactgagccactaattcccagttatccgctttatccgcataaccgtaagccgtattcggctggttacggctggtgctgtcaccgaagctggtcgcgttatacgaccgggtatacatcgcagccagataaatattattggcatcatatttcagaccgccggtataagcttccgctttatcaccgcgtcccagaatacccgcagcattaccattctggttgctggtacgatcggactggaaggttgcggcaccaataccgaaaccggaacccagatcataggtggtgctcaggccccagccgtcgccgttttcacccagcacatcacgaccaccgctcgcttccgttgggttgtcatttttgccctgatactggacggcaaagttccagccatcgaccagaccgaagaaaccgttgttacgataggtcgccatgccgttgccgcgctggaacataaagttgtccgcgccataagtatcaccaccaaactctggcagaacgtcggtccatgcgccgatgtcataagccacgccgtagttgcgaccatagtcaaatgaacctgcatcgccaaacttaagccctgcaaagccaacgcgggtatagctgtcagccgtgccttgtgcctcagaattgttgagtgcggcctggtattcccactggccatagccactcagttgatcggtgacctgggtttcacccttgaagccaaaacggacataggactggtcgccattggcgctgtcgttatccgaaaaatagtgcaaaccgtctactttgccgaacaaatctaatttattgccgtctttattgtatatttcagccgcatttgccgatcccgctgctgccagtaatgcagggatcgccagggagagaatgtgacgcttcattttattaccctctgttatgtgccttttatatttgccactgcaaaccgatggtaatatcggtcggcaaaccattgttgtttcatagcgagtaataatccatcgtaaaaatgctactaaatttccgaaactgtttcataatctgtaaaatttatttctacatgtaaataacacggaacttattagccgcacagagtgataaaaaataaagcacaaaatgataatccaatcgaaaataatagttatcaggatgattttaatgggaatattcctaagcactcaatggtaaaacttattgcgccccagccaatatacttactcccgctatcatcatttatttcttatcttcattcaccccgaatgatttttttttacccttatatatcgccgggcttattgcccggcttttttttgcctgatcgcctctgctctggtttcatacgcgctaaatagccttgattattgccgtttttatcaccaaatttatttgttgatttaagaaaatatagtgcgtcagcaggtaaagcttatcaggtaattagtcactccatgaaactataacaggccgcccgattcggactggcgatattagcgctcgcgcatcgattctttgactttattcaatggcttaagcaaatagtccattacggatttttgtcccgtcttaatctcaacgttcgccaccataccaggaacaatcgggaagcgccgtcccgcccgattcgtcagctccgctttttgcgtacgcacataaacccggtaatagaactggtcgcgcttgacctcatcctgcaaggtgtcaggagaaacggtttccaccacgcctgctaagtcaccgtaaatcgacgagtcataggcggtgactttgaccaccgcggccaggccgggccggatataggcgatatcacgaggattaatgcgggtttcaatcaacaattgatcttccagaggaacgatctccattatctttccgcccggctcaagtaccccgccgactgtcgtaacctgaatatccttcacaatcccacgcaccggtgaatagagcgtcgcgcgcgtcagctgatcttctttgcctgcggcgacctgaagctgggcgtccagttcagcattgttttttacctgctcttcatgagcacggaccagatagtcgttacgcgcctcatcgatcttaccgcgcagatcgcttacctggcggcgcaggcggatcacttctacctgccctgctgcccccttagccaccagcggttcagttaaacgcagctcatcctgtaccagccgtaaagactgttgcagattactgatggtttcggtcagattacggcggcgcgactcatacagttgcctctcgcgcgccaccagttgcggctctttctgcgtctctgcactgaaggtaagcggaatccccgacagttcagcgttgagccgttctgatgacgcacgcagcgtgcgcactctggcttgtacttcgccaaagtttgactgaaaacgggtgggatcaagcgtggccagtatctggcccttttcgacgatatccccctcatgcacattgagctgcttaacgatgccgccgtccaggctgtcaatcacctgtgcgcgggtggatggcgtgacctttccggtgcctaccgtgacctcatcaagaatcgccatgtgcgcccatacaagaaaaatggccagcgccgccgtacataaccagatgattgccgacgtacgccgttcatgtttggccagatctttgtccatcaccacgctcatgccgcacctccctgactggcatccgcaacgttgtgggtcgcgcgccgtaaaatctgatcttttgcgccgtccgcgatgatgcggccgttttccattacgacaatacgatcgaccatcttcaacagggcgggacggtgcgtcaccagaatcagcgtgcgtccactgatccagccctgcatctggcggataacatgctcctcaagctgctcatccatggaggcggtcggctcatccagcagcacgacctgcggctggcgcagaatcagtcggctgagcataatcatttgacgctgtccgcctgacagcccgcgcccgccctcattgataatgcgatccagactggccgcatcctgctggaccagcgacagtgccccactgatgcgtaatgcctgtagcatgtcctgctcgctggcgtggggattgccgagcagcaaattctgcctcagcgtgccaaaaaacagacgggaatcgtgggacagccagccgagctgtcggcgtaggtcggtcggatcgatatgggccatatccacgccgtctaccagcacttttccctgactggcctgcgcctggcccgccagaatcttcagtaaggtggatttccccgcaccgaccttccccaaaatggcgattttttcacccggcttgacgttcagctgctgcacattaagcacgttcttttcgttttcttcgtcgtaggtatagtgcacgttgcgcagttcataatgcccggtcagcgtcgggcagtgcgccatggtggcggaatcaggtttatcgagtggttttttcagcagctcatccagccctttcatggcggttttggcgtgctgccagcgtgaaaagaccatggttaactgcatcagcggcgcgatagtgcgcgaagaaagcatgctacaggcgaccagcgttccggtggtgatttgtgagtccagcaccaggtaaaccccaaacaccagcatgcccgcataggtcagttgttgcacggtcgctgcccagccggtcagtctggctccccacaggcgttgctgattaccgatcgcggcgctgacctcatgtgtctgctcccactggcgctgaaaatagggttcggcctgcagcgctttgatgtcttcaatgccttcgattgtttcaaccagcacggcgtttcgtagcgcgccttcgcgcaatccggctttcgccagccgtgccatcgggaactggactaacatgcccggaataatgattaacggaatagcggccaatggaatcagtaccagccagccgccaataaacgacatgataaacaggaacagaatgacaaaaggcaagtctgcagccgcgccgacggtggttgaggtcagtaactcacgcacctgatcgatttcgcgcagctgagagataaaggacccggtggatttgggccgtgactcattgcggatattcattgcccgggcaaacagcatggcggaaacttttaaatcgatgcgtttgcccatcaggtcagacacctgcgtgcgcatcaggcgaatcagatattcaatggcggcggcaatcagtacgccgacaaacagcacccacaaggtggcctcggactgggcgggaatcaccctgtcgtagacctgcattgaaaagagaataccggccagcgccagcacgttactgattaccgacgccacggagatttccgcgatgcgacgtcccatgccgcgaaagtttttccagaaccagtgcggttcatagggctggacgaactcatcgatacgggcatctctgccgcgtgcggctacgccaatcacgccgatatcaccctgcgctctggagagcagaccggccagctcgccttcgcgaatcacgtcaccgccttcgctcagccagtagcgtgcgccgccgtcagcatcgatctcttccagcacggcaacgctgttattttccatgaccagcacaacgggcgtgatctcctgccgccagcgtagtttgttctgtggcaccatcgtgagatgaagtccaaggagaccacacaggcgctccagctgctgtgccaccggcaggtgttcaaaccagcgcatttgctggcgcaacgtttttccatctgcaggtttgccgaaacgggccgccacgcgcaacatcgcagcaatccagttatcggtcgtcgggttttgtgcactcatcgtaaacgccttttaaaacgggttcgctattgcaacgaaggaagaagatcgccactgcttttttgacggtcgatacccatgatgtcgagcaggttatcaaccgcagcggcgtagcggacggtggcatcccagccgtcataaagcgcagttatccgcgcgctgtcggcctgaaaaacatcctgctcgacgctgagcagatcattcaggctgcgtttactcagccggtattcatcggcataaacgttgcgtgtatgttcagcgctggctaactgcgcctcacccgccagttgacgctgctgagcgccaatcatgtcggcgtaagatgtggaggcattttgattaatcgtaagtttggcttgctgtaccgcagcctgcgcggcgagacgatcgccttctgctgactgtgttttggcattgaccagaccgccctgatagagcggcgcttcgacctgaagctggacttcatcatcccagtatgagcgagtgtcattttcataacgtgtccgaccggcctggaccttgatgctgggccagtgccccgattgagcctgacgtacccgctccctggcggcttcctgtttgtattgtgcactgcgcaccgcagcactgctttcataggcaattttgtccagggtaatttgctgttgtagcagtgcctggggcagttcaggcagcgtggcaggcaccacgccggtcaggacggtaagctgtgcgttagcagagcgcagttgcgccagatactgctcacgcgtggcatgcatggcggcgatccgtgtttcggcctgcaggacgtcagactgagagtttaacccggcatccgcgcgcattttggcgatgtcacgcacgtgctcaagcgaggcgatattggtctgcgcggtagcggccagcgcctggtagcgtttgacctccagatacgactgcaaggcctctttagcgacctgcgtcatcgcgtcgaataaactaaactggtaggcatccgacaaggcatgctgttcgtctattgcgccattggtgcggccaaagtcatacagcagttggctcagcacgatcccgccggaaccattattattcaggctgccagaggagtcggtttgatgagagcgccccgccgccccctgaagcgatagctgaggataccaggcgctctgcgcagcactgagatcgccttcaccgatatgaatctgcgctgccgcctccgaaatcttcgggttacgtgagaaggcgcgtaatatggcatctcgcagcgttaaaatggcgacctgctcttcactcggtgccgctcgccagttaaattccgctttggggagcggtgcggcaaacgccgcgggtaataccacgccattcagggcgtaaaaaaacagggctaaacgcgctttgttcattattcataccaacaggttttcttatgatcatttgaatgacgtcctggtgatttcagcatacaaaaaagcaaggtcacgatgagcattacgcattttattgttaatttacttaatgcgtttaatagagaccgctaagcacgagttaatattaatagtacatatcccccagcggttcattctaaaaatcaccaattatcaaatatctttactgaaaggcgattttttaatcagttacatcctcctttaccagttaagaaaaaataaacaacaacctgtttgaataagttgcagggcttaccattcttaaaagcggcaatgcaggatgccaaagcgtcaaaagtaaggctgcggccaacccgtcgtatggatacaggtaactgcgcagaggtttccacggcccgcgggtttgcgctatgcggcccactttactcagacaggaagcctttgcccgaaacggcaacgcaaggcctggtgcaggtttataagcaggctggcctccagccagtgcgtccattttgcgcatcgctcacagagcgtggcggcccgcaattttgcagaaaaaagcagcgggtgcttacgcaaccgctgctgtgagtcactgcttaactacgatgtggcaatttagacgacgtgtacctgcagattgtgctggaccagcacatccccaagcgtgttgtcattggtgagtgccgagttatggtagacctcataggactggccattcaccatgcgctctccactgatctcccacgtaccgcccaggctgttaaccagggtgaccaggctgccgtcagcccctttaatcatcagatcatcgctctgtttgtcagtaatattcagtgcctcgttgagatccagtttcactgaattcgtcccgctctgaccgagatcaagcacttcaatattttccactttcagaccaagatcggtcagatccagcgtcagatgttcaccgttcagcaccagcgtatcggtaccggctccgccatcaatatggttaaagtgcagatcgcttaccgtgaccgtatcagcaccactgctaccgttgaccgttgcaccttctgacgtcgtgccatcggccagcgtaatcaccacgcctcctatgctgtagctttcctctgctggcgtttgatctactgcggtttctgccacggcagccgccgcgacagccgtattctcctccgccgcactgaccggcgcggccacatcggcctcggtagtcagggttgaagccacatgcaccgtaggtgttgcctgttcagtggactgcgtgttgtgatgcgtatccagactggacgcagcactgtcgtccaccaccgagaacagcgcaacggattcggtcgccgacgtggtggccaccggcaacacagcacctgccagcaacgtattggttgtggtgtagctgttaccggccacatccgtaatggtgatcttagccagcgtatttaaggacagcagcagtccacctaccgacaacagcgaagggctgaagttagcggagtaacgtcccagcgcatccgtcgtggtattgatcgtcggtccgttgttgccgttcgccagtagcaaggtgacgctgacttttgtaccctgagccgcgttaagcgaacccccttgcacggtgagtccatttaccaacgatgacactacgctcagaacggggtccgcgcccacaaggggctggttgtgcgacagtgccgtaaagctacttgtggtcgtggtgctgttaccgcccacatcggtaacggtgacggcaacagaatggcttccgtctgcaatgcctttcagggtggctgacggcacacttatcgtccaggtaccgttactgcctatcgtggtcgtgaaaatattacccgccacgttaacggaaacctgccccccaaccgcattactgctggtgccgctgatggtttctgcaacattcgcctcagtgatattcagataaccatcaccaccgaagtagctgttgatgcccgccgttggcgtagtccggctggcgacgcccagcgaagccgatgcattgcccgtgttacccacgccgttgatcacgctggccgagacggtatagagcccatctgcaatcgccgcgagactggaagcagcgacaggaatactccagtttccattgctgctgaccgtggtcgtaaaggtctggttgccaatcgtcacctgcaccaccgaaccttcggcgttagtggctgtaccgctgatggtctgggtggttttaacatccgccacgttcaacgcgttatcgccaaacagcgaggtaatcgtcaaggcaggcgcggtgttactgatgacgctcaggctaccgctgcccgtcacggtattgccgttaacatccgtgccggtcaccgcaacggctttaacgccatcgctgatgcccgtcaaatcggtttttggcacgctgatcgtccaactgccgccgctgatgactttcgttgaataggtgatgccgtttagcgttgcactgactgtcgcccccgcagacaggtttgatgtgccgctgatggtctggttagaagccagatcggcggcgctcagaatgccgtcaccaaacacggtattgaccgtcagagaaggctgagtcagggccagctgcacgcctgcgctggtggacgtggtattacccacagcatcggtgaccgaggcacccaccgtaaaattaccgctgagcagggttgacagaatggccggtgaaaccgttgccgagaaggtgccatcactgttgaccaccgcggttaacgtggtgctgccaatcgccagccttacagtaccgccggcggctacaccggttgcggtgccgctaaccgtctgggttatcagcgactcggcaatattcagtacgccatccccaaacagtgggttgagtgtcactttaggtaaattgttgatacctacagtggcagaagctgaactattggcggtattaccggcgctgtccgtgacgctgacgccgaccgtcaaggtaccgtccgtcaggccctggagcagccttggcgtcagcgccaccgaatagttaccactggcgtcggttgccgtgacgatttgctgaccacccacggtcaccacgacacgagaacctgcttctgcaccgctcacgacgccaccaatggtctgccccagcagcgcatcggcggcattcagcaagccgtcaccaaacagcgggctgatggtaagcgtaggcgcaagagtatccacacgaataccggcactggtggaggcggtatttcctgctggatcggtgaccgttgcgctaacggtgagattaccctgtgccagggtgccgagaatatccggcgttacggtggcggtgaaagccccgttgctgcccactgttgccgttacctggctgttacccacgttcagcgtgaccagtgaacctgcagcaacgttgttcaccacgccgctaatggtctggctggtggcaatatcgaccaggttaagcacaccatcgccgaacagtgacgtcaggttgatggttggggtttgcgtaaagataccgatagtcgcgctgttgctggcgacattgccaacggcatcggtaacggtaacgcccagggtcagattaccatcaagtaacgacgtcagatcgctggacggcagcgtcacgctccagttaccaccggcctgaaccgtggtgttataagtgtgagttcccaggataacggtcacgcgtgaacctaccgccgcgttctcaatcaccccgccaatctgttgattgaccgccgcttcggcaatgttcagcaaattatcaccgccaaacaggccggtcaggttacccactacaggcacggcatcgacaatcgcggtgaccgtttcgccaacgctgcgggtgttgcctgccgcgtcggttagcgtcacgttcacagccagttcaccatcgctcagcaaacccaggacagatggcggcacgacaatcgcccatttaccgtcctgaccgacagtgctggtcagcgtggtgccgccaagcgtaaccgcgaccgttgcgcctacacccgccgacgttgccgtaccggtaatggtctgagcaaccgtcgtgtcgatcgcgctcagcgtgccgtcaccaaacacggaatcaaccaccagcgttaaggcggcgttaaccaccttgttcacggtgatagtggcatccgtttgattacccgcctgatcgttgacgcgaacgccaaacaccagcgcaccatcattgaggctggacagcacctccggtgttaaatcaatgctccagacgccgttagcaccaatgacacctgtcgcgatgggggcaccatctccgacatacagagaaatggtttgtccctcttctgcccccgtggcacggcccgttaacacctgcccgacggcaagatcggcggcattaaccaggttatcgccgaggaagctatcaatttcaatcaatggtgcgctcgtatcaacgtcaatattacggctggcggtgcctgtgttaccggcggcatcggtcaactgcgcagtaatggtcgtttcaccgttggccagtgcctgcatatcgctggctggcacgctggtggaccaggttccgtcgctctggacgatgcctgtataggttttaccgttcagcgtcacggtcaccgtgcggcccgtttcgctggtgtctgctgtaccactgatcgtctgacgcgttgaactctcactggcgttaaccacatcatcgcctgcgaagctgttaatcgtcagtgtgggtgccgtcagatcgatctgaacggtaccgctggtggacacggtatccgttccgtcggtggcgttgacggtgatggtgacaggtccgtcagtgcttccgaaatcactgaccggcagcgttgccgtggtccagttaccgttagcgtcgatcgtggtgctgtactccaccccgttgatcacgacggtgacgacgccgctatcccccaggttttgcgatgttccgctgaccacaacgccgcccgcctgctgatcgaccgtactaatgatattgtcacccgacacagtgcccagcgtgacgagcgggcctggtggcggtgtcagatcaacctgtagcgtcagatcctgggtgaccggattgcctgccagatcgctaacggcaagcgttaaggtggtggtcggttgtgtaaaggtgctcatttgctctggcgtcagcgtcaggctccaggcaccattcgcgcccacgaccgccgtacccagcacggtgccgttataggaaacggttaactgtgtgccggtttccgcgccctcagcgaccccggtcaatacctgagactgaatactctcggcgtaatcgagcgcattatcacccgcaaacgtcaccccggtgatcgaaggtggcgtggtatcgatcaccagcgattcgctgagcgtcgtactgtttccggcgggatcggtgacggtgatggaaaccggataggtgccgtcggtaaaggcttccagctgcgcgttactcaacggcaatgtccagctaccgtccgccgcgatctgggcattgaacgtggtggtgccaatggtcaccaccacctgttgcccgtcaccagcctcaccagtactgcccgtcagagagatgccactcgccacgtcagcggcgttgacatagccgtcacgtggcagcggatcgacgctcggtgccggcggggtcagatcggcgttaaaggtaaactgcgcggtggcggggttgcccgtggcatccaccacattcacggtgacgctgtggggacccgtgccaatcgcatttaatgcattaggtggaatcgtgacgctccagttgccattcgcatcgacagtcccaggatagcgtgttccgttgagatccacgctgatgcttactgcctggtttgcgccggtgctgccggtcgtaccggtcagcgttacgcctgcggcggcctcgctgatgttcagcacattgtcgccaccaaactgcaggtcggcaaaggttggcacaggaacggtgacggcggtgaccacattaagcgtggtgctgtcggtattgcccgcaatatccgtggcggtgacggtaatcacatggctgccgttagggatctgcgccatttgatcgggcgtcagcaccagtgaccagcttccgtcaggctgaacggtggcactgagcggctgatcattattaaagccactaaggatgaccgttaccgtctgaccatccccgctaatgcctgtcgaaccggtaagtgtctgattttgtgctgcttcactggcattcaatgcgccgtcaccgaacggcagattgaggctgacatctggcagcgtttgtatggcaaccacgatgttgctgttgatggatgccgtattgccgttggtgtctgtcacggtcagcgtgaccggccagttaccgtctggcagtgactgcaataaggttgaaggcagacccagtgaccaggtcccatcaccattgatggtcgcggcataggctgtgccgttaaccgttaccgtaacggatgctgcattatcgatattcaggttgccgcttaacgtgccatcggtttgcgcttcgacagcgttgatacggccatcaccaaatggcgtattgagcgtcggcagcgcaatgggggcagtggccgtcgtgaagtcttgcgtggcagtcgccgaagtatttccggcacggtcagtggtggtcacgctgatcgtgtgcgttccatccgccagcccggctatcacgtctggcggcaggctggcgctccagttgccgttcgcatcaatggtcacgttaagcggtgtgccatctacgctgacgctgacggtttgtccgtcgccaaacggcgccgtgccggtaattaattgcaccgaggccgcttcgctggtgttaatgacgttatcgccaaacaacgttggggttatcgttggatcggccggtgtcgtcaccaggatctctacacctgcgctgacttcagccggattccctgctgcatcgttggcggtgacaaccacctgcgttgcgccatctggtaatgcgtccagcgcgcccggtgccagcgttaaggtccaggcaccgttggcgccgactgccgtattaaacgtctgatcgccgatcgtcaccgtgatcggggtgccctctggcagattggtggcattgccgctgagtgtaagctcgcccgccgcatcagcctgactgacaagcccatcaccaaacggcgtatccagcgtcagctcaggcaatgtgcggaaggccacatccagcgtggtgctgttattggtcgtgatattgccgttgacgtccgtggcggtaatggtgaacgtctggcgtccatcattaagttgctgcaaatccgcagccgggatcgccagtgaccaggcgccgttaccgtctgcaaaggtggtataagtgatctgattcagcacgacggtaatctgcgcgcccggatcgctgttgccattgacggttaaatcctgcaacgactccgcctggttaagtgacgcgcctgcgctcaggttgatatcgctcaataccggcagggtcgtatcaaccgccacattgtgattggtcagggccgtattgcctgccacatcatccgccgtgacgacaaaggtttgttgtgaaccagaaggcaggccactcagggctgaagacggcactgacaccgtccagttgccgctggcatccaccgaaccggtatagccgacgccgttcagcgtgacggtcactaccgttccttgcgccagatgcgtactgccgccgctcacgtcaaggtccgaacccgcttcgattgcgttaataatgtcatcattggcgaccacgtccacactcagcgtcggctgggcagcgtcactggcaatgacattcagggttacgttgctgctggtcgggttgcctgcagcgtcggtggcgctgacgacgacgctcagctgtccgtcaggtaatgcactcacatccgcctgcgggacggtaattgtccagcggccatcattctgcacttcacccgtataattctgaccattcagcgagaccgttaccacctgacccgccgtcagattagtactgccgccgctgatggttaactctgcagccgcttcaacccggttaacataattatcatcgctgatggcatcaacggtcagtacaggcaatgccgcgctgtctgcaacgcgcgtcagcgtctgggttaacgccgtctggttgcctgcggcatccgtcagcgttatgtccagttgataggtgccatccggcaagccctgcatcacgctggctggaatctcaagacgccaggtgccgtccgacaaaaccagcgtttgataggtttcaccctgcagtgtcaccgtcaccgtttgccctgcatcggccagcgatgcggtgccggtaatcggaatattttgctggatttccagcgcgttaatctggttatcaccggtaacaggattaaggctgagttcaggtggtgtgaagtcgaccgtgaccgacgtgctcaggctgccgctattgctgcccgtggcatcactgacgttgacgacgaccgtattcgcgccttcaggcagtgcctgcaagactgcgctgctaagcgtgaccgtccagttaccctgtgcatccaccgttgccgcatagtcattaccgcccagcgtgatggtcacaatctggcccgcaccggtgagaccggtcgtgcccgtgagcgtttgttcgctggccgcctcgacctgactgatataatcatcggcaaatggcgtattaatgcttatcgctaaggtccccgtcgcgaccgtaatatcacgggtttctgtaaaactgttgcccgccgcatcgctgacggtcaccgccagggtatagcttcccgccgcaacatcggcaagggcacccgcgggcagagtaaagctccagttgccgttcgcatcgaccgtggtattccacacctggttattgagggtgatggtcaccacctggccttcaccggcgtcactgctgccgctgagcacgatgggcgcggtgctttctgaagcgtcaacgatattatccccggcgaccgggtccagcgtcaggtttggtggcgtgagatcaacgttaacattaccgtctacctcacggctgttacccgcggcgtcagtgaccgtaaccctgtagttggcgctgccttcattcagtgtagttaaggcatcggcaggaatactcacacgccagttaccattgccgtctaccgtaccgttataaacattgccgcccagtgaaacactgacggtctgacccacaccgcttacgcccgtggttccgctcagctgttgtgtgctggaaatatcagcggcattgagggtgccgtcaccgaatgccgtaatcacgacaggattaggcaggttgttgatcgcaacgtttaaggtgcctgaactgctcagggcggcacccgtcgtgtccgtcgctgtcaccgtcaacgtggcaggaccatccgccaggctcgccagcgcagcagccgggatgatcacgctccatgtaccgccagcggagaccacggcgttataagtgacattgttaaactgcagcgtgacggtgctgtctggtgccacattcacggtggttcccgtgatgattaacggctcaccagcttcgctggcattcaggaagttatcaccgcttatgatatccagcgccacgccagatgcattgctgttaaccgtgagagcaagatccgctgtcgtggtatttcctgctgcatcgctgacggcaaccgtgtaggtggcactgccatccgccagggacgacagaacggtagctggcaccgtcagccgccatgttccatctgcctgaacggtaccgctaaacacatcgctacccacggtcagtgtcaccacctgcccggcctcgacgttcgtcgtggtacccgacagttcctgattaacctgtcgttccgccccatcaatcagattgtcaccggcaaaagcattcagcgtgagtgtgggtaatgaagccgcatctgccttgaccgtcaggttgctggtatcggtcgtgatattgcccgccggatcggtggcggtaatggttaaaggataactgccgttggtcagcccattgaacgcagcaggcggtacttccagcgtccagctaccgtctggattggcggtggtgctgaccgttgtgccgttaatattcgccacgataacggcattgccttcgctgttaccgctcaagaccagtggttgctgaagttcagcagcattgagaacgccatcaccagacggcgtagccaccgtcagcgctggcggtaaggtatccactgtgacattgccggacgcattgctggtgttaccggcaatgtcggtaacggtcactgtataaggcaccgttccctggggtaaggcggtgagcacgccagaaggaatattgacctgccagttaccggcgttatcgacgataccggtgtagttgacgccattaagactgacgacaacgcgctgcccttctccggttacaccactgttgccggtgataaaaccgcccgctgccgcttcactggcattcagtacgccatcaacaaaggcatcacccggtgtggcaaccggcacgtccgtcgccacgacattaatatctgaggtactggtcgccagcgtattgccgtcagcgtcagtgatggtggtcgtcaccggaagtgcaccgttaggtaatcccacgaggctgccggccggcagcgtaaccgtccagttgccatccgcacccaccgtaccggtgtagttcgtgccgttaacgttgacgttaacaatgctgcccgccggaatattgctggtgctgccgctaagcaccacctcgcttgccacgtcatcggcattgagatagttgttgttgcctgcaggagccagagcaacgctgcttcccgttgcgtcaaccacaaagttaagctcagtgctggtcgtgttacctgcggcattcaccacggtgacggtcagggcctgattaccctcattcagggttgccagtgcggctggcggtatactgatgctccagtttccgcttgcctcaacggtgccgctgtaagtgacaccgttaatggttacggtgacttgctggccggcctctacgttagtcgatgtgccggtaagggtttgagggagtttttgctctgacccatccagcacaccgttgccagcaaaagtcccgctgtcaacgctcagcgtgggttgcacttctggtgctgtggcgacattcagctcgctggtataggtcgtctgactgccattcgcgttggtgatggtcaccgtaaaaggattattacctgaaggcaacgcagccagatcggactgatcgatgcgtaacgaccagcgcccattagtcgtgacaaatgtgcgatagaaccggccattgagtgacatggtgacctgatcgccattctgaccggtaccgctcaataccagcggttgcgtcaaatcgcttacgctgagcgtattatcgccgcccacggggtccacgcccaatgagggtggcagcgtatcaatggttacggtgctggtctgggtaaccacgtttccggcctgatcgattgcgctaacgatcagtgaattgttgccctggggcagcacagcaagatcgcctgcgggtagcgtcacgctccagctgccgtcgctgttaaccggaacatcataggttttgccacccaactgaacctgcacctgttgcccggcaccggtaatcccggtactgccgctcagcacctgatcgctggcggtgtccaggttgttaatcaccccatcgctcaccgatccggcatccagggtaatggctggcagggtcgtagcctgcaacgtaacgtctgcagtatcggataacagattaccgttggcgtctaccgtactgacggtgatctgcttcagcccatcgcttaccccgttaaacgcggttgacggaatggtgacggaccagaggccattcgcatctaccgttccgttgtaattaacgccattaaaattgactgcaacctgctgccctggcgaaccacccgcgatcgacccttttacggttaatccttgtcctgcttcaagggcattgaggaagccatcaccgcccagtggctgcgatatggtcaatgtaccaggcgtacccgttgccggttcgacggtaatggattcattattggttgcactggcgcctgcactattgctgacgctgacgtcaatggtggtggaaccggctgccagcgccccgagcgctgcggatggcaccgtcacgctccagttgccgtctggtccgacggtggtggtgtacgtctgcccgcccagcgttacggtgacggtccgccccgcctcgacgttggtggtggtgcccgataccagctgatcgctggccttttcggcgttatccagtacgttgtcaccggcgaagttgtccaccgtgatggtcggtgggcccggtggcgtaaccggggcatccaccgtaatggtttcctgcgtgcttgcgatagtgcctgccgcattgctgacagtgacgttaagcgtggtggtgcccgccgccagcgcggtcagcgccgccgacggcaccgtcacgctccagctgccgtctggcccgacggtggtggtgtacgtctgcccgcccagcgttacggtgacggtctggcccgcctcgacgttggtggtggtgcccgacaccggctgatcgctggccttctcggtattatcaagaacgttgtcaccggcaaacggatcaacggtcagcgtcggtgcgcccggcgtggtaaccggagcatccaccgtcacaacctgctctgcgctggcggtagtgcccgccgcattgctgacggtgacgttaagcgtggtggtgcccgccgccagcgcggtcagcgccgccgacggcaccgtcacgctccagctgccgtctggcccgacggtggtggtgtaggtctgcccgcccagcgttacggtaacggtctgccccgcctcgacgttggtggtggtgcccgacaccggctgatcgctggccttctcggtattgttcagtacgttgtcaccggcaaacggattaacgctaagggaaggtgtattgggtgtgcctggcgttcccggtgtacctggagttcctggcgtagccgcgttgtcttctccgccaccaccaccaccgccacggcgggtgccaagtgcagcgcccgcaagacccagcaagccgacaccactcgccgtcatcaggccggtggaaatattgctgttatctgccagcagaagcggctccacgctatccagcgactcatagctgggcgtcacggttgtcgtggctaaatcggttgcaccagccgtggtgggaaagagcgcatgatcgggcgggttcacgccatcgtcaaagacaagttcactgtgatcgcctgcggcatcatccaggaagaattttttgtagcgaacagaacttccgtcacgcatctggacgataagatcgtcgccctgacgctggtattgtacgacggcctcacgtgtcccgttgatgcgtacaacgctgggttcactgagcgtaatcgtttgtgttatgccgccgttgacctgagacgtgagcgtaccatttgcacgagaaatgatatcgacgcgactttgagtgagttctgccatcttgaccttgctccaccagaatatctaattatctgaaatgtaaaaccataaaaataagttatgatttcacattgacgttttttcatgctgtgtatcagaaaacgtttcagtctggtgtgggcagtgcgacaaaaagacacagaaaaccgaccatgtcctaagcatttactttattttttaaaattcttgttaaccgatgttcataaacagcaacaccatgcaatcaatagttaacttatcgcgtttaaaaatcaatcataagatgcagttttatttatgaattaatcaaaataacattagccatatttgtgattaatcagtagagcacagggtgggaaagatgatctcccatgtcaaaacattgctaaatgtttccagtaaagagcaaaagtgacggaaaagactctcttttttgggttcttggctttctgccagatactcaaattcagctaagctattcaccttgcgaatttgtgatgaagatcgtcctggaaagggagctgtttggggtttattcgcgggctgtgccaggaaagttctggaaaacaaatccatcaggataaaagtcggtacactggcttttctcatgacctgttacagcaggccgcttaacctgttaaacctgtgttctcacagcgttttacaggaaattgatgctacacttttctgctttgctactgatgaattagagccatgacagcactggatgccgcaaaatcaagccaatctgacagccgcctgagcgggggcacccgtactatttttttgatcaacggattggggatgtctgcctgggctccgttggtgccctatgcacgcgatcggttgcacttagatggcgcctcattgggtgcgcttttgctgtgtctgggaattggctcactccttgccatgccggtgaccggcaccttagtggcgcgctttggctgccgcagggtgatggtctgttcgacgttagtggtgttattcatgatgccgctgctcgccacagtgcaaacacatctgttaatggcagcaacattgatgctgtttggtgccggactgggcatgctggacgtcgccatgaactatcaggcggtagaagtggaaaaagcagccggcagaccgatgatgtcaggcttccatgctttttttagcctgggcggtattctgggtgccggtgcggttagcctgctgttaagcctgacgtttaccccgttaatagccgtgttaatcattatggccgtgatgggggtactgttgctctggcgtctgccaacctatatgaatcagcgcttacatcagcccgatcagtcgtggctggtgattccgcgtggacgcgtcgcctttctgggcatgctgtgttttattctgtttttagcggaaggagccgtgctcgactggggcgcacttctgctgttacaaaacccctcaatgacaacggcgcatgccgggctgggctatgccctgttttccgtcgccatgacgattggacgttttagcggcgataaaatcattcaccgcgttggccgctacccggtcatgttgatgggcgcgctggcggcggcttcaggcatgaccttagccgtgctcctgccctggccagaagcctcactgctggctttcttactggtgggttttggtttatcgaacaccgtgcccatgttatttaattcggcaggtaatcagcatgatatgccggcgaacctggcgatttctgccatgacaacgttgggatatgcaggtattctttctggtccggcgttgatcgggttcatttctcaatggattagccttagcggtgcatttttgcttattgcactgttattgttagctgtggctgtcagtgcgcgcaacgttgcgcgataattcaggtatctgagcgctatgttgtataagtttccgctgacatccggtaatgtcactcgcttttttatcgtatttaatctggtgctgttactggcgctgggctttatggtgcaaaattccgtcaatgcctggttgacggataaacgttatgccatggcggatatggcgcgtgatattcaaaaacgcattgatgcctatcgctttgtgacctggcagatctatgaaaacctgtcgaccagcgccgccggttcgacacccgccacgaatttacaagagacgcgcctgcgtccggatgtctactatctggaaaaaacccgacgcaaaaccgaagcgctgattttcggttcgcatgacagcagcacgctggatatgtcgatgcggatgtccagttacctggatacgttatggggtgcagaaacgccgacatggtcaatgtattttttaaatggtcaggacaacagcctgatcatgatttccaccctgcccctgaaagacatgaccacgcgctacaaagagaacgccatcagttctctggttgaggcacggcgtgcagaaatgctgcaacaggctaatgcgctggatgagcgtgaaagcttttcaccgctgcgtcatctcgctttccagaatgaccactattttaccctgcgtacgacgttcaatcagccgggccatctggccaccgtggtggcatttgatttacctgttaatgacttgattccactcaatatgccggtggaaaacttccagctgcgtcaggatgctccgctgaataacagcgccagcagcaaccaggaagatgtcgaaaccacgcaggtttcgttggtcagtcacaatatcgaaatagccgcaacgctcccgagcacatcgttacagctggtctatcaggtgcccttcttacgcctgttgctcgacagcgcgcataatttgatgtggccgttgctgattaacctggtgctgttcttgctgtcacttggcggaatgttgttattacgtcaacagtctctgcgcccgagtgaaaaccagagcgccgagctggattcgctccgtgtgctcaatcaggagattgtcgccagtttaccggttggcttgctggtctatgacttcgccagcaatcgcaccttgttaagcaataaaatcgctgagcatcttttgcctcaccttaatttgcagaagatcatcaatatgtccgatcagcatcagggcgtactgcaagccacgattaacaatgaggtgtatgaaatccgccacgcgcgcagcgtcttatcaccgcatactcagctgtttatgatgcgcgatcaggatcgtgagctactggtgaacaagaagctgcagaaagcgcaacaggtgttagatcgtaaccaccagatgcgtcagcagttgctccatcaccttggtcacgcgttaaaccagccgctggaaaagatcgtttcgcagctggttcacctgagccagcgtgagaacgacgagagcgtgctggatattctggatgagagtcagtcactggcccgcctggttgacgatatcgtgctgctcaatcgccttgaagcgcatgactggtccccggatgcctcggtgtttaacctgcaggaactgctggacgagatcactctggaaagtctgccgctgctgcgtcgcaagggattatcgctcgtggtgaataatcatcaggcgaatgatgaaatgcggtttggcgatcgccgtgccctgcgcaaagtgctgacgacgctgatgcattatgccttgatcacgacgcgctggggcaagataacgctcgaagtgaaaacggcggagcaccatcccgaccgcctttatatcgagctggtggacaccggtgccggactcaccgtggatgaactggcgaatgtcgacttcccgttcctgggcgataccagccaggatcgttatggtcaggcttccgggatggcgtttttcctgtgtaaacagctgtgtaagcagatgggcggcagtctggaaatcgtcgccaaagcggatattggtactcgctataatattcagcttccgcttacgcttgaagaaaagcgcgaagaggatgaagagaaaattctcgaagggattaccgccctggtggagatcgcggttgaagacgttcacaagatcgtctgtcgccatctggagaactggggcgcacgttgcctgacgccagatgaacgcatctcaggccaggatcatgatgtacaaattactgacgaccccagcaaattatgtggctgggctttattgctggcggaagatgaacccggccatcatgctttaaacgatcaacagtatcgcgtcaatttcaatctcagcaatgcactacttgatgcattactggcactgattgagaagcaattgtcccacgatgtgatggaggatgacaccgacgatgacgccagcacgccactgttaagtggtggctatttccagctgtttactgagacagtaccggatgatgtaaagagattgtatactgagtcagcgatatcagattatgcctcgcttgctcagacagctcatcgccttaaaggcgtgtttgctatgctcaatttgacaccgggcaaacagctttgtgaagagttagaacaccacattaaagtgtgtgacgattcaaacattacaaataccaccagtaatattgacgcttatgtcaatcaactgctgcagcaaggtaaccaataagatgaataacttgaatgtaattattgcggatgatcacccaattgttcttttcggtatccgaaaatctctggaacaaattgagtgggttaacgttgtaggcgaatttgaagattcaacggcgctgatcaacaacctgtccaagcttgatgcgaatgttctgatcaccgacctctccatgccaggtgaaaagtatggtgacggtattacgctgattaaatatatcaaacgtcactatcccgacctgtccattattgttcttaccatgaacaataacccggcgattctgagctcggtactggatctggatattgaagggatcgtactgaaacagggtgcgccaaccgatctgccaaaagcgctggcagccctgcagaaaggcaagaaatatacgccagaaagcgtggctaaactgctggagaaaatcagtgcgggcggttatggcgacaaacgtttgtcgccaaaagagagcgaagtattgcgcctctttgctgaaggtttcctggtcacagaaattgccaagaagctgaaccgcagtattaaaaccatcagtagccagaaaaaatcagccatgatgaagttgggtgtggataacgatatcgccctgctcaactacctgtcatcggtgagtgcgacccaaatcgataaagattaagtccgcaggcggtgcgtttacgcaccgcctctcttcccggctatccttcccgcgttttacgtacccgctccgcataaatacccagcgtcgttttcagcacgtctaacgtcactggcttcgacagacagttgtccattccggcatccatacaacgctgtttttcttccgccagcgcattcgccgtcacgcccaccaccgggaatacatgcccaagctgacgcaaccgctgtgtcaggcgatagccatccatattcggcatgttcacatcggtcagcacaatatcaatgctgttacggctgaggacatttaacgcatcaacgccatcctgtgccgttttaacctgataacccagggtgccaagctgctctgacagcaacatacggttgataggatgatcgtcaacgatcagcaccataatgtcgtcgttatgaattttctcttccaccggactggccagcgacaacgcatcgttcacgtcggattcaaccgcaatgcggtaaatgcgcgccagcagggttggcagctcatgcagggtagcggtgctgtgaatccagcgcccggcctggggctcacgcggcatgtccacgtgtgagccgtcaacggtgataactgcgcgaaccggagagctaacgtctaacgaataatccgttaacaccacatcatcactgccgggatcagcctgatattcggcgacctgaataccatgctgctttaacaaccgttcaagatactgcgccaggtattcattacgcatcgccagccagattttcttatcctgtaacccatccagcagcgggattgaaggctgcttaccgttatagatgggaatgcgcacaataaactggcttcccattcctggctcagactcaacctcaatgtcaccgtccatcatattgataagcttttcgcaaatcgctaaacccagcccggtgccctggaaattacgctgtacgccattacccacctggaaaaaaggatcgaacagtcgggttaactcttttgccggaatgccgacgccggtatcccgcgtgcggaacgccagatagccttgtgtgacataggcatgcaggataatgcagcccgtatgggtaaatttaatggcattattcagcaggttagaaatcacctgttgcaggcgcagtggatcgccatcaagcgcctgcggcacatcgtgctcgatatagcagtaaagcgtcagacgtttctttaccaccagggagaggtagttaccgacaatgtgggtaatcacttctcgcggcgagaaaggacgcggttctatcttcagctgctccgactcaattttggagaaatcgagaatgtcgctgatgattttcagcagcaggctggaggagttattcattgcagtgaccagcgacgctatcccgctcggcaactggcgcgtctgcagcagatccaggttgccaatgatgccatacagcggcgtacgaagttcgtggctgaccgtcgcgaggaacatcgatttcgactggctggcctgttcagcagcatgggccatttcctgtagcgattgctccatacggacacgcgcggacacgtccaccagcacacagatggctacgttctcatttcgatagcgggaatgcacgaaactgatttgcaggttggtgttgctgccggtcagcacatcgacaaagttaacctgctgaccaccgataatctcattcaatcgcttacgatcttcttgcgtcagcagcgtgagatagttgtgcgccagctcattactgagaatgttggtgccatcgctggtgcgcagaatacaaatcccgaccggggccgaggctacgattttacggttaaactgctcatgctcttccagccggtgggcattttcttccgctggcagaaacatgcgccgctcaaatagccaggccagcgtaaacagcacaatcgcgctcaggatattaagcaataaggcattaatcatcatcagcttaagctgatcgaccagtacatcggtcgataccgaccacaccacgttaagattcgagggcggcagcggttttttcagcaccagttgacgataaccgtcaagatagccaaaccaggttttgtcatcgggcaattcatttagtgaaaaacctaaaccaccccggcgcgaggtcaggagcggataatagttttcatccgtgatcgtggctgttacgggcaggctaccgggctgaataaactcctcaagctgaatgttttgttccacccccagcaaggcctgaagcttatcggcaacgtatatcggcatcacaacagagaagctacccacgccaggctgcgcgctactgtttacccagtaagcgggattgcgccggtcctcttccgagctgttgcggtagcgttgtaggttttcttgcagcagtttcagactgcgatcgcgactgacgttattgccgatagcaaaatccgccaggcacttactatccccactaatcaggaaaacccggctgagatcataagatgaggcaaagttgcttttccagtaattaatgtagttgccaagtgagtccagtgaggtgcgccaggtggtgctcatggaggcgcagtcgtcgcctgaatacagtggcgtaaactgcggttgaatggttttgccggccggtaaccgacctgagggatcggccccgctactggttaaatggttttcagcgatgtacttgagctcacgcatcatgcccgccgagtggcgcacgtaccagtcaattgtcccgtagttgctggcgaattcctgacgaaccttattctctttatcgtgcagtacgctgatgatatagaaggtggtcagcaccgcgcccagtaaccagattagcagcgccagcgcgcggaacagatagcgcgaaatgcgaagcgtcgtgcggaaagagactagatatttcaaaggtgactcgcaggtggcaaggttagtcgcatcgttggatttttaatgctcatacactagctttatcgcagcaaaaaagccagtcggctgcggagcgcgaccgcagtttgggaatgtttgaccttaccggaaatcatccttgctaaaacaccagcgcaaaaaaaacggcaggtcgggttgcccctgacctgccgttcatgactcacgtgcgttggatgacttacacgtcgtcatccgctgcggggacatcgtcgtcgtcgttgtcgacttcaggcacgatatcttcatccccttccgcgacgctgccgtcgatagaatccagctcttcttcttccaccggctccgcaacgcgttgcagtccgaccacgttctcgtcttccgcagtacgaatcagaatcacaccctgggtattacggcccacgatgctgacttcagatacccgcgtacgcaccagagtgcctgcatcggtgatcatcatgatctgatcgctgtcgaccacctgcactgcgccaatcaccggaccgttacgctcggtcactttgatggagataacgccctgcgtagcacgcgacttggtcgggtattcgctgttagctgtacgcttaccatagccgttctgggtgaccgtcaggatagcgccctcttcgcgcggcacgatgagtgaaaccacccgatcgttctgcgccagcttgataccacgaacgcccgaggcggtacggcccatggcacgcacggcagattcggcgaagcgcaccactttacccgcagccgagaacaacatcgcttcatcgttaccgttggtcagcgcgacaccaatcagctcatcatcatcgcgcaggttaatggcaatgataccggcgctgcgtgggcggctgaactcttgcagacccgttttcttcactgtaccgcttgcggttgccatgaagatgttgaagccttcggtatattcgcgcacgggcagaatcgccgtgatacgttcgttggcttcaagcggcagcaggttgacgatgggacgtccacgcgcaccacggctggcttccggcaactggtagaccttcatccagtagagtcggccacggctggagaagcacagaatggtatcgtgggtgttggccaccaacagacgatcgataaagtcttcttctttaatgcgtgcggctgacttgcctttgccaccacggcgctgcgcttcataatccgtcagtggctggtatttcacataaccctgatgcgacagcgtaaccaccacgtcttcctgattgatcaggtcttcgatgttgatgtcagcgctgttcgcggtgatttccgtgcggcgctcatcaccaaactgatcgcgcatcagttcaagctcttcgcggatgacttccatcaagcgctctgagcttcccaggatgtgcagtaactcggcaatttgatccagcagctgtttgtactcatccagcagcttttcatgctcaagaccggtcagtttctgcagacgtaagtccagaatggcctgagcctgttgctcggtcaggtaatactggccgtcacgaataccaaactgcgcctccagccactccgggcgggctgcatcgtcacctgcgcgctccagcatggctgacacgttgcccagatcccacgcttgtgaaatcaggcccgctttggcttccgctggcgtcggtgcacggcgaatcagttcgatgatcggatcgatgttagccagcgcaatcgccaggccttcaaggatatgtgcgcgatcgcgcgccttacgcagttcaaaaatagtacgacgcgtcaccacttcacgacgatggcgaacgaaggcttcaagaatctccttcagcgccataatcttcggctggccctgatgcagtgccaccatgttgatgccgaaagaggtttgcagttgagtcagtgaatagaggttgttaaggaccacttcaccgactgcatcgcgtttgatttcaatgacgatgcgcatgccgtctttatcggactcatcacgcagggcgctgatcccttcgacgcgtttttctttcaccagctcggcgattttctcgatcaggcgagctttgttcacctgatacggaagttcgtgaatgatgatcgtttcacgcccggttttggcatccacttctacttcgccacgggcacgaatataaaccttaccacggccggtgcgataggcttcttcaatgccgcggcggccattgatgattgccgctgtcgggaagtcaggccccggaatgtgttccatcagcccttcaatgctgatgttttcatcttcgatataagcgaggcagccgttgatcacttcgcgcaggttatgcggcggaatgttggttgccatacccactgcgataccggacgagccgtttaccagcaggttagggattttggtgggcagaacttcagggatctgctctgtaccgtcgtagttcggaacgaaatcgacggtctctttttccaggtcagctaacaggtcgtgggcgattttggacatgcgcacttcggtataacgcatcgccgcagcggagtcgccgtcgatggagccgaagttgccttgaccgtccaccagcatgtaacgcagggagaaaggctgggccatacgtacaatggtgtcgtaaacggcagaatcaccatgcgggtgatatttaccgataacgtcaccgacgacgcgggcagattttttatagggtttgttccagtcattacccagttcgctcatcgcgaaaagtacgcggcgatgcactggcttcaggccatcacgcacatcgggtaaagctcggccaacgatgaccgacatggcgtaatcgaggtaagaattttttaactcttcttcgatattaaccggtgtaatttctctcgcaaggtcgctcatggagccgctatccctctactaatcccggattttaaaggtgcgaaagtatatcatagagccgcacgtgagggaaaagtaaagcaacgacaaccacgaggtttttcatcccttactggcacaaatttaaccaaggcaggtacaacacgaaaatgcaccttacaggcgatgctggacacagagtgaaacgtataattttcgaccaataaacaggtttacttcggcatcagccactcttatcactccttgataatcacagcagttgaggcagtcgtgtgacatgttgaattgttgctttatgaccgccactctaaattgcagaaaaccaggattaatcccaaaaaacatctttcacgctcagttccactggctctgattgaattactcattctaaggtacttcaaaatcaaagagtaaatgttatgatattaaaaaaattaatgtaaccgttggctatcctatgaatatatcactggttgaaaacacaggtctttattatattatcgagcgtatttaccctcgtgacggactcattcctgataatttttcttttggtggaatttccccctcactcgttcagatatatcgcatggtgattagcctctccagaaagcaagatatgtatatggagggagcaaaaatcaaccctgcaaatatcactctttggcagactataaaatattcgtttggcaccccggtacagacaaaatacacaggtgatttagtgtatacgctggcattttcaggttcgttagcctccttttcagcactccctgactctgatgtattggatatacctaaaaacttgaccaagcccagaacaaccagaatttcaccaacgatcaattatgggaaagaccctatacctaacattattctttacgggaacaaaaacgtaaagttcactatggataatggtggaatagatacacctacggcaatggcaaagtacaatagcaatacaaaagaaacaaaattagttactgataaaacagaactaaaaaaatcaatgcttgatctaaaaaaacatggtgtaacactatgaataacaagtttttttatttattttcaataatatcatcactgttcttattttgtctcggctttaatttccattatgaaattttaacgctatcttctgcctgtcaagattttttttctggtaacatcagtagcttattttataataaaactattactggcctcacgttatcaatattttgtttactcgctgcatttattcttagaaaaaaatcagcacgcgtaaaaaaaatcataacccaacaattcattcaaatactaacatcgataattgcaataacagtcaactccaagataaaacccattccatgtgaaagcattaccactggatatccactgaacatcttcctggcttttttattcggttttattattagcatgatatttgttttaaaaaggagagaaccttgatttttaaaaccataaaaaaagggttcagactctgcatgaattacgaagaaaaagattcgaaactcgaatacttcatcttcctggttttccagctagtctggttttcgctctacctgtcctttctggcggacgattccctttcaatcctgctgatcattgcatttattatgcctcttatttccagcagtttgcggtgccttaactatctgaacagaagccgtgcgattggttttttgtggataccctttccctatttcatggctttaatccctttgttgctaaccagaaaacacataacgtaagcgcgttttttgtctcgccgttttacccttacgccaactgcgatcaggccatctttagcttccggtcatcattctgatagtgctgataacataatcacatttcagttgctccctcctttcggcttgccagtgaaacattctcttttgtcatcgtgcctttcgatttaagccaggtttggctatgactgctgactcttcagcctacggcctggttcagcttgaggtatactcccaaccatcaacgctattagccggagtaacaaggttatgatttcaacttcacaggaaagcggtcagaacgttgaccataaggaaattgccaagtttgaggccgttgcctcgcgctggtgggatctggagggcgaatttaaaccgctgcaccgtattaaccctctgcggctgggctatattgcacaacacagcaacgggctgtttggcaagaaggtgctggatgtcggctgtggcggcggtatcctggccgaaagcatggctcgggaaggcgcagtggtcaccggattggatatgggtgctgaaccgctggaagtcgcgcgtctgcacgcgctggaaagcggcgtcacgctcagctatgtgcagcagacggtggaagagcacgccagccaacacgcgggcgaatacgatgtggtgacctgcatggaaatgctggaacatgtgcccgatccgcgttcggtggtgcacgcctgcgcgcagctggtgaaacccggcggtgaggtgttcttttctaccattaaccgtaatcccaaagcctggctgatggctatttttggcgctgagtatgttctgcgcatggtgccgcgcggcacgcatgatgtgaaaaaatttatccgcccttccgaactgctgggctgggtcgatgaaacgccactgcgtgagcgcaatatgattggcctgcactacaaccccatcaccgataagtttcgtctgggtaacggtgttgatgtgaactacatgatacacgcccaccacggcgacgcctgatccgccgcagcgtgcggctctgcccacgctgctgtcatcctgttgtcatgtgctcgcgctaattttcccctggggcggttctgtgtcatcggagccgtgacatttgcacattttgctgatgcctgctttctggtgtctgaaaaacttgcgcaatgtttgaaaaatcagcggtcgatcataaattgcaatattttctctggatggttgacatgacctgcggccttacgagacgcggcttaagaaaacccttagaaaatacaacccccgtagacatcattttttcctcttgttaagcgccagcaaaatactagaataagcctccatattgttatacatatcttcgacaaccccaagatgtagtgtttatccacaacattattcacaatgaatatgctgtgcataaatcgggatttcttttaattattggatactcacgcaaaggtaaaaacgcgacatgaaccaaagtctgctcgttactaaacgcgatggccgccaggagcgcattgatctcgacaaaattcaccgtgtcctcgactgggcggccgaagggctgaacaatgtgtcggtttcacaggtagagctgcgttcccacattcagttttatgatggcatcaaaacgtctgacatccatgaaactatcattaaggccgctgcagacctcatttctcgcgatgcccctgattatcagtatctggctgcgcgactggctattttccacctgcgcaagaaagcttacggtcagtttgaacccccagccctgtacgatcaggttgttaagatggtcgatctgggtaagtacgaccgccatctgctggaagactacagccgtgaagagttcgagcagatggacggctttctcgaccactggcgtgacatgaatttttcctacgcggcggtgaagcagttagaaggcaaatatctggctcagaaccgtgtatccggtgaaatctatgaaagcgcacagttcctgtatatcctggtcgcagcctgcctgttctcagcttatcctcgtgcgacccgcatggattacatcaagcgtttctatgatgcgatctcgacctttaaaatctcactgccgacgcccatcatgtccggtgtgcgtacgcctacgcgtcagttcagctcgtgtgtgctgattgagtgcggcgacagtctggactccatcaatgccacttccagtgcgattgtgaaatacgtttctcagcgtgcgggcattggtattaacgccggccgtatccgcgcgttgggtagccctatccgcggcggtgaagccttccataccggctgtattccgttctacaaacacttccagaccgccgtaaaatcctgttcgcagggtggcgtccgtggtggtgcagccacgctgttctatcccatgtggcatctggaagtcgaaagcctgttagttctgaagaacaaccgtggcgttgaaggcaaccgcgttcgtcatatggactatggcgtgcagctcaacaaactgatgtaccagcgtctgcttaaaggcgaagacatcacgctgttcagcccgtcagacgtgcctggcctgtatgatgcgttctttgccgatcaggacgaatttgagcgtctctacaccaaatacgaaaaagacagcagcattcgtaagcagcgtgtcaaagcggttgacctgttctcgctgatgatgcaggaacgcgcctcaacgggccgtatctacatccagaacgtcgatcactgcaacacgcacagcccgtttgacgccagcatcgctcccgtgcgccagtctaatctgtgcctggaaattgcgctgccaaccaaaccgatgagcgacgttaacgacgacaacggtgaaatcgcgttgtgtacgctgtcggcctttaacctgggtgccatcgaaagcctggacgacctggaagagctggcaacactcgcggtgcgtgcactggatgccctgctcgattatcaggactaccctatcccggccgcacaacgcggtgcaatgggtcgccgtacgctgggtattggcgtaattaactttgcttactacctggcgaaacacggtgtacgttactccgacggcagtgccaatggtctgacgcacaaaacgtttgaagccattcagtactacctgctgaaagcgtccaatgagctggcgaaagagcaaggtgcctgcccgtggttcaatgaaaccacttatgcgcagggcgtgctgccgatcgacacctacaagaaagatctggatgcgatctgtaatgagccgctgcacctggactgggaaaccctgcgtgagcagattaaaacccacggtctgcgtaactcgacgctgtccgcgctgatgccgtctgaaacctcatcgcagatttcaaacgcaaccaatggtattgagccaccgcgtggtcatatcagcatcaaggcatccaaagacggtatcctgcgtcaggttgtgccggagtatgagcgccttaaagatcagtacgaactgctgtgggatatgccgtcgaacgatggttacctgcaactggtcggcgtgatgcagaaattcgtcgaccaggcgatttcgtctaacaccaactacgatccgtcacgttttgccaacggcaaagtgccgatgaagcagttgttaaaagatctgctgaccgcctacaagtttggcgttaagacactctattatcaaaacacccgtgatggtgcggaagatgcacaggatgatctggcaccttctattcaggatgatggctgcgagagcggcgcctgtaagatctgacggtcgggcgggaagcctttcccgcccacattttcccgcgaggccggtgctgagcctcgtctactttggacagtttttatggcttactccactttttcacagaacaaaaatgaccagttgaaagagccgatgtttttcggtcagtccgttaacgtggcgcgttttgaccagcagaaatacgacatctttgaaaaactgatcgaaaagcagctctccttcttctggcgtcctgaagaggttgatgtttcacgtgaccgcatcgactaccaggcactgcccgatcatgaaaaacacattttcatcagcaacctgaagtaccagaccttgctggattcgattcagggacgcagcccgaacgtggcactcctgccgctgatctccattcctgaactggaaacctggatcgaaacctgggcgttctcagagacgattcactcgcgctcttatacgcatatcatccgcaacatcgtcaacgatccggctgtggtgtttgacgatatcgtcaccaaccagcagattctggcgcgtgcccaggatatctcgaagtactacgatgacctgattgagatgaccagctactggcatctgttaggtgaaggcacacatcaggtcgcgggtaagtccgttaccgtcagcctgcgtgcgctgaaaaagcagctttatatctgcctgatgagtgtcaatgcgctggaagcgattcgtttctacgtcagctttgcctgttcattcgcgttcgccgagcgtgagctgatggaagggaatgcgaaaatcatcaagctgattgcccgcgatgaagccttacatctgaccggcacccagcacatgctgaacctgctgcgcacgggcgaagacgatcctgaaatgaaagagattgccgctgagtgtcgtcaggagtgttttgagctgtttaagaaagcggcgttgcaggaaaaagagtgggcggaatacctgttcagcggcggctcaatgatcggcctgaacaaagatatcctgtgccagtatattgaatacatcaccaatattcgtatgcaggcagttggcctcgacctgccgtttgaaacacgctcgaacccgattccctggattaacgcctggctggtgtcggacaacgttcaggtggccccgcaggaagtggaagtcagctcttacctggtcggtcagattgactccgaagtgggtgaaaacgacttcgacgacttccagctgtaataatgagccgttctgttgttattctgcgcagctccggtacccgactggagtgcgcagacgatcaccccaacctgctgaccatgctggaagccaacaatctgtgtgttgaattccagtgccgcgaaggctactgcggctcctgccgtatgcggctgctgagcggtgaggtcgactacgcggaaacaccgctggctttcattgagcagggcgagattctgccctgctgctgtaaggcgaaaggcgacattgagcttgagctttaacgcctgagccgtccgcgtttaaaaaccgtaatcccgaccgggttgcggtttttttatgcccacggatagttcagggaatacgcgcaatcaccttaatttcaaaatcaaaccccgccagccaggtcacgccgaccgccgtccagttgggataaggtgcctgaggaaacagggcattctttacctgcatgatggtttcaaactgatgttcaggatcggtatgaaaggtggtgacgtcgataagatcgtccaatgtgcagcccgccgccgccagagtttgccgcagattatcaaaggcaagcgctacctgagcggcaaaatccggctctggcgtgccatctgtgcggctgccgacctggccggagacaaacagcaggtcaccagagcggatggcagcagagtacccatgcatgtcatacagcgcatggcgtccttcgggaaatacggcctcacgagtcatcatacaatcacctttaatcgatttagggtcagtaagtcatgcacgcatcacctgcttgatttaagatacatgtcgtatatgaaatagaacacagatacgtgtcgtatgtcaaagccaaatacggtacgtatctgaaaaggaggagagatgacagcacggccacgcgcggtcacgatggaagagaatcgcgtcaaactgatatccgcagcacgcaaagcgtttgcagaaaaaggctttgcagccgcatccatggatgagcttaccgccagcgtcgggttaacccggggagcgctctaccacaactttggcgataagcgcggcctgctcgccgccgttgtagcggaagtcgatagcgaaatagcccatcgggccaaagagagagcggcgggtataaaagacagctggaaccagctactggaggaagggatcgcgtacattcacatggcgctcgaccctgaagtccagcgaattgtgttactggatggcccggcctttcttggcgatccctctctctggcccagccagaacgcctgcctggctgccacgcaaagcgcgctgagtgagatggttaagaacggagtagtgaagccggtggacgtcgaagcggcagcccgcttgctcaacggtgccgcttttactgccgcattgtgggtggccgccagtgatgatcctcaggcgaccttagcgaaagtgacggcgacatttaacgtgctggcggggggattactgcagcctacggcatcatgccagccgagaccggagtagcgtttttgcagaagagccgaacaaacagcccggatgtgcagggccgccttcacgcaatgcggccctgtaatccttagtgcttaaccgtttcgattacgtcaatccagccgtggcctgtgcttacctcactgccgtgcaaccagcgccgcagcatattcatcgccatcatcgccacgactttttgccgggtttccaggttgtggcgacagtggctgaacttcacgcgttgcccccatgtggcctctggcgtatggagcgcaacggagatttcgccttcgcgtagattgcctaccgacagggctaacggtgtctgaagcctcgccgccagcgcctgagtacgcattacctgtacttcaagactttcgtcctgctgcggtaaaatttcggtggcgctcaggggaacctcagctgaagccagctgccagttcagtaaacctgcggtgtactgctcgctaatcgctaggcgccagttacgctgatgcagctcacgcgccaacagtgcaggcagcccctcggtgccttcaaaaatcgtgcactccgccagcagcaaacgcacctgttgccagacctgctccattgcaacacgctgggaggccggcccggtcagtttgatttcgataatgggcatcgacgagcggtagcccatcaacacgttctctggcaggggcagcggctccagttcattggcaatgtcactttccccacgaccaaaagtggtcaggcgcagacaaagcggcggctcgggcagttcaaatttgtctttcaggcggggaatgatttgttgctcaaccatcactttaaattctgaaggcacgccaggggtgaaaaacaaccagcagcggttgagttgcatggcgaacccacaggcggtaccgaccgggttatccagcatttcagcgttagcggggatttctgcctgcttacgattactgtctgccatcacccgtccgcggctggcgaaccaggcttccatggtttccagccagtcttcctgcatgaccagcgctaccccgctcgctttggccgccgcctgagcactgagatcgtcactggtagggccaagaccgccgttgacgatgagaacgtccgcctcaaggctacgcgcctgtagcgtctccaccagcgatgacagggagtcaccgaccgtcgtacggctggtcatcggcagcccgtgctgaaataacacatcagccagccaggccgcgttggtatcgacgatttgaccatgtaacacttcatcgcccgtggacagcatttcaactctaatcacgttctttctccttgtgccagtcacttcactttaggaagcccctgcgtaaaacacaatctgtaaggcggatttagcacagaataagaccttttcaggcgggacaggcgggagagtaaaacagcgggactaacaatgcgggtgcgaagcggccggaattcaaaaacaaaacggacaggacgaagcctgcccgttgtacgtgatgtagtgcacgttacgattaacggcgagccagcagcaagcctaaaatcagtcccgcagtcgcaccgatgccgatgcctttccacggtttctcatgtacgtagtcatcggcacggtaagccacctgcttagcacgatagtagtagctatcggatgcctggctaacacgtgactttacatcttccagcgctcgttcagctttggttttgagttcgatatatttctggtcggccggatcgcctgatgacttcagcacttcttccagcgtttcggtcagcagtgcgatatcgtcgtcatagcctgtttcgaaaggttcagtctgttttaccatcatttcctccatgtgaattgcaaagcacaaaggtaactatagccataaaatagggctttgcgcggaacccgaccaggaatcgcctgaaaatcagcataagtaaaccgaacgcgagtcaatctgtgtcacgctgagcgctacgcaaagaagtgtaagagatggcctgctggccgtaatttcgcttcgcttatttgatttatctgataaatttttagcgaactgaatttttctctacgccgactgtcgtaccctgctgttgcctgtaataatcaggccatgtgcataacaatgtgctgacacgacagtcacaacaaactcgaacagctaaggaatgatctctggcatgaatcgaagaatgtttatgaaagcgtcaatggccttctccgcagtaagcgggatgacaggcttatcgacgctgttcgcgcaatccgcctgggcagacgatggcattgctgacggaaccgcagtacgcttcgatttcgatgagttgaagaagaatgcggccgcgctggctaaaaaaccctggggcggcgcaccaggccctcttccacccacgctggcgaccctaacaccgcaggcatacaacgacattcagtatgatgccagccactctctgtggaacaatattcccaatcgcgaactggatgtgcagttctttcacgtaggaatgggattcaaacgccgcatccgtatgttctccgtggacagcgccagccgtgaagcacgtgaaattcatttccgtcctgagttgtttaattacaacgatgccaaagtcgacactaaacagctggaaggcaaaaccgatcttggctttgcgggcttccgcgcgtttaaaaagcctgagctggcccgccgcgatatcgtctctttcctgggtgccagttacttccgtgcggtcgatgacacttatcagtacggcctgtccgcccgtggcgtggcaatcaacacgttcagcaatggtcaggaagagttccccgactttacggcgttctggtttgaaacgccgaaagccgaggacaccacgtttacctgctatgccttactggacggagccagcatcaccggcgcctataagtttgtcattcactgcgaagccgaacgcgtggtgatggagattgaaaaccatctctttgcccgcaaggatattcgccagttaggcatttcgccgatgaccagcatgttcagctgcggcaccaacgaacgtcgcatgtgtaatacctatcacccacagattcacgactccgatcgcctggcgatgtggagcggtaaaggggaatggattgcccgtccgttgaataatcctcagcgtttgcagttcaacgcctatgaagatgaaaacccacgtggttttggtctgctgcagcttgaccatgacttcgagaattatcaggacgttatcggctggtataacaaacgtccgagcctgtgggttgaaccagtaggcaaatggggcaaaggcgccatcaacctgatggaaattcctacgaccggtgaaacgctcgataacattgtttgcttctggcagcccgctgagcccattaaagccggcagcgaatacagttttgcctacaagctttactggagtgccctaccgcctgtacagagcgatctggcgcgcgtggatgcaacccgtaccggcatcggtggtttccctgaaggctgggcacccggcgagcacttcccggatgtctggtgccgtcgctttgctatcgatttcatcggtggtgatttgcaggccgcggcagcgaaagggattgagccggtaattaccgtttcatccggtactttcaaacaggttgagattctctatgtcgaacccatcaagggctaccgcattctgttcgactggtatcccaacagcgacgccgtcaaaccggttgaaatgcgtctgttcctgcggacaaaagaggaaaccctgagtgaaacctggctctatcagtacgttccgccgccgccggatcagcgtaaatacgttgatgaccgtcagatgacggtgagttaatcgttcaggcttgacctaaatgcatcccaggcgctctgccgggatgcattttttttgcccatcatctcctgcagcgcgtggtgaatgcgcacccgtcagcgcgcctctcttttcaaacctgctccgtttcgcccagtgcacaggcagactcattcgccagcctgttctgctctgcgcatatcaatatgggcaatgccatcttcaagatagctgtcgctgaccgccacaaagccatgtcgctgatagaaagcctggagatgcgcctgggcggaaagaaacagcgaatgtcctggccagtgctgttcacaattggctatcgcctgcgccatgagttggtttcccagattcagaccacgcgccttatcagaaacgataacgcgcccgatggtgacgtctgcctgcgggccatccggtgacaagatgcgggcatacgcgagcagttcatcctgcgccatgcccaacacatggcggttatcggcctgcaaatccaggccatcgacgtccagataggcacagttttgctccaccacgaacaccttgcagcgcaggaccagcgccgcataaagctgcggtacggttatggcttgctggtgaagatccagccaactgatttgcatctcttatccttatcacaataggctgactgcccggcggcgcaataatactaatctacaatgctaccctttctgcagccagcgttgataatgcccaggccaggcgacggtgggcgttccgggttttcccatgccaaacccatgaccgcccgtgagataacgataaatctccacgtcaacctgatgctgttggcaggcacgagccataatcagtgtgttatggggatcggaaaccggatcgtcctcggcctggaccagaaaaaaagggggcgatgttgatgtcacataattctgcactgaccaggctgcatcttctgccgccgtggcatgcgcaccgactaacatacggtgtgttgccgtgtgcgtataaggcgcttccagggtgatgaccggatagatcaacgcagcagcatcagcataagcgggcgtgctgtccagggcatccatggctgggtagctgtgaagctgatgccgggtcacggccatcccgagcagatgcgcaccggctgaaaaacccagcaccgttaaccgctttgcctgcggccttaacagccgcagcgcgcgctgggcgtcctgtaaggccacttcattcccatcagtccagccctcaccgggaagacggtagcgcagcaccgctgcggtatagccgcgtgcggttaaccagcgcgctgcaggccaggactcttttgccatctcaatgcgctgatagccgccgcccccggctatcagaacaacatgaccgttcgacacgctgggacttaacaccgttaaggtcggaatggcgatatgacgttgcgcccctgaaggcagcgtctcgatctggccttccggtccgccgccgcccggcggtgtgccaggccagagcggcaccaccctttgtgagtaagcggatggctgagcctgggaaacggtactcctggcggcaacccatgcagctgccaaacctgtcagaaaacggcgacgatccatagcgggtactcctgatagcaaggtatggcccatttcagcaggaaactatggaaacagaatgaagataggcattttataacgggaaggtggacgcatcagtaggagcaagcgggtttgaactgaccaaaaggctgacgggacaggctcaaggcaaaaaaaatcaggcccggaggcctgattcagtgtaacggcgtaaacttacatcagcggctgggccatttgtaccagtctgattaacggctgtggataaacacccaacagcagcaccagaatcgcagaaatcagcaccacaacaccaccggcggtgaaagcccagttcgctggcgtatcgcggctcagcagttctggtggactgaggtacagactgacggtaacgcgcagatagtaatacaggccaatcgcactaccgactacgaccgcaccggtcagccaccacaggtgagcactgacacctgaggcaataacgtagaacttaccgataaagcccagcgtcattggaataccggccagtgacagcatcattacggtcattaccgcagacagaatcggacgatgccagaacaggccacggtaggagtacagtgaatcggcgtccgggccacgatacgggctcgacatcaggctcacgacaccaaaagcacccaggctgctgaacagataacccgccaggtaaaccccagaggtttccagcgacagctgatgatctttaaccgcaatcaacgcgaccagcaggtaacccaaatgggcgatagacgagtaacccagcagtcgcttgatattgctctgcgaaatcgccatcaggttaccgaacaggatggaaacaaaggcgataatgcccagtaccgtccgcacggcttcgctgtccgtgaccggcgcgtacatgaacagacgcatgacaacaccaaaaatggcaattttactggcggttgccaggaaggttgacacaggtgcaggcgcgccttgatacacgtctggcgtccacaggtggaacggcaccagcgacagcttaaagcccagaccgataatcagcatacccaggcccactagcaacagcggttcctgaatcatgctgtcagtgaggcttttgcccaggctgacaaagcccaggttgccggagtcagcgtaaatcagcgcgataccaaacagcaggaaagacgatgctgccgccgacaagatagtgtatttcagggccgcttccagagaacgtttctggcggaacgcgtaaccaatcaacccaaacagcggcagagacagcagttcaataccaataaacagcgacgcaaggtggttagaggctgacagtacaataccgcccagcgcggcaatcaataccagcagatagaactcgtccttgttatccgggaatgttgccagccacggataggcgaaggtacaggttgccaggctggccagcatcaccagtgcggtatagaacatcgaataagcgtcgacgcgcaacagcggcgtgacgtccatcgccccgacatggcccacaaagtagagtgacagcagagccaggttcaggccaaccaccgttagcgtggcgttaacaaagtggttgcgtcgccaggcaatggacagcatcacaaccaccaccgtcaatccgacgattaacagcggcagcaacgcgatcaattgttgaggagttattgtcatggcgaattacggccttgtagttgaaattgaagcggtaaaccactgctgaatattgctcattgcagcatgtgaggtatccagaatcggctgtggataaatacccagcagcaccagcagaaccacgagcacgccaatggtcatgaattcacgtgccgacattcccggcagtggatctttagatttcgcttcaccgtaataggcacgctgcatcattaccagcgaataaaccgaagcgaaaaccagaccaaaggtcgcaatcacaataatgacagggacgatctggaagctgcctgtgaggatcataaactcacccacgaagttaccggtgcccggcatccccaggttggcgacagcaaagaacagtgataaacccggaatccatttgattcgcgaccacagaccgcccatctgacgcatatcacgcgtgtgcaggcgctcatacaactgtccacacaggatgaacagtgccgccgccgacaaaccgtgcgcaatcatctgtaccactgcgccctgcatagccagctggctaccggtgtaaatcgcaatcagcacaaagcccatgtgtgaaatcgaggtgtaggcaatcagtcgtttaatatcagtctgcgagaacgccatccatgcgccgtagaagataccgataatacctaaccacatcgcgacaggtgcaaactcagccgaggcgttgggaaacagcggcaggctgaagcgcagcaaaccataggctgcggttttcagcagaatacccgccaggtccactgaaccggctgtcggtgcctggctgtgcgcatccggcagccagccgtgcagcggcacaaccggcattttcaccgcaaacgcgataaagaagcccagcatcagcagatattcaacggtgtgcgacattggcgttttcaacaactgttcgtagttgaaggtccagacgccggtagcgttgtaatgaacaaacaccagcgccagaatcgcaatcagcatcaccagacctgacgcctgggtataaataaagaatttggtggcggcggtgatacgtgtcttaccgtccgatgccttatgtccccacagtgcaatgaggaagtacatcggcaccagcatcatttcccagaagaagaagaacaggaacatatcgatggcaaggaacacaccgataacgccgcccagaatccacatcaggttaagatggaagaacccctgatacttctcgatctcgttccatgaacacagcaccgccatcaggccgagcagtccagtcagcaccaccattaacagcgaaaggccatcaagcgctaaatggaaattaatgccgaaacgaggaatccagggtactgagaagctcgattgccactgcggaatacccgctgcctgcgtcagtgaatagccaccctgcaaccagagctgcagtgaaagcgccaacgtcagccccatggtgatcagggcaatccagcgtggcaccttcgcgccgaagcgctcggtgagccagcagataaaaccaccgaagaagggtatgaaaattagccaaggtaataacacggcatacttcccttttttttgtcctggctcgggctatctcacttgcccgtttcgcctccggcagtgctcgcatcctcacgtacttcagtacgctccggttgctgtgcgctggcggtggcgaaacggactgcgccgattacgcccttacatcagacaatctttgacattcttaatgggtaagttttcacacctacccgctcatcaatctttaaattaccagcaacagggccagaaccacgacggcgcccacgctcatcgacgccacgtaccagcgcagataaccgttttcactcaccaccagacctttattggcgatacgtgaaagcaacgcaggcaggttcatcaagccgttaagcggatcgcgtttcaacagccacgcaatgcccaggtaaggtttgacaaacactttatcgtagagccagtcgaagccccaggcggcgaaccaccaggtgccaaagaaccggcccgggccgctattggcgatgcgggtaaccagttgacgcttgcccagccagagcgcggcagcaataacgatgccggcaacggcgaccagaccagaagcgatctccagcgtcactttaccgttttcaccaaactcattagccggtaaaacacccgccagcggtggggtaattaatgcgccaataaaggtggagagcaccagcagtacaatcagcggcagatgatgggtaatgcctttacccgcatgagcatgaattttctcttcgccgtggaacacgatgaagatcatgcggaaggtatagattgaggtcaggaacgcccccaccagacccgcaaccatcaggttaagatgaccgttagccagagcaccaaacaggatttcatctttactgtagaaacctgcggtaatcagcggcagtgccgccagcgccgcgccgccgaccaggaagcaggtataaaccagcgggatacttttacgcagtccgcccatcttaaagatgttctgctcgtggtggcaggccagaataaccgaacctgaagagaggaacagtaaggctttaaagaaggcgtgagtcatcaggtggaaaatcgcggcatcccacgcctgtacgcccagcgccaggaacatatagccaatctggctcatggtggagtaagcgagaacacgtttgatgtccgtctgcaccagcgcggcaaaaccggcaagcaccagggtaatggcaccgataatgccgaccagatgcagcacttcaggcgtcagcaggaacaggccatgtgtgcgggcaatcaggtacacacccgccgtcaccatggtcgcggcgtgaatcagtgccgataccggggttggacctgccattgcatccgccagccaggtctgtaaaggcagctgggcagatttaccgaccgcaccgcctaacagcatcagggtcgcccactgcagcatgtgattgtcggcggcaaagtgtgccggtgccagttcaaccatttcgcggaagttgagcgtacccagttcgttgtaaagaatgaacagggcaaaagccagaaacacatcgccgacgcgcgtgatgataaaagctttcatcgccgctttgccgttttctggattgctgtagtagaagccaatcagtaagtaggagcacaaccctaccccttcccagcccagatacatcagcatcaggttatccgccagcaccagaaccaccatgctggcgataaacaggttggtataggcgaagaagcgggaatagccctcttctccgcgcatgtaccaggaggcgaacatatggatcaggaaaccgacgccggtgaccaccgacagcatggtcagtgacaggccatccagggtcagattgacctggatgttgaaattgcccacgtgaatccaggtccacagcgcctgagtgaagacctgctgcccgttagcaaagaagtcgaagccaacaaaaacggtcgtcagtgcggctaaccccaccgatcccattcccacagcagccgataaattttctgaccagcgaccacgggaaaacgctaacagcaaaaaaccgattagcggaaacaagacagttaaatagagaagattcatccgcgcatctcgctcacaatatcaatgttcagcgtctgacgacgacgatagagctgaagcagcagggccagaccaatactggcttccgctgcggcgaggctgattgccagaatatacatcacctgaccatcggcctgtccccagtagctgcccgcgacgaccagtgccagggccgcagcgttgatcatgatttcaagactgatcagcataaacagcaggttacggcgcagtaccagcgaggtcagtccaaggacgaacagcaccgcggccagaatcaatccatgttgtaacggaatcatgcttgctccttattcgcctgcgcggcttcgtttgaacggttgctcagcacttcaccctgacgctcttcgcgtcccagatggaaggccacaaccagaccggccagcagcagcattgacgccagttcaaccgccaggacataagggccaaacaggctaataccgaccgcttttgcgtcgatgattttaccgtcaatgccctggtcatgcgctgtcatgatggcgtaaatcatgaccgctagcagcagaaacgaaaccagtccgggaccaatccacaatgacgggctcagccattcgcgttcctgtttttcagtggctttgcccagattgagcatcatcacgacgaacacgaacagcaccataatggcaccggcataaacgatgatttccagcgcaccggcaaaataggcacccagggagaaaaagacgccagccaccgataacagcgaaacgatcaggtacagcaacgcatgtaccggattagtgtgggtgataacgcgtaacgtcgtcactaccgccaccagtccgcaaagataaaacgcaaattccatgccttgctccttaaggtaataagcctttgacgtcgattggtttcgcttcgttttcagcgtcacctttatctttaccgtcaatcgccatacctgccatgcggtagaagttgtattccggatatttacccggccccgagatcagcaggtcttctttctcatacaccagatcctgacgcttgaactcgcccagttcgaaatccggcgtcagctggatagcggtggttgggcaggcctcttcacacagaccgcagaaaatgcagcgtgagaagttaatgcggaagaactctggataccagcgaccgtcttttgtttcggccttttgcagtgaaatacagcctaccgggcaggctactgcacaaaggttacaggcaacgcaacgctctgccccgtcgggatcgcgggtcagtacaatacgaccacgatagcgtggtggcaggtagaccggctcttccggatacatctgggtttcgcgtttcgcgaaggcatgcatgcctatcatccagatactgcgcactgtcgtgccgaagcctacgacaatatcttttaatgtcatttgtttaccccttactgcgctgtatacagaatgactgcggcggttgccagcaggttcaacagcgtcaacggcagacacactttccagccgaacgacagcacctggtcatagcgtggacgcggaagcgcagcacgaatcaggatgaacatcatcataaagaacgccgttttcagggcgaaccagatgaatggcggcaggaaaggcccatgccagccaccgaagaacagcgtaacaatcagcgctgaaacggtggtaatcgcaacgtattcgcccacaaagaacaggccaaacttcataccggcatattcaatgtggtaaccgtcggccagttcttgctcagcttctggctggtcaaacggatgacggtggcacactgcgacgcccgcaatacagaaggtcagaaaaccaaagaactgcgggatgatgttccacaggtgcgtctggctgttgacgatatcggtcatattgaacgagcccgcctgcgccactacgcccatcagcgacagccccaggaacacttcataactcagcgtctgggcagaagcacgcatggcacctaacagcgagtatttgttgttactcgaccagccagcaaacagcaccgcatagaccgccaggccagccatcatcaggaagaacagcaacccgatgttcaggtcagtgacgacccaggtcggtgataccggtacgatggcaaacgccagcagcagtgacacaaaagcaatcaccggcgccagggtaaagataaagcggtctgtaaaggggggaacccagtcctctttaaagaacatcttgatcatgtcagcaaccagctgcaaggagccgccccagcccacgcggtttggtccgtagcggttctggaacagaccaagcaaacgacgctcggcgaagctcataaacgcaccacagcccacgacaaccagcagaatcaccagcgctttaaccacggcgatcagaatgtcgataacacccggagttaaccagctcattgcgccgcctcctgcagagaatcaatttttgcattcgccaggaatggcggcacgcctggcagaccgagtggaaggcccacctgccctgcctgcagcgaagaagagaagcgcacaggtaagcgaacggtttcaccggcacaggttaattccacggatgcgccgctgttcacgcccagcttagccgcatcatccgggttcagcaccagggtcggtgccgacatacgctgttggattaccggcgcacgctgcgtcatctcttcactaccaaacaactggtagtaaggggcgacacggaactgaccggtggtggcataagcacctggtacgctgctgaaccaggctaactgcgcctcactggcttcaaacaagcgaacgccgggatcgccgtgacgcagtttaccgcccacttcatcctggaatttgttccatgcctgaggtgagttccagccgggtgcccaggcaaacggaatctgcgaacgcggtgcgcttggctggttgttcccttccatagagaaggcaaacatggtgtcctgatcctgtggctgacgcggctcatgcacgctgatattagcgcgcgcggcggtacgcccactggcacgatgcggtgaacgcgccagtttctgaccacgaatacggaagctggcatccggtgcagcttctttaatgcctttaagctgtggcaggctggcgaccacggcatcaataacatgatcgagctgcgtccagtcaacgtgacggctttccagcgcgctgtgcagtgaatgcagccagcgccagctttcaagcatcacgatgctgttgtcgtaataggctggatcgtagacctggaagaaacgctgtgcgcggccttcatggttaatcgaggtgccgtcactttcagcgaagctggcagcggaaagaaccagtccggctttttccagcgtggcggtgcgttgatgatcaaccacgatcacattagcggcatgattcagcgcggcatcgacctgcgcttttggcgcatgacgataaagatcgttttccagcacgacgaccgcatcggcttcgccgctttgcagctgctccagcgcgtggtccagggtatgtccgcccatcaggcccagtcccatgctgttcgcatggcttgccattaaggtgatacccacctctgcgccgcgtgctttaagcgctttcgccacgtttgctgcggcttcaatcatggcgctgctgccggagtggacgccggagataatcaggggctttctcgcacccgccagagcctgtaccaccacatccagcttgccgttcagcgcagggtcgaaatcgcttacggccggggcggtttcgtccagcgcattggcgatggcaaacccaagacgcgcctgatcttccactggggcacggtagctccatgcggcaatatcatcgagacgcgtttcatcgacgttggtaacaaagagtggatgcttagcgtgctgaccgatattcatgatggccgcgatttgccagtctgcgactttctgcgcagcggccatttcacgggccttgcctttcaccgcctgacgaacagacagggcaacgcgcgcgccgacctgcgtcaggtcttcacccaacaccagcaccgcgtcatagctttcaatttcgcgcagcgacggcgtataaatcccaccttcgcgcagcacttttaacagcagttcaaggcgctcctgctcacccgcaggcataccggtagagaagttttcggccccgaccagttcacgcagcgcaaagttactctcgatgctggcgcgcggtgagccaataccaatcacgcgtttcgcctgacgcagaacgtcagcaccgacgttcaccgcctgctctgcattcaacgttacgcggtcgctgccacgtaactgaaccggatgatgaggacgatctttcaggttcacataaccgtaaccaaagcgaccacggtcacacaggaaatagtggttaacgctgccgttataacggttttctatgcggcgcagttcaccatagcgctcacccgggctggtgttacaacccacgctgcactgctggcagatgcttggcgcgaactgcatatcccatttacggttatagcgttcagagtgggttttatcggtgaagacgccggttgggcagatttcgacaaggttaccggaaaactcgctttccagcgtgccgtcttccgggcggccgaagtaaacgttgtcatgggcaccataaacgcccagatcggtgccatcagcataatctttgtagtaacgcacgcagcgatagcaggcaatacagcggttcatttcatgcgaaatgaacgggccaagatcctgattgcgatgggtgcgtttggtaaagcgatagcgacggaagctgtggccggtcatcaccgtcatatcctgcagatgacagttaccgccctcttcacataccggacagtcgtgcgggtggttcgtcatcaaccactcgaccacgctttcacggaactctttcgcttcgccatcatcaatagagatgaaggtgccatcagacgccggcgtcatacaggacatgacaaggcggccgcgggtatcttcagcgttctggaattgctttaccgcacactggcggcaggcacccacgcttcccagcgccggatgccagcaaaaataaggaatatcaaggcccagagacagacatgcctgtagcaggttgtccgctccgttcacatcatattctttaccgtctacatggattgtagccatagtgacatgcttccgtaaggctcgtcataaacgagcgttaatcaaattcttgtccctgcacactgcagcaggaacggcggcacagggccagctcccgtggataacggcgaattaccagcgcgctttcagcaggtttggctgaataccaccgatagctcgggtattaccaaacacctgcggcgcaatgccggcttcaaactcttcacggaaatatttaatggcgctttgcagcggttcgacggcaccaggtgcgtgagcacagaaggttttgcccgggccgagctggcggcaaagctgctccagggtttcgatatcccccggctggccttttttctgctccagcgcgcggaggatcttcacgctccacggcaaaccatcacggcatggcgtacaccagccgcaggattcgcgagcaaagaactcttccaggttgcgcaccagtgaaaccatattgatttcatggtcgacggccatagccagggcagtacccaggcggctgcctgctttaccgatactggcgaactccatcggcagatccaggtgctgatcggtcaggaagtctgttcctgcaccgcccggctgccaggctttgaagcgcaggccatcgcgcatgccgcccgcatagtcttcaagaatttctctggcagtgataccaaacggcagctcccagacgccggggttttttacccgacctgagaagcccatcagtttcgtaccggcatcatcgctctttgacaggccctgataccattcaaccccgttggccagaatagctggcacgtttgacagcgtttcaacgttgttgacgcaggtcggtttaccccagacgcctgcgctcgccgggaaaggtggcttagaacgtgggttagcacgacgcccttccagcgagttgatcaaggccgtttcttcaccacaaatgtagcggccggcacctgtgtgcacgatgagttcgaaatcgaaccctgagcccaggatatttttacccagtaaaccggcttcggtggcttcggcgatagcgcggcgcaggtgcaccgcagcttcaatgtattcgccacgcaggaagatatagccacggtaagctttcagggcaaacgcactgatcagcatgccttccaccagttgatggggcatttgctccatcaacaggcggtctttataggtgcccggctccatctcatcggcgttacacagcaggtaacggatgttcatggattcgtctttcggcatcaggctccacttcagaccggtagagaagcctgcaccaccacgtcccttcaggccggaatctttcaccagcgccacgatctcatccggtgccatgcctttcagggctttttctgcaccggcataaccgtttttactgcgatactcatccagccaaacgggctgctgatcgtcacgcatgcgccaggtcaggggatgggtttcggcagtacgaatgatctgtttaattgtcattgatactgctccagcaaagaggcgatgccttccggcgtcagatgaacgtgcgtatcttcatccaccatcatggttgggcctttatcgcagttacccaggcagcaggttggcagcaacgtaaagcgaccatcggttgtcgtctgacccggcttgatattcaggttttcttccagtgcagcctgaattccctgaaaacccgtaatgtggcataccacgctgtcgcaatagcggatcacatggcggccaaccggctgacggaaaatctggctatagaaagtggcaacaccttctacgtcgctggccggaatacctaacacttctgcaatggcgtgaattgcgccgtcgggtacccagccgcgttgcttctgcacgattttcagcgcttcaattgacgcggcgcgtgcatcttcgtaatggtgtttttcgtgctcaatcgcatggtgctcttccgcactcagcacgaagacctcgttggggtcgatcgttttaatagcaatgtgttgatcgtgcataattagcggtccacgtctgacataacaaagtcgatactaccgaggtacacgattaaatcggataccaggctgccacggattaccgaaggaatctgttgcaggtgcgggaagctcggcgtacgcacacgtgtgcgatagctcatcgtgctgccatcgctggtcaggtagtaactgttaatccctttggtcgcctcaatcatctggaaggattcattggccggcataaccgggccccatgacacctgcaggaagtgagtgatcagggtttcaatgtgctgcagcgtgcgctctttcggcggcggcgtggtcagcggatgatccgctttaaacggccctgccggcatgttgttcaggcactgctcaagaatacgcagcgactgccacatctcttccattttcagctgcacgcgcgtgtaggcatcactgatgccggcacccacgggcacgtcgaagtcgaagttttcatagcctgaatatggccgccatttacgcacgtcaaaatcaagaccggtcgcgcgcagagccgcacctgtggtgccccatgccagcgcttcttccatattgtaggccgccacaccttgtgaacgtcccatcagtaccgtgttgcgcagcgccgctttgtcatactctttcaggcgcttcggcatccagtccaggaagtcacgcagtaagcgttcccagccattcggcaggtcgtgtgccacaccgccaatacggaaccaggccgggtgcatacggaaaccggtaatcgcctcaaccacgtcatagattttctggcggtcggtaaaggcaaagaacaccggtgtcatggcaccgacgtcctgaataaaggtggagatgtacagcaggtgactgttaatgcggaacagctcggagagcataacgcgaatcacattaacgcggtcagggacaacgataccggccagtttttctaccgccagtacgtaaggcatttcgttgacgcagccaccgaggtactcgatacggtcggtgtaaggaatgtagctgtgccaggactgacgttcgcccatcttctccgcgccacggtggtgataaccaatgtccgggacgcagtcgacgatctcttcaccatccagctgcaaaatgatgcggaaagcaccgtgcgcggaggggtggtttggaccgaggttgaggaacataaagtcttcattggcggtgctgcgtttcatgccccagtcttcaggcttgaacgtcaacgcttccatttccagatcttctttctgcttcgtcaacgtaaaaggatcgaactcggtcgcgcgcgcgggataatccttacgcagcggatgcccttcccaggtctgcggcatcataatgcgcgtcagatgcgggtgaccatcaaaggtgatgccaaacatctcccaggtttcgcgctcgtaccagttggcattggcgaaagtagtggtgatggtcggcacatgcatatcgttttcggataaagccaccttgagcatgatgtcgcgattgcgttcaatcgacagcaggtggtagaaaacggaaaaatccgcgtcaggtaaacctgcgcggtgggtacgtaaacgttcgtccatgccgtgcaggtcatagagcatgacgtacggcttaggtaatttacgcaggaatgtaatgatttccagcagctgttcacgctttatccacaccaccggaataccggtgcgggtggcctgaacggtaaaggcatccggcccaaaacgattacgcagctcgccaatcaccggatcatccaggtgatcgcgggtttgccatagtggctgagcgagatcttgcgtggtcaaatctgtcatacgttactcaccattccggcctgataacaggcgctcaaatgaaggcgtcaggatggtgccatgcattaatttgtgatgttgtctgctgcaggcacgaattccatccatacggttaacttaaacttcgtctggtgtacgcaggttggttactgcaatacgttcgccacgcttacgttcacgctcaggctgcatattggcacgataaacgccctgatcaccgaccacccacgacaggggacgacgctctttgccaatcgactcctgcagcagcagtagcgcctgcatataggcttcaggacgcggcgggcagcctgggatataaacgtcaaccggcaggaacttatccacgccctgcacgacagaatagatatcgtacatgccgcctgagttggcacaggcacccatggaaatgacccatttcggctccagcatttgatcgtacaaacgctgaatcaccggggccattttggtaaatggcgtaccggcgatcaccataaagtcagcctgacgtggagaagcacgcataacctcagcaccaaagcgcgccacatcgtgcacggcggtgaaagaggtcgtcatctcaacgtagcagcaggaaagaccaaagttgtacggccacagggaatttttacgtccccagttcaccatgtcgtgcagggcatgttcgagcttgcccatgtaaacgctgcgatgaacgtgctgctccagcggatcgctgacgatttcctgcttttgcagagggtaacggtcgttctcaccaccgtttgggtctatgcgggtgagcgtatagtccatcttattgcctctcttttactgcttgtgaggattggtgtgacttaccgtgggagttttaaccacgattcggcggcgtgcaggcgtccagtccaacgcgccaatgcgcaccagataaaccaagcccgccaggagcaccaaaatgaaaattgcggcttccgcaaagccgatccatccactttcgcggattgaagtcgcccatgcgtataaaaagagagcttctacgtcgaagataacgaagaacatcgccaccaggtagaattttgctgacaagcggaggtgagtatcaccgacagattcaatgccggactcaaaaggtgtgtctttgtaacgggcacgcgctctgccgccaagcagccatcctccggttaacataaacgcacagaggccaaatgcaatgacgataaaaacgacgaatgcccaatgctgagcgatgatttcggtggtagttgacatactctttgcttactcatcaaaagtggcgctggcatcctgctcgggttctggcagcaaactcaccacatcgattcaaagggaaggataaaaaccttacaaattttgctgttactctggaataagcagcaattttatggggttttttactcctttctataaccttttgtcaacttagacaaaagtatccaaactttattttacacctgcatcatattattaacatatgatgcgcgtgtttccagctaaatcgcttcagtctgtaagggtaattttagtgtagcgggtatttgcgcgcatggatcgtgcatttaacccccatattttgacaggattttcaggcttttccttccctttggaatggctattttgttgatccagaacacagaattatcttttttgtgttaaatttcagcagttatcagactgattcgaatcaactatttcacattttacaggcgtccttctctcacgtccgctcgattgcgggtggctgacagcaagtaaagacaacccctcgaaaatcggttttattgcgcaagaaaaagcctaaaaaaaagccccctgtcctttttacaggacaagaggcgtatttacagaggttatcgtgctgctaaattgcgcattttttgcaaaagaatgcggtatttactcttcatcatccagcaacaatgtgccatcggcattggccaccatgttgtaaggatcgtgcgtagactgcatagcattaaagatcgccagcgccagctcgttatcactgtcagcattgcgacacagcaggtattgcgtatcaggtaataccggtaagccttcagctgcacccatgacacgtaattccgggctcatcatttctaccggacgcgccgttacacctaatcctgctttcaccgcagcgcgcacggccgccagggttgatgcaacgtaggagatacgccacggaataccggcttcattaagatggtcaatcgccatatcgcggtacgggcttggctcatcgagtaataccaacggaatcgcttccccacgctggaacacgtaatccgccgcgcagtaccacaaggtcggcgacgtgcgcaggacctggtgagtaaagttacccgggctggaggtcgtgacaactaaatcgacttcgccctggttcagcatttccatcataaagggattgcgtttcacgcgaacatcaatcgccagttttggatagacagaggtcacgcggtttaacaggaatggcagaatggtgtcggacgtatcgtcagaagcgccaatcgtcagtacgccctggatgttgctgtacatcagggaagtacaggcttcatcgttaaaacgcaggattttcctggcatagcccagaagctgaataccgtgttctgttaacaacttgttgcggccatgtctggcaaacaactctttaccaaccagttgttccagacgttgcatctgctgacttactgccgattgcgttctgcacaccgcagcagcggcggctgcaaaggtgttcaaatcagcaacagcaacaaaagttcggagcagatcgagatcgagattgagtatcggacgatttgcattagtcatgtttttttcttcacttattagatttttaagaactactatcctggtgttattacatgcttatcaaagcgataagcggtaatgatgcttcatggcgtcccggcaaagggccgacataaaatttacttacggaggaagacggaacttccctgcaaaacaaggaaaccggctcctgaagacagagacaacttctgtgccgaaggcacgggatgcaaaaatgcgggaagctgtgtagttgtcttttttctacccccaaaatgcggttaagcaggggtaaacaggtctggaatacgctaacggtgtgtagcgtttaatctcatcaaatagtaaattatacttaatcatttttgaccgcaaaatggaaatgtttttatgaaaagcattgcatattttgatcaaatcgcatcttacattcatccttgtccctcctgagcggacgtaacctgccggaaaacagtaaatacgacttttcattgtcgaaacatgcattgaagatgctctgcattatttctgtcggtcttaataatcgttaaaaaaaccttagatataaatgcgttaacatcaagagcaaccgttgtttttcaggttactctgattaactgcggtcaaagccgcgcaaattttatgcattaataaagcataattaaactatttcgctcatgacgcattgcgcagactcagattgtgtcacggccttcaggttcattatcggcataataaaagcagacattacccagcgctcaatttttactcacagaacaataaaccaggaaagccttataaaccaaacgtttcaaccggactgcatgataaccaatatgcattacgtcgtctgcccgaagacaaagatgctgaacacgccaaaaccgtttcttgcccttcttttgtaggcctgaggagagtacattgtgcaggtttgttttcagcggcaggcaaaaggattctgcacattaaggcggccacaatgacttttcaaattgataaatccggcaaactggacaatgtctgttacgacattcgtgggccggttttaaaagaggctaaacgccttgaagaagaaggtaataaagttcttaagttgaacatcggcaatccggcaccttttggtttcgaagcgccggatgagattcttgttgatgtcatccgcaacctccccagtgcgcaggggtactgtgattccaaagggctgtattctgcccgcaaagccattatgcagcactaccaggcgcgcgatatgcgcgacgttacggtcgaagacatttacatcggtaatggtgtgtctgaactgatcgtccaggctatgcaggcgttactgaacagcggtgatgaaatgctggtgcctgcgcccgactatccgttgtggaccgccgccgtgtccctgtcgagcggcaaggccgtgcactatctgtgtgatgaatccgcaggctggttcccggatcttgatgatatccgcagtaaaatcacgccacgcacccgtggcattgtgattatcaatcccaataaccccaccggtgcggtttacagcaaagagctgttaatggaagtggttgagattgcccgtcagcataacctgattatttttgctgacgaaatctacgacaaaattctgtacgacgcggcacagcaccactctatcgctgcgctggcaccggatttactgactgtcacctttaatggcctgtctaaaacctaccgcgtggcgggtttccgccagggctggatggtgctgaacggacctaaaaagcatgcgaaaggctatatcgaaggcctggaaatgctggcatccatgcgcctgtgtgccaatgtaccggcgcagcacgcgattcagactgcgctgggtggctaccaaagcattagcgaattcattgtgcccggtggacggctctacgagcagcgccaacgtgcctgggaactgatcaacgagatccccggcgtcagctgtgtgaagccgcagggcgcgctctacatgttcccgcgtattgatgctaaaaaattcaatattcacgacgatcagaaaatggtgctggatttcctgttgcaggagaaggtcctgctggtacagggaacggcgtttaactggccgtggcccgatcacctgcgaatcgtcacgctgccacgcgttgacgatctggagatggcgatcaataagtttggccgtttcctgcagggctaccgtcagtagtcctgttgcgcctatactgatgtgatgtcggggagagctcgcctctcccctgttgcaaacaggaaccaccatgactcaaagccatttcttcgcccacctttcccgtctcaaactgatcaaccgctggccgctgatgcgtaacgtacgcaccgaaaacgtctcggaacacagtttgcaggtggcgatggttgcccatgccctggccgccattaagaacaagaagttcaatggcaatctcaatgccgagcgcatcgctatgatggcgctgtatcacgatgccagtgaagtgctgaccggcgatttaccgacaccggtgaagtactacaacgcgcagatagcccacgaatacaaaaagattgaaaagattgcgcagcagaagttgattgagatgctgccggaagagctgcaggatatttaccgcccgctgattgatgagcacctgcacagtgaagaagagaaagccgtggtgaagcaggccgatgcactttgcgcatacgtaaaatgccttgaagagctgtcggccggcaacaatgaatttttattagcaaaggcgcggctggaaaaaaccctgagccaacgtcactcacccgaaatgagctatttcgtcgaggtgtttattcccagctttagcctgtctctggatgaaatttcgcaggattcgccgctctgatacgggcggcttcacgccgccacgttctgcttagtctttactgtgaaaaacaaacttgcccgttgtctgtcgggtgaccaccagcgatgtcagtgaggtcaggcgcagcgccacctcatcgatgcgcggtgtatcatctggcgcattggcggcaatgacagcacagcctgccgccaatcctgacaccacaccggcaggcgcgtcttcgaccacgacacagtcggccggagagagtttcagcatttttgccccaagtaagtaaggatcaggttccggtttgccctttgccacctgctcagccgtaataaacacggcaggctgcggtaatcctgctgctttatggcgcgcatgtgccaccggcacggaacctgaggtgacaatcgcccaggggatctgcaacgcatccagttgcgtgagcagcgcttttgcgcctggcagcgcctgcacgccgtcggtgtcttctgcttctgttttttccagcgccagaaactcagcctgtatcgcttcttctgactggcccgacatgaagtggcgcagtgaagtaatagcctgcttaccgtgaatgaagtccagaatttcatcagccgcaatgccatgacgtgcaccccagttgctccaggcgcgttctaccgccggtagtgaatcaactaaggtgccatctaaatcaaataaaaaaccactgtactccacgcgtcactcctcatcaggcgttaatgatttgcgcaatctcgtttacgcttaaatggtattggcgaggacaagtctgccacaaagccagcatccgttgatacttttcccacatcggcgtttgcgcattaaagccgtgcgtgccggcatcaaaatgggtatagcacccttcggtattcaccataaaacgcacgtagcccagataacgcgattccgtggcggcatcaaaacccaggaacgccagacgtcgtggatcgatgtcgccttcggctttaaggtttgaccaggaaacctgcagcgcatggtgcatctccataatgtcgatgagcgtgcggcaggtttcttcgggtagtttgccaaattctttatccagttcacgcatctgcaggccgtaaccacgctcaatgatggtttggtagcgacgaaaacgttcggcgttctccggctccagcatcgccatgattttgtactggtttgtcaggatcaaacgttgtgcatgggtcatttccatcatctcttcctcaagcccgctggctgttcaggttttatacgatggaaagataattacacaggggaaacgatgtgggcgttgccacatcgcttttcattgatttaagcgcgggtttgggtgcaataatttgccgcacggcgcagattaaagatcgtccagaaatgtccgatccagttgcttgaaggcacgcttaagcagatcggccagcgcctggtatgtgggtttcccctcaaccggggcaatcgcctgccctgcggcttccagtttcgtgcgcacctcgtgaaaccagcgcagcagcgtgggcggcaatggcgtgaccgaacgcttacctaaccaccataaaccctgcatgggcaaactgcaggcgaacagggccgtcgcgaccgctgggccaagttggccacccatcgcgatttgccacgttaacgtaaagaccgccagcggcggcataaagcgaattgaaaaccgtgtcgccgaagagacacgattttcaggaaagactggcgccaggcgtttatcgttgggccaggtcttcatataatgctgtccgcgttgaaacatccggaaccagccggtgtgggattcattcgccatggctcgcctcaactaatgctgtattttttgaaaaataattataacgacacaactttacgtaacatccttcaaatgtttttgtctttaaaggtgactccggctattctgtcgccgatttaacaacgtccctgccgcaactttccttgtaacagagacgacaaggcccgttttaagcgaattttcaaatttatgcgtaaaaactcaattttttttgcgtaaaaacgcactattttgacctgggtatgacttctgtcattaatctggctgcttcaatgggctacgctgtaagtctgattgcgttatttttagccacttttaacaaataggtacttccatgtcgagtaagttagtactggttctgaactgcggcagctcttcccttaagtttgccatccttaatcccaccagcggtgaagaattcctgtctggcctggcagaatgcttccaccttcccgaagcgcggattaaatggaaacttgagggccagaagcaggaagcccctctgggtgctggcgctgcccacagcgaagcgctgaatttcattgttaaaacaattctggcacaaaaaccagagctttcagcacaaatcgcagcaataggtcaccgtattgttcacggcggcgaaaaactcacgcagtcagtggtcatttctcagtctgtcgtgcagggtatcaaagatgcgtcatcttttgcaccactgcataacccagccggcctgatcggtattgatgaagccatgaaaaacttcccgcatttgtccgacaagaatgtggcggttttcgacacggctttccatcagacaatgccggaagagtcctatctttatgcgctgccgtatgcgctttataaagaacatggcgttcgtcgctatggcgcgcacggcaccagtcactactatgtgacccacgaagcggcaaaaatgctcaacaagccgctggaaacgctgaacattattacctgtcacctcggtaacggtgggtctgtttctgccattcgcaacggcgaatgtgtggatacttcgatgggcctgacaccgctggaaggcctggtgatgggtacccgcagtggcgacatcgatcccgcgattattttcttcctgcacgacaccttaggcatgagcgttgacgccatcaacaaaatgttgaccaaagagtccggcctgttagggctcaccgaagtcaccagcgactgccgttatgtcgaagataactatgcaacgaaagcggatgccaaacgcgcgatggatgtcttctgccatcgtcttgccaaatacattggcagctatacggcgctgatggacggccgtcttgatggtgtgatctttaccggtggtatcggcgaaaatgcggcaatggtgcgcgagctgaccttaaataaactggcgctgcttggctttgaggttgaccacgaccgcaacctggcggcacgctttggcaagtcaggttttatcaataaagaaggcacccgcccggctgtggtgattccgactaacgaagagttagtgattgcccgcgacgccgcacgtcttaccgcctgatctcctttcgccgtcagcccatgctgacggcgttgttttgacacccagtgaaatctgagaggttcaatcgtgtcacgtacaattatgctcattccgaccggcaccagcgtcggtctgaccagcgttagccttggcgtcattcgtgccatggaacgtaaaggcgttcgactgagcgttttcaaacccattgctcaaccgcgtgcgggcggcaatgcaccagaccagaccaccagcattgtgcgcaagagttcaggcattccggccgcagagccgttgccaatgtcccgcgtggaatcgctgttggggtcaaatcagcaagatgtgctgatggaagagattattgcccgctaccacgccaatacccagaatgctgaagtggtcctggtcgagggcttagtccccacgcgcaagcaccagtttgccaacgccctgaactatgaaatcgccaaaacgttaaacgctgaaatcgtctttgtgaccgcgctgggtaacgattcgcctgcacagcttaaagagcgtattgaactgacgcaaagcagctttggcgggtcaaagaataaaaacatcactggcgtgatcattaacaaactgaacgcgccggtcgacgaacagggccgcacgcgccccgacctgtcagaaattttcgatgattcgtcaaaggccagcattgccaacatcaatcctgaccagctgtttgccaatagcccactgcccatcctgggttgtgtgccctggagcttcgacctgattgccacccgcgccattgatatgtgccgccaccttaacgcccgggtcattaacgaaggtgaacttcagacgcgccgcgtaaaatcagtgacgttctgcgcacgcagcattccgcacatgcttgagcacttccgtccaggctcgctgctggtcacctctgccgaccgtcctgatgtgctggttgctgcctgcctggcggcaatgaacggtattgagattggtgccatcctcttaaccggtaactatgaaattgatgagcgcatcgccaaactgtgcgaacgtgccttccagaccggcctgccggtatttatggtgaaaaccaacacctggcaaacctcgctcagcctgcaaagcttcaaccttgaagtgcccgtagacgacacgcagcgtattgagaaagtccaggagtacgttgccagctacatcaatgctgactgggttgaatccctgacggccacgtctgaacgcagccgtcgcctgtcaccgccggcgttccgctatcagttgaccgaactggcacgcaaggcaggcaaacgcattgtgctgccggaaggggatgaaccccgcaccgtcaaagcggcagccatctgcgccgagcgcggcatcgcgacctgtgtcctgttaggcaatccggatgaaatccagcgcgttgcggcagctcagggcgttgagctgggcaaagggattgagattgttgatcccgaagtggttcgccagaactacgttccacgtctggtcgaactgcgtaaaagcaaaggcatgaccgaagtggttgctcaggaacagctggaagataacgtggtgctgggcaccatgatgctggaaagtggtgaagtcgacgggctggtctccggcgcagtgcataccactgcaaacaccatccgtccgccgttacagctgatcaaaaccgcacccaacagttcgctggtctcatcggtgttctttatgctgcttccggagcaggtgctggtctacggcgactgcgcgatcaacccggaccccaccgctgaacagctggcagaaattgccattcagtccgccgattccgccaaagccttcggcatcgatccgcgcgtcgcgatgatctcctactcaaccggtaactcaggtgcaggtagcgacgtggagaaagtacgcgaagcaacgcgacttgcccaggaaaaacgtccagatctggtgattgatggtccgttgcagtatgacgcggcgattatggaagacgtggcaaaatccaaagcccccaactcgcaggttgccggtcgcgcaacggtgtttattttcccggatctcaataccggtaataccacctataaagcggtacagcgttcagctgacctgatttcaatcgggccaatgctgcagggcatgcgtaaaccggtcaacgacctgtcacgtggcgcgctggtggatgacatcgtctacaccatcgccctgacggcgattcagtcgcagcaggctgaaggctaagtttccatggctgaataagagcatgcagactgcatgctcttttttttgcctattgcagcgtaacgtcaagcgcgcgcaggtgctgaggctgccaggacagtctcacttcactgccggctttccagtcgggtgatacctcagatgcggccattttcaccataaaattcccctgcccggcaacctcagtgagcattctcacgtgatcccccagatagataaactgctgtatcctggcctgaacagactgttcgcccggtttggcggcgttcacattgatgcgttctgggcgaatactgagctgtatttttttaccaggcgagctcgggcgcaccttcagcgcatccagctgaacaccgttatccagcgtcacctgataataatcgccatgctgtcccgactgcgtggccaacaggctgttattttcgccgataaactgcgccacaaaggcgttatcgggctgctcataaagtttatgcgggctgtccatctgctggatcattccatcattgaagaccgccacccggtctgacatggtcatggcttcactctggtcatgcgtgacatagacaatggtcagtccgagcatactgtggagctgcttaatctccatctgcatgtgctcgcgcagttgtttatccagcgcgcctagcggctcatccatcaggatcagtttgggttcaaagaccagcgcccgcgccagggccacacgctgctgctgccccccagacatctgcgcgggatagcggtctgccagcgaagtgagtttaatcatatccagcacccgcttaacccgcacactgatatcggctttgctcaaacggcgaatcgacaacggaaacgccagattttccgccaccgtcatgtggggaaaaagcgcatagttttggaataccataccgatatcacgttgatgcggcggcaaggtgtgaaggggtttatcacgcagcaggatctcaccatcggtgggcgtttcaaatccggccagcatcatcaggctggtggttttcccggagccagatggccctaacagggtcaaaaactccccttctgccacatccagattgaggttgcgcaccaccagcttgtcgccgtcgtagctctttttgatgttgcgaaaactgacaaaatttctcatggcgtactctcgtaaacaggataaaaaaggtgtcggcacgattcatgcatcatccttttgacgtgcgaattctggcgggcctttttttagcactaccacaacgcctttgatttgcacaagcagaatttgacaacaggaaatgaaacggcttacaaaatcactttgcaggccattgtattttattgtctttttatatttaacattaattcaacgtgagattgctcacagaatcaggcaatccaggatgatgcacgctgatggtgcctcagggcgaaactgaggcaatttgcagatgatgttccaaccgggcaaggacaggcgcaaaggcggcggggatatctgcctcgttaacgcaggcgtagcccagcagcaagcctcgctgcggcgtcccttgcaggtagtaggatgaaagcggacgcgttaacacaccgcactgttctaactctgcgctgaaggccacatcgtcgatgctgtcgggcagcctgagcaccagatgcaaacctgcattgctgtggtgcacaatccagtcagcgcccagcgaggtgctaatcacctccaccagcacggcccggcgacggctgtaaatctgccgcatgcgccgaacgtgggccgcatagtgcccttcccgaataaactccgccagggtgagctgcaccaggccgtagccgccacgatacagctctgagtgtgccattttcatgcgtgcggccatggatttaggcaccaccatgtagctgagccggatgcccgggtacagcgttttgctgaaggtgcccagatagatcaccggtgcatccgccgccaggccctgtagcgccgggatcgggctaccggtaaagcgaaactcgccatcgtagtcatcttccaccacccaactgccgctgcttttcgcgcgctccagtaattcatggcgccgttgcagactcatcaccgcacccagtgggtactggtgggaaggtgtcacacagatcaggcgcggtaccgggctgtccggttgctcagggggcaaaaccagcccctggtcgtcaacctgagtgggaatcagcgtcaccccattcaccgccagcacattacgaattccccagtatcccggctcttccacgatagccctgtcaccgggatcgcagagcattttcgccagcagatccagcgactgatgcgttccggcggtgaccaggatctgctcggggctgcagttcaccgatcggatcacccgcaggtaatcggccagcgcctgttgtaactcgacgcagccgccgtggctggcatagctcagattctcaaccggcagccgccggctgaggcgaagctgtatttttcgccagatgtcgtgcggcatatggctgacgtccggtacgccgggcatgaacgcgccccactgatggctcccggcaccgctgttcgccagcagacgtgaaccccgtcgcgacagccggacgggtttcatcggcggcgttaccggcctgaccagcggctctcccggtgcctgttccggtaataccgcactgacgaaggtgccgcttccggtacgggtttgtaagtaaccctcagactgaagctgttcataaactgccagcacggtgttacgtgagactgcgagttcacgagcaaggtcgcggctggcgggcagtcgcgtcgcggtggcaatggctccatcctgaatggctgcctgcaagacatcatacaatcgcttattcagcgtaccgccggaaagcgaggccagacgttgtgcaagcaggtcaccgagtaagcttcgcaaaattggtacctcaaaataaaaaaaactggctctggattataaaaccctgaaaacgctaaaaagcaaggaggcagattccactgtaacaatatggcaacaaacaccatgaggtcgcgttatgagtaacagtgaagttcaggttcgtcgtctcaatgctacgccgcgcggtgtgggcgtgatgtgcgatttctatgcggtgaaagcagaaaacgccacgttatgggatcatcagggacgcgaaattatcgatttcagcgcaggcattgccgtgctgaataccggacatcgccatcccaaagtcatcgccgccatcaaagaacagctcgaccattttacccataccgcgtttcaggtcgtgccctacgaaaactacatcgccctggcagaaaaactgaatgcgctggtgccggtgaatgggcccgccaaaaccacttttttctccaccggagcggaggccgttgagaatgcggtgaaaattgcacgcgccgccacgggccgtcctggcgttatcgcctttacgggggctttccacggtcgcaccaacatgacgatgtcgctgaccggcaaagtggtcccgtataaaaccggttttggcccttttgccagttcagtatttcacgcccgctacccgaatgcactgcatggctgcagcgtggatgatgcactggaaagtttgcaggccattttccgctgcgatatcagcccgcaacaggtggcggccattatctatgaaccgattcagggtgaaggcggctttaatgtggcaccgcccgccttcgtcaccgctctgcgtaagctgtgcgatcagcatggcattttgctcatcgccgatgagattcaaagtggcttcgcccgcaccggcaagctgtttgccagtgagtactatcccgacgtgcagccagacctgatcacaatggcaaaaagcctggcgggcggtatgccgctgtcggcggtatcaggacgggctgaggtgatggatgcgccgctgcccggcggtctgggcggcacctacgccggcagcccaccggccattgccgccgcgctggccgtgcttgaggtgattcgcgatgagaacctcagcgagcgagccctgcaactgggtggacaactggttgaaaccctgcaaggtgcaggctgtaaagcgctggcagaggtgcgcggtcatggttcaatgatcgccgctgaattcatggatggcgcaggcaagccgagtgcggacatcgccaaagcgattcagcaacaggcgctggacgaggggctgctgctgctcacctgcggcgtgcacggcaacgtgatccgcttcctctacccgctcaccatcccggacgcgcagttccgcacggcactgaacctgctgaaccgtattctgggcaagtattgagtttcgcgtactgccacgccgcccgttccgcagcgtggcagtaccctggcattaagattgcaaagcaaacaccgggcagagaattctgcccaaatataataattcaggagtccggggatgatgaaaaatatagcggcactggttctggcggcggtggctgtccaggcgcaggccgaaaaccttacggtggtttctttcggtggcaccaacaaagacgcgcaggataaagcgttttataagccttttatggcctcaggtcatgacggcatagaagcgggtgaatataacggtgagatggcacgcatccgtgccatggtcgaaaccaaacaggtcggctgggacgtggtcgagctcgaaaccccggaactggaacgtggttgtgaagaagggctgcttgaaacgctggactggagcaagctgggtaacaaagccgactttgccaagggcagcgtaagcgaatgtggcgcaggcttcttcgtctggtctaccgtactgacctacgatggcaacaagctaaaaacggccccaaccagttgggcggatttttgggacgtgaaaaaattcccgggcaaacgcgccttgcgtaagagcgcgaaatacacgctggaaattgcgctgatggcggatggcgtgaagcgcgaagacgtttataacgtgctggcaaccccggcgggcgtggatcgtgcttttaagaagctggatcagctcaagccgaacattcagtggtgggaatcgggcgcacagcccctgcagtggctggtttcaggcgacgtaacgctggcgtcggcctataacggtcgcatcggcaccgcccaggcagaaggccataactttaaaatcgtctgggatggcaacctgtatgacttcgacaactgggccattgtgaaaggctcaaaacacaaagcgctggcggaaaagtttattgccttcacgctgaaacccgaaaaccaaaaggtctatgccgaaaatattccttatggccctgccaatatccaggctggcaagctgctggctgccgatcgtttagcccaactgcccaccgcgcctgacaatatggccaaggcggttcaggttaacgcgacgttctggctggaacatggtgaagaactggaacagcgttttaacgcctgggccgcgaaataaccctctgccggacccgctccggcagcaccattgaggaggtcggcatgagtcaaaaccccgttatggattcagcgcccgtcagacgcacggaaggcgcattcagtctgcgtcacaaattcaaccgggctggttggatcaaaacgcaacgctccctgcttttagttgcccctttactgattttcgtcgtggtgtgttttttatttcccatcggctcgattctcagtatgagcgtgaataaccctgagcttaaagacgggctcccgcaaaccagccaggccttaaccaagtgggatggcaaggcgctgccggatgaaagcctgtttgccactatggcaaaagaagtcagcgcggcgcgtgaacagggccagatttccggcattgctaagcggttaagttatgaagacagcacctttcgtcggctgatcctggccgtccctcgccaggctcccgaggatggccttaacgtcaaacaaacgttgatcgacaagcagccgatgtggggagagctgtccacctggcaaaccctgaaacgcgtcgccaaaccttataccagttattatctgctgtcggtgtttgaccataaggtcgatgccaagaccggcgatatcacaccacagtcgcccgatcaggcgctttatgtcaatgttctgctacgcaccttgtggatggcgaccgtcgtcaccttattgtgcgtcggcctgggctatccgctggcttactggctggcgaaacagccgtctaaccgggccaacctgctgatgattatggtgctgctgcccttctggacctcattaattgtgcgtaccgcgagctggattgtgctgctgcagtctggaggattaattaaccggaccttaatggcaacaggtctcatcgacagcccgctcacgctggtgtttaaccgggtcggcgtctacatctcaatgacacatattctactgcccttcatcgtgctgcctctgtatgcggtaatgaaaggcatttcccccagctatgtccgtgctgccgtgtcgctgggtgcgcatccctttgtggccttctggcgcgtctatgtgccacagacgtttgccgggattaccgcaggtgcgctgctggtgttcatgatggcgattggctactacgtgacacctgccctgttaggcgggccggacgatcagatggtcagctactttgtcgccttctttaccaacagcaccatgaactggggcatggccgccgccttaggcagccagttgctgattatcgtgacgttgctgtatgtggtgtattcacgtgtcacccggacttcatccgaagttgcggtgcgttaaggagcgaatgatgagacaacaaggttcaacgttgctgcgggtctggcgctacctgtttaatttctacggcgcagcggcactgctgtttttgattgtgcctgttctggtcatcgtgccgctgtcatttaacgaaagttcgtttctgagctatccgctaagtggcttttcgctgcgctggtatgcggccttttttcactcgaaggagtggatcggtgcgctaatgaacagcctgctggttgcgccactggcgacgctgttggccagcgtcctcggcgtgctggccgctatgggcctggtacgcggtgagtttcgcggaaaagccctggtgatggcgatcattatctctccgatggttgcgcccgtagtgatcatcgccgttggcatgtttttcttcttcgccaaactgtcactgctgaacagctatcttgggctggtactggcccatgcgctgctgggcgtgccctttgtggtgatcacggtggttgccgtgctgaaaagttacgacacaaatctgacgcgggccgccgccagcctcggtgcctcgccgctgctggcgtttcgtaaagtcaccctgccgctgattgcacccggcgtattttccggcgcgttattcgcgtttgcgacctcatttgatgaagtggtcgtgacgctattccttgccagcccaacgcagcggacattgccgattcagatgtttgccggtatccgcgaaaatctcgaccccaccattgcagcggccgccactatcatgattgcggcttcgcttttattactgatcgtgatggaagtgctgcggcggcgcggggaaaagatgcgccaggcgcaaccggcttagatcaccctcagtataagggtgcgcattgtaccaccgcccacgcggttaaccggtggccggtggtacgatctggacagtgcgcatcctgccgctgtcagcctgacaggcgcacagtcacagcaagcgctaaaccggccctgcgccttgtcatcgtccggtgaaggtgaaccgcaccgttgacccacaaccgctttcctgttctgacaggccgactagcataaatcccctgcccgttccttgcgcgcaaggtgaatggacggcgtggccatgacaacgcgactgatggctaaaagaaagggagctgataatcaggcgggaatgcgacggcgattaaaacagaggactagctttgcgaacggccatgaccgcgcgcaaagctaacagaaggtatcagtgattgttttcgttgttacgactcagccataaagataaggctttaagcgaatcatcggtaaactcatcacagcgcgcggtgatttcatccggggtcatccagaagatttcatccacctcttcttcctgcatggcaaaggggccgtgcgacacgcaactgaataagccgccccagacgcggcaatgctcatcttcaaagtagaatttgccatgttctgcaaagggaacatccgcaatgcccagctcttcttcggcttcgcgtcgcgcagattccagcatgtcctcgccactctgcaccacgccaccggcagttgcatccagtttacccggcataaaatctttgatttcagtacggcgctgaaccagtattttgcccataccgtcatgaaccacgatataggttgcgcggtgacgtaagcattgcgcgcgcatctgcgcacgcgtagcctgtgcaacgacttcattctcttcgcttacgatatcgacccattcgatttcgccaccagcaatgtgatccaccatccgtaaccctttcctgtttagcgtgtctttatgcacgcgctgtttgccacgtttttatcagtcgtaaggtaatcacttatgacgggttgagcaagcgccgatcgctagcgatttttgccgctttccgctaaccataactggactgatgctcgctgccattgaaactcggcataatgttgtaaacgcgcaggcaacgtatcaccatgcagcgccagtcgattaagcatgacagccaaatcggtatctgcaatgcaccactcaccaaataaattttgctgccgctccggtaacaggcgctgtacggcggcgatcagtttatccgccgcttccagtgccgctggcgacaacggcgcaaagtgctctcccgcaaacaacacctcggtaggacgctcctgccgaatcggcatcagatcgctgcgtagccaggcctgaatttgccgggcgcgcgcacgtttctcgcgatctttgggataaagacgttcgtactcgggggcggcaaaacgctcctcaaggtattcgcagatcgccgaggattcactcagcataaagtcatcgacctgtaaggtcggcacacggcaggttaacgacagatcgcggtaggtttccgcacgctgctgattttgcgataaatcgagacgctttacgctaaaaggcacccctttttcgctgagcgcaacataagccgacatgacataaggactaaagaaagatgaatctgaccacagggtgatggaagggtaattcatctgctacctcgaatggctaaaaggggtgcctcatgtttaccgacttttatttctgaaaacaaccaggcgctggtccgatgtttggggtcaactcgctaaattacgaagcggctcacgccacacgggtacgactcttctatgatgaagtaagcaaaaaataaaaaatcagacggagccgcactatgcatatcttaatcaccggtggaaccgggcttattggccgccatcttatcccacgtttacaacacttcggtcacgaggttagcgtggtcacccgcgacgtggccgccgcacgagaaaagctgggggaggatatcgcgctctggtcaggcctggcgcaacagcagtcgcttgacggcatcgatgccgtcattaacctggccggcgaacccatcgctgacaaacgctggaccgatgcgcataaacagcagttgtgcgagagccgctggcaaatcacggaacgcatcgcctcactgatcaatgccagcaccacaccaccgcgcgtcttcatttcgggatcggcgacgggcttttatggcaacagtggcgacgtcgtattaaccgaggatgatcccggccaaaatgagtttacccacgagctgtgtgcccgctgggagcagttggcgctgaccgctcaaacagagcgcacgcgcgtctgcctgctgcgaaccggcgtggtgctggcgcgcgagggcggcgcgctgagtaaaatgaaactgccgtttaaactgggtatcggcggccctatcggcagcggcaaacagtatatgccgtggattcatattgatgacatggtcaatggcattatgtggttgctggacaatgacgactgcagcggcccctttaacatggtttcgccctatgccgtgcgcaatgagcagtttgccgccacgctgggcgaggtaatgcaccgccctgcttttatgcgcaccccagccagtgccataaaactgatgatgggtgaatcttctgtgctggtgctgggtgggcaacatgtgctgcccaaacgactggaggcgtcgggttttcgcttccgctggtatgagcttcaggatgcgttacaggacgtggtaaaaaactgagcgacagaggggagcatggcgctcccctgtcgtttactgcgacgtgacggcgggttttgacttcaccctacgcagcgcgccgtgattcggttgcgggacgcgaatgataaacgtcagcacaccggcaaacacatacagaccggtgtacgcccagaccacgccgacgatatcaaaaaacggcagcatcaccgaggcgatagcgggcgcgacaaaattgctcataccggcagacaggttatataccgaaacggccgcgccctgatgatgcggctccagcgtggggaaaaccgccgtcatcggcacaaaggccgcaacgaaaatccccagcatcacggcgggaataagggcgaccaggaagttgtgaccggcatagacaggcaggtagtagaacgccaggctggaaacggccattcccaggcagccaaaccagcgtacctggcgaatccagccaatacgttcgcccatgatgccccagaaaatattggtaaagatggttacaaagaagaacaccgcccaaatttgtagccactccgacagggtaaacccaaggcggtccacaaacagcagcggcatgatgatggcaaagccaaacagcgacagtgtgttaatgatgcggataaggcaggcataaaacacatgctggttggtgaacaggatggtcaccgctcgcgacatctccgtcattttttcccgcagaggcaagttgacgcgagaacgatcgaccggcacgttgcgcaggctaaagtacgccagcaagccgccgcaggtgacccagccaatcgccagccataatgtgccggtttcaccaacggaagggataatcaggcttggcagatagcttcccactacgccgatccccactgaatacatcgcccagaaccagcccgtggcggcagccagccgttcccgtggcagtacctgcaccagcatcatcatgaatgagtagataaacagcggataggccaaaccacgaataccatagaacaacaccatgagcggataattacgcatccccagccccaggctcataaacagggcatgcatgaccacccacaaaataaaaccaatcagcatggcgcgctgcggggtaatcagctccgccaccacacctgacgcccatgccgccagcgccacggctaaaccgtaaaaggtgaacaccagcgccgactggcctggcgtgaaccccatatcggtaatatggcgtgacaggaaagccatctcgaagccgtcacccgccataaaaacggcaatagccacaaatccccagatcagatgtttgggcaagccaaaccagtacgcagtagagtgcatgacgatggtccttctctgttcggttacaggttattcaggtcagcgagcgaggctgacatggttgacggtagagctcacggcacgcggtaagacggtcaggcggcgctaaagcctctggtcctgggcagacaacgccaggattcggcacgttgaggtacatttgcgcgtccgcacgctcatgacccgccgcattgacgagatgtataacgatggtcagcgccagcaccgcgacgttcaggctgctgcgcgtcacccgcttcatgggctctgctctgcccggtgcggataagatgcggcatgttccgatgccacgctgctgctgtgatttcaccatcggcgcttttagcgctgagcggccaatatccatagccagaacctgtcatctccctacaccacggcaagaggaggttgctctggctggaccaaccatgtttccagcccggccacggtcgtggtcagccgcgcatgaaaatcgtcagacgcggccagctcaccaaacagggaagactggctcatatacgccgtcagcggatcggtgcgggcaaaccactgctgaatcacgtcgggttgcagcacgccatcctgatagtcatagggcagctcgccccgggtccaacgctgcaaaaacagatagaacagcgcgggtagcaccaggctggcggctggcggcgtgccgcgccggtaacattcctgcaaggtcggcgtcaccatcgcgggaatttttgacaggccatccgccgccacacgttggttggtgtctttgatccaggggttactgaagcgagacaacaccacatcccgatagtccgccaggtccagcgggctgggagagagcgagggaatgacatcctgagagacgtattcccaggccatctggtggatggctttctgtcgggtgctttcatcgatgtaaagcaagccgataagggttcccgcccaggcaattgcactgtgggtggcgttcaggatacggattttggcttcttcccagggcagcaccgagtccaccagctcgacgccaacctgctccagcgccggacgtccggcaataaaatcgtcttcaatgacccactgaataaaggattccgccatcaccggcaccgcatcatctttacctgtcgcggcctgaacccgctcagcgacatctgccgtggggcgcggggtgatacggtcaaccatggtatttggcgatgtcgtcttctcgcgtacccactcggccagacgatctgcgcccttcgccgccaggaaagctaaaaagccctggcgaaaacgttcaccgttatgacgcagattgtcgcagttcaacagcgttacgggtgcaccgccgttggcaacacgtgccgtcaggatgcgcaccagcgcgccatacagcgtccgtgcctcgccgttgagatccgcacggatatcgggctgctgcaggtccagttcatgctccggcgttaaatagtaaccggcttcggtcacggtaaacgcgatcacccgggtggccggatcggcaccctgccgcaccagcgcgctgatctctttgtcccacggcagaacctgacgaatcgaggtgatggtttcgtaatcgcgatcgccttctggcgtgaccgtttccagcacatattcgccttgctgcgcggccaactgcgtgagtaacggcgtggcatcatcgcggatatttcccagggcgatatgccaacggctgtcgccctgctgcatcagtcgatgcagataccatgcctgatgagcacgatggaacgagcctgcgccgatatgcatccaaactgacgttgtcatcacgacctctttaagcatttgtttaaccaaagggcatttgcccggatgcacatatgttaatcagaggttacgtcgatgtactgtgattaatttcacatttataacattcgcccagcaaatgcgcttttgcccgaataggcttttcgccgcattgcgcgataaaatggcggttcacagaagatggaatgccggaatgaacaaagaagagaagaaacaggaactcgccgcgcgtgctgcctggatgtattacgtcgcgggcttaacgcagcaggagatcgcccgggcgctgggattgtcgcgccaggttgcccagcgcctgatttcaggggcgcgtgaaatgggaatggtcagcgtgaagatcgatcatcctgtcacgcactgcttgcgtctggcgcacgatgtgcaggaaaaatttggcctgcagcattgtcgcgtcgtgccctccggtggccttgacgacgacgccatacagcagatgctggcggtggaaggtgcagaggtgatgtcacagtttatcaatgacgatcagccgcaggtgtttggcattggatcgggcaaaacgctgcgtgccattatcgatgcgctgccctgggtggaacgccctcagcaccactgtgtttccatgattggcgcgattgcccgtgacgactcgggcacccgctatgacgtgccacttaagctgtctgaaaaaatgcagggcaagtatttcttcatccccgcaccgctgtttgctgacagcccggaagataagcagatgtggtgtcagcatcaggtctatcagcgcgtggtcgatcgtgcactgcaggcgcatgtgacgtttctggggatcggggaagttaaccccggctgcccactgaatgcggaaggctttattactgacagtcaggtgcaagcgctgaatgcgcgcggcgttgtcggggaaatgctcggccacttcttcaatcagcagggcgaacgtgttctgggggagaccgatgcgctgttaaccagcgtgacgctggaaagccagacgacgcgcaatatcatcggctttgccggtggtgagcgaaaatatgctgccattcaggctgcggtgaacggcggctggatatcgggcctggtgaccgacgaaaccaccgccatgcgcctgctgaatgacaggtaactcaactacttcagcgatcccttaaggaactgctgtaagcgtgggcttttcgggttaccgaataattccgtcgggggcccctgctcctcaattttcccctgatgcaggaaaatcacgtggctggaaacgtgacgggcaaattccatttcgtgcgtgaccaccaccatggttttgccctcttcggccagtttctgcatgatgcgcagcacctcaccgaccagttcagggtccagagcagaggtgggctcatcaaacagcagcacttccggctccatcgccagtgcgcgggcaatcgaaacgcgttgctgctgaccaccggacaggtgtacgggatattttccctgcgcccgctcatcaatgccgaccttgttcagataggtaatggcgcgctcgcgtgcttcggctttactcagccccaacacctgaatcggcgcttccatgacgttttccagcacggtcatgtggctccacaggttgaaatgctgaaagaccatcgtcagacgggtacgaagcaggcgcagctgctccttgtctgccacttttaactggccatccgtatcgcgcaccagggtaatggcggtgttgttgaccacaatggcgccttcgctcggtttttcgaggaagttgatacagcgtaaaaaggtacttttccctgaacccgacgagccaataatactgatgacatcgcccgcattggcgtgcaatgacacgccttttaatacttcatgttcaccgtaatgtttatgcaggtcggtgacgcttaatttgttatcagccatagtcttactcaatgcgatgaagaaggtttcacgtgcgccagccaacgacgttccgcaagacgaaacaggctaatcagcacataagaaataatcaggtacaacacggccgcaatgccgaacgcggtaaagggctgataggttgccgcgttaatgtccctggcgattttcagcaaatctggcacggttgcggtaaaagccagagcggttgagtgcagcatcagtatgacttcattgctgtaaaccggtaaggccgtgcgcagcgcagaaggcaaaataatgcagcgatacagtttaaaggtggaaaagccataggcccgcgcggcttcgatttcgccgtgtggcacagcacgaatcgcaccggcgaaaatttccgtggtgtaggcgcaggtattcagggtgaaagccagtaacgtacagttcaggccgctacggaaaaacgcattcagcagctccgtgcctttaacgatttccagcgtatacatgccggagtagaacaccagcagttgcacataaagcggcgtaccgcgaaaaacgtaggtaaagagccacaccggcaggctgataaaacgattcggtgacacgcgcgcaatcgccagcaacaccgccatgcagccgcccagcacgaccgagacaatcagcagccacagggtaatggctacgccggtgaagcgataaccgtctgtccagagcagcgctttccagtattcgtgaagaatctcgatcatagctccgccctcttcacaccgaccgtgtagcgacgattgagccaccagagaatgccgttagacaaggtggtaaagaccagatagatcacaccggctacgatggcaaaataaaatggctgccatgtgcttttgccggccaactgcgtggctttaaccacatcttccagacctaacagggaaaccagtgccgtggctttcaggatcacctgccagttgttaccaatgccgggcagcgcatagcgcatcatcgccggaaacaggattcggcggaaaatctgggaaccggtaaaaccaaacgctgtggctgcttcgatttgcccttttggcaccgccataaaggcaccgcggaaggtttcggtaaaataggcgccgtagataaaccccagcgtaatgatacccgcaaccatgggatcgatatcgaactgggccagtccgagcgcatcggtaaggtgattcagcgcaatctgcagaccgtagaagatcagcagcatcagaacgaggtcgggcacgccacgaatcagcgtcgtgtagccctcaaaaatcagggacagcaggcgattacgcgatagcttcgcgccagcaccaatcagccccaggatcaccgccatcaagactgaactcagcgcgagttcaagcgtgaccagcgtcccttttaaaatgacatcagaatagccatacaacatggaaaaaagtcctgtcgtggggtggaaacgacgcggtgcccgccctacagacgggccgcgttgcttctgttaacacataaacgataacgcacaacgttgccccggccagacaggctggggcaaccagaggcgaatcctgttatgcgaacagcagaagcgaagacgacagatcagtcaccgtacacgttgaaagtaaaatatttcttcgcaattttgtcgtaggtaccgtctttacgaatagattcaaacgctttgtcgatggccgctttcagctcggtatcatctttacgcaatcccatgccggtgccgacgccaaagattttatcgtctttcactgccgggcctgcaaacgcatagctcttgccaaccggctgtttcaggaagccttcggcagcctgaacttcgtcctggaaggcagcatcgatacggccagcggtcagatcctgatacaccagatcctggttagcataaggcgtgacggtcacaccttttggacgccagttctgattagcataggtttcctgggtggtgccctgcagtacgccgatatttttgcctttcagcgactcaggagtgggttcaatttttgcgcctttaggcgccactaaacgcgcattggcggcatagagcttgtcagagaacgcaatttcttcctgacgcttagcggtgatagacagcgaggagatgatggcgtcgattttcttggctttcaaagaggggatcagcgcatcaaagtcgctttctacgtaagtacacttggtctgaatacgtttacagatttcgttagccagatcgatatcaaaaccgaccagctgtccttgcgcgtttttcgactcaaacggcggatatgttgggtcagtgccgacacgaatcgaggtcggtactgctgcaaatacgctggccgcactggacaggcccaacattaaagaaagagccagaacacgcttcttcatagattaccctcaagtaaaatgcttattgttatgtggtgcatgatgtgtgtttgcgactaacactgccttttcctgtgcatgtttcatgccaggtctgcagcgttaccgcctgcccagccagccgtttagccacgaaaaggctgggtttgtgaatggaatatatcagtgatgtcgcagagaaaaagcgatgttgtgaacttttagttcaggaaatgcaggaacagtgatcgctcccgcgtttctgcaccaaagaagtgcggaagaagaaacttatgcaccttgccagcgcacaaataaatcctgcggcagttcaatatcaaactggtcgataacccgattaacggtctgatcgaccagttgatcaatggtggtgggacggtgataaaaggcaggtaccggcggcataatgatggcccccagttcagccgcggtggtcatcatccgcagatgaccaatatgcagcggtgtttcacgcacgcacagcaccagcttgcgctgctctttcagcaccacatccgcggcacgtgtcagcagcgagtcgctgtagctatgcacaataccggacagggttttcatcgagcagggcagaatcaccattcccagcgttttaaacgacccggaggagatgctggcggcaatatcgcgcacatcgtgaaccacatcggccaacgcctggacatcccgcaggctgtagtcgctttccaggctcagcgtctgacgtgctgcctgactgatgatcaggtgcgtttccacatcgctgacctgctgcaaaacctgcaacagccggatgccaaatatcacgccgcttgcgccagaaataccaataatgagtcgtttcatcgttcaaccttgcagtggcaaagcgcaccataatagcgcagaccggcagaaaacacagagggcgggataagtcccgccctcttatttgcattcaggttagcttagccttcgttatgcagctcaagattttccacttcattttgacgggcaatggcttttgcgtcgtcattacgcagggattccagatattcaagatagccctgatcgacgtctttcgtcacataaataccgttgaagacggaacactcgaactgaacgatatccgggttttcttcccgtacggcttcgataaggtcatcaaggtcctgaaaaatcagcgcatccgctttgatgatctggcgaatttcttctacttcacgaccgtgggcaatcagctcggtcgcgcttggcatatcgatgccatagacattgggaaaacgcacttccggtgcggcagacgcaaggtaaacctttttcgcgcccgcttcacgagccatctcgataatctgctcagaggtggtgccgcgcacgatagagtcatcaatcagcaggacgtttttatcgcggaactcggcacggttagcgttgagcttgcggcgaaccgcgctgcggcgcagttgctgacccggcatgataaaggtacggccgacgtagcggtttttaacaaagccctgacggtaaggcttatcaaggattcgcgcgatttccagtgcggtatccattgaggtttccggaatcggaatcaccacgtcgatatccagatcttcccactcgcgggcaatcttctggcccagcttggtgcccatacggacgcgggcactgtagaccgaaatcttatccaggaatgagtccggacgggcaaaatagacgtattcgaacaggcaaggattgtttttagggttttcggcgcactgacgggtagaaagctgcccctgctcagtgatatagaccgcttcacccggtgcaacgtcacggatgaattcaaaacccagggtgtccagcgccacactttcagacgccaccatgtactcggtacggccatcggcaatgacgcgtttgcccagcaccagcggacgaatgccgttaggatcgcggaaggccaccataccgtgaccgataatcatcgccaccacggcatacgcgccacgaacctgctggtgcaccgccgcaatggcggcgaaaacgttgtcggcttccagcggatagtgctgaaaacgatccagttcctgagcaaatatattcagcagaatttcagaatctgaggtggtattcacatgacggcgacccttttcgaacaggcgcttacgcagctcatgtgcattggtcaggttgccgttatgggcaagagaaataccgtacggcgagttgacgtagaacggctgtgcttcagaagcgctggagctgcccgcggtaggatagcgtgcgtgaccaatccccatgttgccttgcaaacgttgcatatgacgcgcttcgaagacgtcgctgaccagaccattcgccttacgcaggcgaaagcagttcagcgcatcgatggtacaaatgcctgcggcatcctgcccacggtgctggagcaccgttaacgcgtcatagatcgactggttgaccggcatgaaaccggtgataccgacaataccgcacatgttgtcatttcctcattaagccgtacgcccggtggcctcaccggggcaaaaaactcgacgtgcttttcaggtagtcaaaaaaccacctgattatagaactgaactcgggaataagttgagactgctgccagtccgggctcttcgaaaagcccgtgaatgtatcaaggaagaacagcaaagcggccacgatgagcacaccacgcaacgccccgaaacaaacgcctaatacccgatcggttcccgacaggccggttttctcaaccagcgagccgataacgtagttcacgattgcccccacaatcagggtcgcgatgaacagcaccgcaatcgcgattccgttacgaaccagttcgtcgtcaaaacctgtgaaccagactgcaaggtaggcatagtaatgactggcgacaaaaaacgcgcatccccaggtaacaagagataaggcttcgcggacaaaccctcgaaccaggctgaccaaagccgaaaaaccaactaccgcaataatgacgtaatcaatccagatcatgaactcttccagcgccagtgccattgcacccctgcttccagttcggggcgcattctaacagaaaaagaaaacgtttgcgtaggggttttcaggttctgcatccataaaaaaggcgatgaaaaaatccgtcttcgcctgtgtcattattaacccattaacaggttgaaaagtggtcgctattcacgcctgagccgcacccggtgtccccgttcccgcggcgaaaggcgctgcctgttaatcttatcggcagcaccaatcagcggtttaacgtgcgctgtaagattttacgacgccgcttaagcccgacacgtttttcagctcagccaccgccgcctgcattttggcttttgaagcgtccggcccgacataaatacgggtgatttgtccctgtaccggcgtggacggcaccgtataagcccggtagcccgacaagcgcaacttcgcgacgatttcattgaccttactggcgttcttcagcgcccccaactgcacgacataggcctgaccggcaggctgagtctctttaggctgctctgctggggcggacttttccgcaggctgcgattgttcggcaggtttggttttttcaaccggccgggttttttccaccggtttgctctgcggcggctctgccgatttaggcttagcctgttcaacctgtttgggtcgggttggctccaccggtttggctttcggggtggtcgtggccgtcgacgaatgaaccggcggcggcgataccacgctcggctcgctgctgtgctctggctgactgctgccctcggcggcgtcagcatcatccgcatcaggatggctgaccacactgcccgcgcccgcaggcggctgcgcaggaagcgactgcgtcaccggcggcaccatttcgctgtcctgctgatcatcgggtttgggcaccagagggatcgcggcaaactcttctttgtaatgctttttcttaccatccagcagccccggcaatacgattacgccgacggctaccagaataacggtaccgactaaacggttttgaaacttactcgccacgtcctttctccgtttcaatcgattccatgacctgcgcgaccgtcaggaaagagccacagaccagaatgatatcctgcggttccgcctgctggcgcgcctgttgccaggcctgttcaacatccgcgaacgcctgagcggaggtcacgtgcgccatgagttgttccgcgctggcaccgcgagggccatcaagcggcgcgcaataccagttgtccacctgaggtgacagcgccgccagcgtgccagcaatatctttatcgtgcagcatgccaacgaccgcatgtacccgacctgactgcggcagcgccgcaagtcgcgaggccagataggctgcggcgtggggattatgggcaacatccaaaattacgcgaggtgattcgctgatcgtctggaaacggccgggcaaaatcgccagcggcaaatgcgcacggattagcgcctcgctgactttcagccctgaagcgcgaagcgccaccagggcggtagccgcgttaggcaacggcacctgaggcagaggcaaatcactcagctcgccttgcgcatcgcgcagtgaccagctttctgcctgctgccggtactgccagtcgcgcccgtgctgcattaacaccgcgcctttttcacgggcgacttcagcaatggtggcgggcatattcggttcaccgacgaccgccggtttagcctggcggaagacaccggctttttcccgaccaatactgttacgatccgggccaagccagtcggtgtggtccagcgcaatactggtaatgaccgcgacgtccgcatcgacaatgttggtcgcatccagccgaccgcccagcccgacttccagaatgaccacatccagctttgcctgcctaaacaggttaagcgccgacagcgtgccaaattcaaaataggtcaaagaaatcgtaccgcgacccgcttcaatgtcggcgaaactggcgctgtgttgggcttcactgagttcctgcccctgaacccggacacgctcggtgtaacgcacaaggtgcggtgagctgtaaaccccgacccgataaccggcggccatcagtagggtttccagagtgcgacaggtggtgcctttgccattcgtgcccgcaacggtaaacacgaagggcgcaggcttaagcaggtccagacgttgcgccaccaggcgaatacgatccaggcccagttctatcgcctgagagtggaggtgttcaagataataaagccacgtggccaaaggcgacgtggcttgaggaaggtgaagattgtccatatgtcccgttttgcaaatttatacccggtgaaagccgcaaggtatacggtgcattggtggaaggcgcgacccgcgcgccttcggtctcctgtcaggcctcgttgctctccgggtcggtcgtcgcaggtgcgaacgcttcaccgtcgtgcagcggtgctggcagattcatcatttttgccagcagactcgccagtttatagcgcatttcaggacgacgaatgatcatatcaatcgcccctttctcaatcagaaactcactacgctggaagcccggcggcagtttttcacgcacggtctgctcaatcacgcgcggaccggcaaagccgatcagggctttaggttcggcgatattcagatcgcccagcatcgcgaagctggcagagacgccgcccatggttggatcggtgaggaccgaaatatacggcagaccccgctcctgcattttcgccagcgcggcgctggttttcgccatttgcatcagcgacattaacgcttcctgcatacgcgccccgccactggcagagaagcagatcattgggcagttatcttccagcgcctgctccaccgcccgcacgaaacgtgcgccaaccacagaacccattgacccgcccataaaggcgaattcaaaggcggctgccacaaccggcataccgtgcagctgacctttcatcacaatcagcgcatctttttcatccgtggctttctgtgcagccaccagacgatctttatactttttggaatcccggaacttcagcaggtccttgggttccagttcgctgcccaactcgaccagcgtgccctgatcgagcaggctcgccaggcgctcacgggcgtgcatgcgcatgtggtggtcgcacttagggcagacctcaagattacgctccagctcggcacgataaagtacctggccacagctgtcgcatttcgtccacactccttccggaatattggcacgacgtgcaggcgtaatgttgcttttattaagaatgcgttcaatccagctcattgatgacctttctgttaaaaactgacctggtccagtcgtctcgatactgctgaaaaccgcttcagcagacggtaaatgtcgctcattaaaccacaaccaattaagactgtggataaaaatctggtcttacccctgagcaatgccgctgctcagggtggattttactgcttagcctggcggcgatgacgccagatttcaatcacacccggcagaatcgataccacgatgatcccgaggataagcagcttaagattttcctgcaccacaggcaaatcgccaaacagataacccgcataggagaacagcagcacccaggccagcgcgccggtgacgttaaacagcgcgaagtggcgataggacatgtgccccattccggcgacgaaaggcgcaaaggtgcgcacgataggcacgaagcgggccagaataatggttttccccccgtgacgggcataaaacgcatgggttttatcgagatagctgcggcggaaaatctttgagtctgggttactgaacagccgttcgccaaacagtttgccaatggtgtagttcacggcatccccgagaatagcggcaatgaccaacagcgccaccatgagatgcacgttgagatcgttacccggcaacgcggccagcgcccctgccacgaacagcagcgaatcccctggcaaaaacggcgtcaccactaatcccgtttcgcagaacaaaatcaggaataaaatggcgtaaatccagatgccatactgcgctactaattcggccagatgcacgtcaatgtgcagaataaaatcgaccacaaaatggatgaactccataacgatcccttgtacgtaaggttaattaatccgcgaggaacaatggccccatcgccggctgtggtaaagcaaaatgcgcgggataatccaccgcaaccagataaagcccttcggctttcgccgtcgccgctgccagggtacggtctttggcggccagcagttcagccatccaggattctgactgatttccacagccaatttccatcagacttccgacaatattgcgcaccatatggtgcacaaaggcattcgctttgatatcgacaatcacataaggcccctgacgcgtgacattaaggtgcatcacattgcgccacggcgttcgcgactggcactgcacggcgcgaaaagacgtaaaatcattctcgcccagcaggcactgaccggcacgctgcatcttttccacatccagaggatagtaaaagtgcgttacaccgttgcccagaatcgccggacgtagccgctgattgtaaatcagataacgatagcgccgggccgtcgcgctaaagcgggcgtgaaagtcatccggcaccgcctttacccaacgcacagcgatatcatcaggcaggttggcgttgacgcctaacgtccaggccgcatcggcacgcggcgccacggtttcaaaatgcaccacctgtccggtgccatggaccccggcatcggtgcggccggcacagaatacgctgaccgtatggtcagccactttcgacagcgcccgctccagcttttcctgcacgctgcgcacttcctgctgacgttgccagccatagtaacggctgccgtcgtactcaatgcccagtgccagtttttttgtctgaccttctgacatcagtacatgtactcctggaccagcttctcagcggtttttacggccatcagtgcgccgccgaaacgaacgttgtccgccactgaccagaactgcaacagctccggaatgccgtaatcattacgcacacagccgatgctcatttcatcggtgccggaggcatccgtgaccggcgtcggcacctcggcctcttcgctcagacgaatatcggccgccagtgcccattctgccctcgcctcttcggccgacagcgggcgcaggttttcaatgtggacaatctgcgcattgccataaaacactggtgcctgaatgctgctgacggcaaccggcaacccgtcgtcctgcaacactttacgcacctgatcgaccaggcgacgctcgctttctacgctgccttcgctgtccgcctgctgcggcagaaggttaaaagccagctggcgaccaaaatggtgctcgtcagcgggcacgccgttcagcaaacgtgcactttcccctgccagcgcatccacggccgctttgccgtgcgtggagacagagatcagattcgtcacctgtaaacggcctaaacctgccgcatcgaccagcggtttaatggccgtcagcagctggctcaccagattatctgccacgctgatgatattgcgattacggtaatccgccagcacctggggattgacgtccggcaccaccagcggcacgtccggtgacagggcaaacagctcactgctgtcgataaccaggcagcctgcactcgccgcttcttctgcatagcgttctgatgcctcgcgaccggcaacaaaaaaggccagttgcgcctgtgaccagtcaaactccgccgcgttttcgacccgaacagaacggccttcgaaacgtttaatttcaccggcaccgttatcgctcgccagcaaatacaattcaccaaccgggaactggcgttgagccagcagttccagtacagcgttccctactgcgcctgttgcgccaagtagcgcaatattccagccgtcagacatgttggtttacctcagacaatgacataaaaacagaaggcggtgatgtcaccgcccggggattcagaattatccctaccttcacccgccgttcacgcaggcggaaccaatcaggttgaggataatatggcgttaaagcccagttgaataagcagatcagcggtggcctgatcatcacagttcacctgtaatgatgaccattcacgacgctcttcatactgtttgcgcaggcggtcaaactcgcccggttttgccgccacttttcgcagtggcgcatcatcgcggcgcacatcatacaccagatgcactaaccgtttcagcgttggctgatcgagcggcccattcagacggatctggctaaattccggcgtcggtaacaggctgtcgagcggcacctgctgcggttgcccaataaagtcgcaccaggcctcgaaaacctgggtggtgccgcgcgctttgccttccagggtataaccggcaatgtgggctgtggcgatatcgaccttatccagcagtgccagggagagatccggctccggctcccagacgtccagcaccacgctcagatcgtggcgcatattcagcacttccagcagcgcggcattatcgactaccgggccgcggcaggcattaatcagaatggtgtcaggcttcagggccatcagccgcgcagcatccgccagatgccagctcttgtaagggccagatttaaacagtggcgtatgaaacgtcaaaatatcggcctgctcaaccagcgtatcgagcgagtgaaaatccccttcgtccccacggtcagcccggggtggatcgcacagcagcgttttcacgccccaggcttccaggcgtttctgcagacggctgcccacgttacccacgccaacaatgcccacggtacgatcgcgcaacaggaaaccgtcgcgttcagccagcagcagcaaggcagaaaaaacatactctacgacggcgatggcgttacaaccgggtgcggcagagaacgcgatgcccgcctgcgccagccaggcttcatcgacgtgatccgtcccggccgtggccgtgcccacaaacctgacaggtttatcctgcagtaacgccgcgttaacctgagtgaccgatcgcaccatcagtccatcagcgtcggctaattgcgcttcgggtaatggcctgccaggtacggcaaccacatcgcccgtacggctaaagagttcacgggcgtagggcatattttcatcgacgagaattttcaccacggctttcctgtgtgttgcatttaagggcgctattctggcacaaaagccccgccttagcctaacctccccatgccgtcgaccataaggctggcagaagcatgtcagacaggcgtaaactgccgcgggtctgaggctggagtcatgctatgttttttctgtttccgctgtttgcggtattgatttggtcggttaacgctatcgttaataaattatcggcgggggcaatcgagcctgcagccatctccttttatcgctggctactggcgttgctggtgttaacgccgtttgtgttacccggcgtgatacggcgctggcaggcaatcaggccgcacctctggcgtttgatggttctgggcctgctgggcatggcgctgtatcaaagtctggcttactatgccgcccacagcgtgagcgccctgtttatgggcattattgcggcgctgattccgctgttaacggtgttgctcagcgtgctgatcctgcggattgcgccgacggtgggcattctggtgggcagcctgatttcgttctgcggcttaatctggctggtcagcgcaggcaaccttcaccagttgctgaatcacggtatcggtgccggagaagcgatgatgctggcggcatccagctgctatgcgctttatggcgtgatgacaaaacgctggtcgattccgttgccggtctggcagagcctttacgtgcaaattgcctttggcgttctgctgttgttacccggctttttgatgacgtcagatgtctcgctcacgccgcgcaatcttcccctggtggcctttgccgggctgtttgcctctattcttgcgccctggctgtggatacatggcgttcaaaagttaggggccagcatcaccagtatttttatgaatctgacaccggtgtttaccgccatcattgcggtgctgtttctgcatgaacatctgcacagctatcactggattggcggcggtctgacgctgacaggcgttctgctggcccagcggctgcgcaggccgttaaccgcgcgcaaaccggttaacaccgatccacattgaactggacggtaacccgtagcccgcccagtaacgggctgcgatccagcgtcacggcagcgccgtgccaggcacaaatatcctggaccagcgccagcccaatgccggcgccggcatgcatagcggcattatccagccggataaaaggctgcagcgctttttgctgctcgtccgggctaatccccggccccgcgtcttcaatttgaagtgttccgctctggaggcgcgcagtgatcatcccttgagaaggggtatatttaatcgcgttatccagcaggttggcacagagttcgcccagcaacagcgcgtcgcctttcacctcactgtgttcatcaccctcataacccagatcaatgtattttgcgcgtgccgcggcataacggctaaagcaggcctcgcggacgatggccgctaaatccacccgcgtcatgggcttatcttccccgtgacgggctttaattcgcgccagttgcagcaggcgatcggtcagcaggatggtgtcatccagcgtatgctgcatgccctgcaggctttcgcgccactgttcaggccggtcgctgtccagcgccgtgctgatctgggttttaaggatggtgagcggggtgcgaagctggtgagcggcatcggcgctgaacctgtcctgccgcgccagtagccctctcagtcgctcaaggtagcgattaaaggcgatgatgagcggctgtaactccgaccacggcagggacggtaacggtgtcagcgccgcgccgttacggcgcagcacgatgcgtgacagacggcgcagcggccgcaatacccggcgcagcatcatgctcgccagtaacagcgtgatgaataccagcgcgctttggctgagtaacgcagtgcgcatcagcccctgagcaaatgcctcacgggagtgaatggtttccgccaccagcaccagcgccatgccttccacgcccgactcactgaccggctgccataatgcagccacccgaatgcgctgcttctggtaaagcccgtcataaaaatgcactaacgcgggataggctgcagacatttcgctggtggcaggaatcgggggcagcccgtcatagcccgataacgttttgccctggggcgaaatcacctggtaatacaggcggtcattcatattgcgctcaaagctgtcgagcaccacccagggcacatccacctccagatgctgatggcgaaccaccagccgctcggcgacggtgcgcgcagaggccaacagggagcgatcgtaggcctgattcgccgccgccaggccgctctgataatgggtataaaccgacagaatccacagcagcaccagcggcaggccgagccacgccagcagctcaccgcgtagagaatgaatcagtcgcatggcagggtttccaggctatagcccagccctcgcagcgtcacaatgcccacatcactcccggccagttttttgcgcacccgatggacatacagctcaatgctttccgggctggcctcgtccaccagcgtaaaggtctgctcatagagatgctgccgcgagaccggacggccacggcgctgcatcagcgtggtgagcacactggactcacgcggcgtcagcgccaggggtttttcgtccagcaaaaagtagccctcgccgttaagctcaagctgtcccagcgtttgattttgtggtgattgcccctgtgaacgccgcaacagcgcacgcagacgcgcatccagttcatccagttcgaagggtttggtcaggtagtcatcggcaccggtgttcaggccgcgcacgcggtcgtccagcgtagtgcgcgcggtcagcagcagcactggcatattttgtccccgacggcgcagccgcgttaagacctcgatgccgtccagacgcggcaaagagacatccagcaccaccagcgcatagtcttcgctttgcaggctgtggtcggccgccacgccatcgaccacccagtccacggcaaagcctttctgggttaacgctttctgtaaccatcgccccagttccgccgtgtcttcaaccagtaagagacgcatatcacatcctttcactaaaccttatcaatgaaaggtaaatgaaaggttactgatttaacaattcagcaacgccgaattgtcggtggtaatcacactctggaagaaagatggagcgcacgatgaaaaaaataatccataccgccctcgcctctgccctgctggccttgatgttgccgtcatccggctatgccgctgcaccagacagaacggaatgcatcgcaccggctaaacccggtggcggtttcgacctgacctgtaagctgattcaggtttcgctgatggaaaccaaacagattgagaaaccgatgcgcatcacctatatgccaggcggcgtgggtgcagtggcctataacgcgatcattgcgcagcgtcctgccgaagccggaacggttgtggccttttcgggcggctcgctgctgaatctgtcccagggcaagtttggtcgctattcggttgatgacgttaagtggctggcggcgattggcaccgattacggcatgattgccgtccgtgaagacgcgccgtggaaaaacctgggcgagctcatggccgcgatgaaaaaagatccgaccaaagtggtggtgggcgcgggtgcttccatcggcagtcaggactggatgaagaccgcgctgatcgctaaagaagccggtattgatccacgcaaaatgcgctatgtcgccttcgaaggcggaggtgaagtggtcaccgccctgctggggaatcatattcaggtaatgtcgggcgatctcagcgagatggtgccgcatttacaagggggcaaactgcgggtgctggcggtaatggcagacaaacgcctgcccgatcagctggcgtcaattccgaccgccaaagagcagggatttaacgtggaatggcccattattcgtggcttctatcttggccctaaagtcagcgatgccgattatcagtggtggcagagcgccttcgagaaaatggtgcaaaccccagagttcaaaaagcagcgcgaactgcgtggcctgtttgaattcaatatgttcggcgcagaactggataaatacgtgaaagatcaggttgccgcttaccgcgagcaggcgaaatcctttggtctggctaagtaaccgggggacatcatgagcgatcgtattttcgccaccctgtggctactgatgtgcctggcaggcctggtcatcgcctggcaaattcaaagcgaatacagctatgagcccgttggaccgcgcccttttccgctcatccttctcagcctgatggccttctgtgccctgatgctgctgctgagaaaaccggatgacatcaagtggcctacggcagccacgatgaaacgtctggtggcgctggcagtgatgatgctggtttacggcgggatgtttgaaaccctgggctttccgctatccacttcgctgctgactttcggtctcggcatgctgtttggtgcacgttggtgggccgccctgctctccggtgcggtaatgggatggtcactgttctacgcctttgaccgtttacttgacgtgaccttgcccgctggcagcctgttcaattaaggagagaaataatggaaacctggtctttcctgatgcacggttttgccgttgccatgacgcctgaaaacctgctgattgccctcatcggctgctttatcggcacgatcgtcggcttactgcccggactcgggccgatcaacggcgtggcgattttgatgccgctggcgttcgccctgcacctgcctgccgaatcagcgttgattcttctggcgacggtttatctgggttgtgaatacggtgggcgcatttcctccatcttgctcaacgtcccgggcgatgccggcgcgatcatgaccgcgctggatggctacccgatggcgcagcaaggcaaagcgggtgtggcgctctcgatctctgccgtcagttccttcgtcggttccaccatcgccatcctcggcatcatcttattcgccccgttgctggcccggtggtcgctggcgtttggcccggccgaatattttgcgctaatggtctttgccattgcctgtctgggcagcatgatgagtcagaacccacttaagtcgttcctgtcggccctgatcgggctgagcatggcgaccgtgggcgtcgatgccaataccggcgtctatcgcttcacctttgacagtgtgcacctttctgacggcatccagtttgtggtggtggtcattggcctgttctcggtcagcgaaattttgctgatgctggaatccacacacagcgggcagaaagtggtccgcgccagtggccgcatgatgttcaatatgaaagaggccgccatgtctaccggtgctacgctgcgtgcctcgtttattggcttctttgtgggtgtgttacccggcgcgggcgcgactatcgccagtgctatcgcctacatggccgagaaaaaaatcagcggcagcgatcagtttggtaaaggggatattcgcggtgtggctgcgccggaagcggcgaacaatgcctccgcctgtggctcgtttattccgatgctgacgctcggcattcccggttccggtaccaccgcagtgatggtcggtgcgctaacgttgtataacatcacccctggcccggcgatgtttactgagcagccggatattgtctgggggttgattgccgcgctgctgattggcaacctgatgctgttgatcatgaacatcccgatgattaacgtgtttgcgcgtatgctgacgattccgctgtggttcttagtcccggctatcgccgccatctccgcggtgggcgtttatgcggttcacagcaccacctttgacctgctgctgatggtgggattgggcattttcggctatatcctgcgaaaaatggatttccctatgtcaccgctgattttggggtttgtactgggtgaaatgctggaacaaaacctgcgtcgggcgctgtctatcagcaatggtgaaatggctatcctgtgggaaagcccgattgccaaggtgctgcttatcatggctgtagccgtattgattgtgcctctggtatggaaacgactgcgccgtaaacccgccaccgtgcatcagtaagtaaatctttgtgcgaaacacacaagccccgtggatttcccaggggcttttgttatcatagcgtattctgtttccggcgcaccccacgctgttctgtttcccaaggaatccgccatgcaacctgtcagcggccccggtgtgccggtcggcgatcgttcatctgttaatccgcaaactgacgccccgcgtgcaggaagcgttgccggtgaacagcccctttctcctgcccagcgcacgacgcttgagcgtttgattgtgcgcattatgtcgcttagcacgcttaaggcgcccgaactctgggccggtttacgccatgaagtgggtgttaaaagcgaagcagagcttcagtcgcgccattttccggctgcggagcagtttctcaatgcccgcctggcgcaggtgcagacaggccacggcacacgtcagttaatgacgcaactgaccgacctgctgccgaaaggtaataatcgtcaggcggtcagtgattttatccgccagcagtttggtcagacggtgctgagcgccttaacccaggaccagctgcgccaggtattaaccatgctgcaaaatggtcagatggcaattccgcaaccccaacagagccgtaccagcgatcgttcgctgctgcctgccgagcatcaggcgctgaatcagcaaattgttcgtctggctgccgcgacaggcgaatccagtggcaaaatatggaccgctgcgctgaagctggtcaatctcaccagcggcgatcctattccgtcgcgccattacccgctgcttacacagtatttgcaggtgcgtcagacgttgagccagcacagtgcgccgacgttacagctgattgaagcctcgttgaaacatcctttggatcagcgtgaacagcagatgcttcaggattacagcctgcaacgttttcaggccacgccgcaaatggtgctgaccccgacgcaaactcaggatctgcttaacttcctgtttgcgcgtcgggctgaaagagcccatgagcaagccctggccgataacgaactgaatccgcatccgatatgggcgcccatttccggttcgctgccgccggctttgcaaccgctggcagcgcgcccggtgctgagcgcggttgtggggttgattgttctggcctttttactgtggctggtgttgtaatttaacacccacaggatgccgcagaagctgtctgcggccattcgcccgcctcatcgccccatgtcatcggatgaccgtctcgcttccagaaatccagcccgccaatcagttctttgactttaaatcccagtaacgccagctgatacgccgctttggttgagccattacagccgatgccatcgcagtaagtcacatagagcaggtcgcgatccagagaagccgtgctggcttcattgatttcccgatgagggaagtttaccgcgccgctgatatggcctgcccgccaggcttccacctgacgggcatcgatcacgacaatcccctgccgttggtgggccagatcgtcagccagatcccaggcatcggtgtaataagccagtttggcctgcagatacgcaacgctctgctgcggtaacgccgggggaaaacctaaaacagatgacattcttttttctcctgttgtgacagacaggcagtttacggcaaagtggactactgaataataccgctttcaacaaggtgataagaccattatgacgtcgccgctgctgcaattgtttcatcatcaggcaaccggtggtctgcgcgaccgcctgtgcgccacacttcgtcagtggattgaaaccgcgcaccttcaggtcgggcagaaactgccctcaacgcgtcagctggcaaccgatttagcgctgtcgcgcgtcacggttgaagccgcttacgcccagcttgaaagtgaaggttacctgcggcgggaatccggtcgaggcagcttcgtcgccatcacgctgccgggcagttcgccccgcgtgcgcgccaatcgcatggcgacattctcacagcgcggccagcagatgctggcaacgggcggctgtcaggatgcgccctttccctatgcgtttgcggcaggttcgccggatttacgtgcctttcctcatcctctctggcggcggttaaccgcccgcgttcagcgcaccgctggccctgacgtgatgggctacggcgatccgctgggttatctgccactgcgccgcgcgcttgctgattatctggccctgtcacgtggcgtgcagtgcgaggctgatcaggtgattattttaaccagttcacaacaggcgctgcagctgctggcgctaatgctggttgatgcaggtgatgagatctggatggaagagccgggctatgcgggggcgcgtaatgcctttctttctgcgggggccagagtgcgcggtattcaggtggatgccgagggtgcggttccccaacccggttccgcaaaactgatgtatctgaccccttcgcatcagtatcccaccggcgtgtccttaagcctgccgcgccgtctcgcctggctggactgggcacgtcgtcacggcagttggctgattgaagacgattacgacagcgagtttcactatgacgatcgccctgcgcctgcgctgcacgcgctcgacaacgatagccgggtcattaccctcggaaccttttcgaaatcgctgtttccctcgctgcgtctggcgtggatggtggtgcctggcccgttggtggcacctttaggccgggcgcgcagcctgctggacgggcatagcgcgctgctgccgcaggcggtaacggcagaatttatgcagcaggggcattttgccagccacttgcggctaatgcgccagctttatcacagccgtcgcgatcgcctgctggagcagctagcccagcgtctgacgccatggctcaggccgtttccctgcccgggtggattgcagacaaccgttgcgctggtgcagggcgacgacgccgccttaacgttacaggcgacaaaggcgggtttattactgccccgactcagcccactgtacggcgatagcgcacctcagcaaggctggattttaggctttgcggcgctaacgcccgatgagattgtggccgggtgcgacaagctggtcaggctgctttcagcaggctcatcacgcaacagtggctgagtggcaatcccaacgtaaaaaaggccggcaagcgccgaccttttcgtagggttcacgtcatgctgcgtgcagcatgacgttttagtccagcgttatgcctggtatttgcgcatggtcagcgtggcgttggtgccaccaaaaccaaagctgttagacatcacggtggtcagcgttttttctgtcggctgcgtcacgatattcatgccttctgccgccgcatccagcgagctgatattgatgcttggggcaataaaactgtgctccagcattagcagcgagtagatggcttcctgcacgcccgccgcccctaaggagtggccggtcatcgctttggtagcagaaatgtacggcgtgttatcgccaaacacttcacgaatcgcgcccagttctttgacatcaccgaccggggtagaagtaccgtggctgttcaggtagtcgattggcgtgtccacgccgtgcatcgccatcttcatgcagcgcactgcgccttcacccgatggcgcgaccatgtctgcaccatctgaggttgcgccgtaacctacgatttcagcgtaaatgtgcgcaccacgtgccagtgcatgctccagttcctcaaccacgaccataccgccgccgcccgcaatgacgaagccatcgcgttcgttatcataggtacgtgaggctttttctggcgtctcgttgtaacgcgtagacagtgcgcccattgcatcgaactcacaggccatttcccagcacagctcttcgccgccgcccgcaaaaacaatatcctgtttgcccagctgaatctgctcaaccgcgttaccgatacagtgcgcggaagtcgcacaggctgaactgatcgaatagtttacgccgtggatcttaaacggcgtggccaggcaggctgaaacgcctgacgccatcgccttggtcaccacataagggcctaccgctttcagaccgcgtgggctgcgcatggcatccgcaccaaaaacctgaaaacgtggggaacctccgccagatcctgcaatcagaccaacgcgtggattgttctggtaagcctcgttgctcaggccagaatctttgatagcctcttccatagagaggtaagcatagatggacgcatcactcataaaacgcacaactttgcgatcgatgaggccagtggtatcgagtttaacgttaccccagacgtgactacgcatgccggaatctttcatctcttgggaaaaagtgatgcctgagcggccctcacgcagagatgccagcacctcttgctggttattaccaatactggaaacgatccctaagccagtaatcacagcacgtttcattcaatcatcctcaccacttctgttatttgacgagcactctagcttacacttgtacgccgaacaagtccgatcagccatttccttttgtaaatttgcgtcatgtcacgtcgaccgataaaatcctgacactccctgaaaaatgagcctttactgtgaaactgccccaggttgaacacgcccaactgagctggaacgaacagggtacacctgtttcccgagcgtttaacgacgtctatttttccaatgacaacggtctggaagagacgcggtatgtctttctgggtggcaatgatttcccgcaacgctttcatcagcatccgcgcgatctgctgattgttgccgaaagcggtttcggcacaggccttaattttctgacgctgtggcaagcctttgattcctttcagcgccaccatcctgatgcggccttaaaacgactgcatttcatcagctttgaaaaatttccgctgacccaggccgatttgacggcggcgcatcagcactggcccgaactggccccctgggctgaacaacttcagtgccagtggcccctggcactgccgggctgccaacgtgtgttatttgattcgggccgcatcacgctggatctgtggttaggcgatattaatgcgctaattgataattttgatgacagtctgcatcgtcaggtcgatgcctggtttttagatggctttgcgccgtcgaaaaaccccgatatgtggacgcctgacctgttccagtcgatggcaaagctggcgcggccgggtggcaccttcgcgacctttacggcggcgggttttgtgcggcgcggtttgcaacaggcgggctttgcggtgacccggcgtaaagggttcgggccaaaacgggaaatgctgtgcggttcgctggagaccgcacccgcgctggcgcatcgccagccctggtatgcgcgccctgcgctgtccggcaaggagattgccctggttggcggcggcgtggcaagcgccacgctggcccttgcgctgctgcgccggggctttcaggtaacgctctactgtgccgatgaggcacccgctctgggcgcgtccagtaatcgccagggcgcgctgtatcccctgctgaatcagcacgatcccgcgctggccagcttctttcctgctgcattcagtttcgcccgtcgcctgtatgacgcactcgatctcccttacgaacatgactggagcggtgtattacagttgggctgggacgagaaaagcgccagcaagattgcgcagatgctgaaaatggccttaccggctgaggtcgcttacagcgtcaaccgcgacgaggcggaggcactggccaacgtggcgctggattgtgatggtatcttttatccgctgggtggctggttagccccggccgaattgacctctgcgttgttatcccacggtgaacgactcggattacgtgttcactggctgcaccgcgtcaccgcgctggagccgcattcgcaaggctggcagttgaccttcagtgaacaacccgccacctgccaccaggctgtggtgctggctaacggtcatgcgattacccatctgacccagaccgactcgctgccggtttatccggtcgccggccaggtcagtcatattccggcttcacccacgttatcggcgctgaaaacggtgctctgttatgacggttatctcaccccagccagcccacagtttgggacgcactgtatcggcgccagctatcaccgtggcgatacgtcgacggcctaccgtgaagacgaccagcagcaaaaccgcagccgtctgcagcactgcctgccccacagcgggtgggtggatgaagtggacgtcagccagggcgaggcgcgcaatggcgtacgctgcgccacccgggaccatttgcccatggtgggcagcgtgccggattacgcggcgacgcttgccacctatgcggatcttgcacagcaacgcacccgcgaagcagaaagcgaaacggcaccgtatttttcagggctttatgtgtttggcgcgcttggctcacgtggattgtgcagtgcgcccctggcggcagaagtgctggcggctcagctcagcggcgaaccccagccgctggatgccagcacgctggcggcgctcaatccaaatcgttattgggtaagaaaattgctgaagggcaaaaaagcggggaactagcacgggcggcgtaccgccccgtgcattcaggcagactgctggcgagcctgtaaaaacaggttatcccacataccaatcaccagcgcctgatcccggggcgataattctccggcggcgatagcgttttgcaggcttcgtgtcacctggatctgtaacgcttgcggcgtgtgttcgtccaggcgttccacttccgccactgccaacgtgaggtggccacgcagataaccgctggcaaatagctcatcgtcactggcgtgctcaaccatgtcgtcaatcagggccagaatacgtgcctcaaattctgcgatcatctcatcattcctctgttattaagtcccttctgcatcacaaatcgtccggccagggaaattgcgatgcggtcagagaaggcctgccataatagtcagccagggctgaaataaagcgtgcgggacgggcaggaatacccgacgccaggtagttcatgacctgggcatgaacctttcgctggaacacaatgcgatctggctcacaatctccttcgagattgtcacaactgacgttgaagggaaagcctgcagccacacaaaacatccattccagcgcctgcggcttaacctctaccgcttcgaactggctttgcgtttgcgcatcgcgaccatccggacaataccaataaccaaaatccaccagcttgcgccgggcttcacccgcgatgcaccagtgcgaaatttcatgtaacgcgctggcgtaatatccatgagcaaacaccacccgattccatggcgattcgtcatccgcaggaagatagatcggttcgtcatcgcctttaattagacgggtctgaaagtcgtggctaaagcaatcatcaaacagcgcgatcagctgttcgtagttatgagttgttgtcattaagtcatcacgtaaaagtattacagattcagcgtggtcagccaggccatcaattcactgccgtggctgtcccagagcagtttggcgctcatgaccgccgaaacgattaccaccatcgggcggatcagcttttgtccacgtgccagcaccagccttgcacccagccgggcaccacaaaatgcccccagcatcatgataagccctgtgccccacaccactttgccaccaaatataaaaaacagcaggctaccaaagttggaggtgaagttaagcagcttggcgtgcgcggtggcttttgccaggttatagccgcacagcgtaacgaaggccagtgcgtaaaatgagccggcacccggcccaaaaaaaccgtcataaaagccgacacagccaccgccaatcagggcgaaaggcagcccctgcagacggtgaacgcggtcttcttcaccgatacgtggcatcagcagaaaccacatgccgatagcgattaacagcagcggcaacacctgacgcagcatatcagcctgcaggtgctggatgagaatggccccgccaatcgaccccaaaaaggtcatggcgatattcagccgctgctcgctgagtcggatggccccgcgccgaacaaaatagaggctggatgagaaagatccgccgaccgattgcagcttgttggtcgccagcgcctgcgcaggtgacagcccggcagccagcaaagagggaaccgttaacagtccgccgccgcccgcaatggagtcaatgaacccagccagcagggcaataaaaaacagcagcacaaccaacagcgggctgacaacgaaccattccatgggaacccttacagtaaatgtttatccagcagtgcctgacaggccgcaggcagcggcggtggctcacgttttaccggcgcagaaccaggctgtttgggcaaaaaccagctctgaagttcggctccacagccatcacccgcaggcggtggggcctgctcttcacactcggtgctgccctgaggacagcgcaagcggacgtgcatgtgcgcgcgatgcgcaaaccagggacgcacttttcgtagccagccacgatcgctacctgcatcagcacaaagctgctttttaatcgccggattgacgaagatacgtgtcacatcgtcatctttcgccgccagtttgatcaggctatcgatttcaggctgccagtgacgcgccaccacgttcttgtcgtcagcggtgacgagatccaacggctgcggtttaaggagttgctgcgcgctccagcgggttttaggcagttgtagccaaatatcgacgtccagcccggtttggtggctggcatgtccactgctaaagcgcccgcctgccgccatgcccatatcgccaatcagcacgtttcccagttggaggttatgcgcctgggttgccaggcgctgaataaacaggatcagatcgggatgaccgaaatagcggcgctgatcctggcgcatgacctgataatccggcgagttaagcggcaacgcctgggcacccacgatacagccgttggcaaagcccccaatcgcattgggctcacccgcaacagggtgctggatacgttgccacggcgttgccgccaggctggaggcactcagcaggagcgcactcaccatcagcaagattttcataggctcaccaacgtggcaccgtcgagttaacctcaccgcactgcgcgcgctggcgcagcagatgatccatcagcacgatcgccatcatggcttctgcaatggggacggcacggatgcccacacaaggatcgtgacgacctttggtgatcatctccacttcctcgccatcgcgggtgatggttttacccggtacggtaatactggaggtcggtttcatggccagattcgcgctaatcgtctgaccgctgctgatgccgccgaggataccgcctgcatgattgctctgaaaaccggtggcgcggatttcatcacgatgttgactgccgcgctgattcactacggcaaaaccgtcgccgatttccacacctttcaccgcgttaatgctcatgagtgcatgcgcgaggtcagcatccaggcgatcaaaaaccggttcgcccaggcctggtgggacattttccgccataaccgtgaccctggccccaatcgaatccccttctttcttcagggcgcgcatcagttcatccagcgcctccagcttgtcggcatccgggcaaaagaagggattctgttcaacgatgctccagtctttcagttcgcaggcaacgtcgccgatctgcgccagatagccgcgaaccaggataccgtgcttcatctgcaggtattttttagcaatcacgccggccgccacgcgcatcgcggtttcgcgtgccgatgaacggccaccgccacggtagtcacgcgtgccgtatttttgctcataggtgtaatccgcatggcccggacggaacaggtctttgatggcaccgtaatcctgcgaacgttgatcggtattctcgatcagcaggccaatcgaggtaccggtggtgatgccgtcaaagacaccggacaaaattttcacctgatccggctcacggcgctgggtggtgtagcgcgacgttcccggacggcgacgatcaagatcgtgctggatatcggcttcggttaacggaatgcccggcggcacgccatcaacgatacagcccagggcaataccgtgagattcaccaaacgtggtgacgcgaaagaactgtccgatgctgtttccggccattgagattccttgttacggtttgacgggcgaaagttcgcccacccttttagtctttataaaatgagaaatggtgctgtgcatcaacgatctgctgacgggtgagcataaagacgccgtcaccgccgttgtcgaactccagccaggtgaaaggcacgtcaggatattgctccatcatatgcaccatgctgttacccacttcgcaaatcagcacgccctgttcgctcaaatagcccggcgcgcaggcgaggatgcggcgcaccagtttaagcccgtcgctgcccgcagccagacccagttcgggttcatgctgatattcgctcggcaggtcgtccatatcttccgcatcaacataaggcgggttagtcacgatcagatcgtactgtaccggcggcagttcgcggaacagatcggcgcgaattggcgtcacgtgatgtatcagaccgtgctcttcaatattctgctcggccaccgccagcgcatcatgagaaatatccaccgcatcgacttcagcctccgggaacgcataggcgcaggcaatcgcaatacagccgctgccggtgcacatgtccagaatatgacgcggtttttccgtcactaaaccggcaaagcggttttcaatcagttcaccaatcggtgaacgaggcaccagaacgcgttcatcaacgtaaaactcatggccgcagaaccaggccttgttggtgagataggcgaccgggatacgctcgttcacgcggcgaatgacgcgctcaacgatgcgatggcgttcgctggctgtcaggcgcgcgtttcgcatatcttccgggatatctaagggtaaccacagcgtgggcagaaccagctggacagcttcgtcccagggattatctgtgccgtgtccgtaccagattccggcagcggtaaagcggcttaccgaccagcgcagcatatcctgaatggtgtgcagttcattcactgcctcatcgacgaaaattttgtccacgtagccctccgcaggccttttactaaatcggccgatagtttgccacgaagccgaggagaattcagcgcggcaaggtgaaaaagctgacaattaatgacggttaacggtaaggtatcggcttctgctgttaatcagccacctcagatatgatttacgaataatgagtaaaaaaacccccctgagccaggatgatcaagcgctgtttcgccagttgatgacgggcacgcgtcaattaaaacaagacactatcgtgcacaaaccggcagtgaaaacccgggaagtcccgataaaaagactgttgtctgaacaagcggataacagccactacttttcagatgaattccagccgctgctgtccactgaaggggcaacgcgctatgttcgtgccgacgtgagccactttgagctgaagaagctgcgccggggtgattacacgccagagatttttcttgatctgcacgggctgacccagatgcaagccaagcaggagttaggcgcgttgattgccgcctgtcgtcgcgaacaccttttttgtgccagcgtgatgaccggacatggtaaacatattttaaagcaacaaacgccgttgtggctggcccagcatccctgggtgatggcctttcaccaggcacccaaaatgtttggcggcgatgccgcgttattagtccttattgaaattgaagagtggcaaccgccagaattgccttgatattcaggcagaaaaacgtcttaagccccttgccctgccgtcccgcttgttccccctttgccgggggaatccgcgccactgcgttacaccttcttcccttatcacgcgtcattccgccccttattgtccgggcgttctgctgatttctgttcaggctgacgcagactatttgcttaagaaactatttatactgaatacaattttcccgctgccgataacgttcaagcatttaggcatattacgtttaaacattattggcacattgaccaagggaactttttgaatgagcgggttgagtaatttttttgagaatttaaaagtgggcaaaaagctcatgctcggttttgggcttattttattgttgagtctggctgtcgcgatatgcggcattaaaaatctgaatgacattagcgtgcgggccgaaaagctcagggagcttaaaagcgtcaatgaccggttttcacaggccaaagatgcccgcctgcaattcgttaaaacacatgatgaaaaattcatcgttctgaacgaagacatgctgaaagaggtagatcagaacttgaaaaacctgggcgtttttcgttgggatgacagtcagcaggcaatgattaccgcgatgccgtcggccattgccacttaccggcagaaacgggccggtaccgtgcaggccgtccgtgacggtacgcaggcgctgacgaacctctccgtggctgatgagatgcgtgctattggtcagctcgccgcaagcaataacggtgacgcgcagaccgccgccgcgttgcaggagatcaataagcatttgagcggcgtagcggtgcgggtgaaactctttggccttgagcataaagatgaagatcgcaatgtgctcagcagcttcctcactgaaaccgtcggacttattgcgcagatcaaatctcggcttacccccgcagacgctgcagcaatcgacaaaatcagtgaacagctcgtgacaaaacaagcggatatcagcgcgatgatggcttcggtaaaagcgggcgaagaggccacagccgaactggcggcggcaggcaaaaccctgaccgatatgagcaatgcgttgtttacccaacagctggacgccaccaatcacgatgccagacaagccgtttggctgatggcgaccattgttattggtgccatcattgcgggtattcttattgcgctgtttattacccgccagctgacgcgtcccttatctgagcttctgcatattgcccgacaaatggcacgtggcgatctcagcaccgtgatgcacacctctcgccgggatgaactgggcgaactcatgcatgcggtaggtgaaatgagtgatgaactgcgccggattatcagcggtatccgcagcggcgtcaccagcgtgagtcaggcgtcggcagaaatcgcctccgggaataatgacttgtctgcacgaacggaaagtcaggcggccgcccttgcgcaaacggcagccagcatggagcagctgacatccaccgtaaaacagaatgccgataatattcatcattccagcagactggcacaggaaactttcgacacggccagccgtggcggacaactggttaccagcgtggtcagcaccatgaatgaaatttctgccagctcaggaaaaatctcggagatcacctccgtgattaacagcatcgcgtttcagaccaatattctggcactgaacgctgcggtcgaagcggcacgggctggcgagcagggtcggggttttgccgtcgtcgccagtgaagtgagaaacctggcgcagcgcagcgcattagccgcgaaagaaatcgaaacgctgattcaggattcggttgcccgtatcagcgcgggttcgcaactggtcagtcagacaggcaacaccatgggtgaaatcgttacctcagtcagcaatgtgacagagatactgaacgagatttctcaggcgtctgaagagcagaaccgcggcattgcgcaggtgggcgtggctatcgttgaaatggataatgtgacgcagcaaaacgcggcgttagtggaacagtcctctgcggcggccagtgcgcttcatgaccaggcacaaacgctggcaggctcggtatcacgttttgtgattgcgtaatctgttcgggaaaagcctgacgggatggttgttccgttgtggattcatgcatgttcgggccattttatggcccgacatcattacatggctttcgccagttttttcgggctaatctgccacagcaatgtgccctggctttcagcgggatcgaagtcaacgcaggcaattgcagaagtggcaaacattggcggtgtttcctgggggcacagttccgacaccaggtatcccaccaacggtaagtgagagatcaccagcaccgatttcaccccttcattggccagcgcctgcaaatggcatcccaccagaccgggatcgccgccgggcgtgagttccggcaaaatatcctcaccgtctggcaaaggaaaggcctcacgaaacgtggcgagcgtttgctgcgcacgcagataaggactgaccagtacacgttcaatgtcaacagactgaccttttaaccagtttgccatctgacgtgattcgtcacatccacaaagcgttaaaggcctgaccgaatcactggcagcctcaagagccgcatcgccgtgacgcatgataaaaacttgcataaagcaccgctgtagtttgtcgacatcgcctgatgcattcgcgtcaggcgcttcattctgcgaatgaacgtcgtgttgtaccctaatgacttcagtatagtcaaccggttgtttattaaataagcacctgtcagattcgtgtaacgcctcacgcttgtgcggcgcgtttctaaccccctgaatcaggatgggtattcgtatttatgaagaagtgtaaaactttgtctgctgctccgctgcgcgcagcaatgcgtcacagggcgcaaaacggtcaccgtattgctgctcaagccgcgttaatctgctcaccatctctgctgcgcccagcctgtcaatgtaatgaaacggccctcccaggaacggcggaaagccaatgccaaacacggcaccgatatcaccgtcccgcggcgagcgaataatctgctcatccagacagcgcaccgcttcgtttaacatcatcaacacacaacgctcggcaatctgcgcgccactctgcgtcttcaccggtttacgcttcaataagctgtacaccgcgggatcgacttttttgcgcgcgaatcgcgacgatccatacagataaaaccccttaccgtttttacgccctttgcgtccgtcctgaatcaccgcatccagcgcagaaggcgcagcaaaccgctcgccataagcctgttgtaaccccggggagattttactgccgacatcaatccccacttcatccagtaactgaaccggcccgaccgggaaaccaaacttcaccagtgcccgatcgatgtgatcgatcggctccccttccaccacacagcgcatggcttcattgatgtaaggcgtcagaatacggttgacgtaaaagcccggtttgtccgccaccactatcggcgttttaccctgttttcgtgccagcgtgaccgtgctggccagcgtttcaggtgaggttgtcgcatgcggaatcacctccaccagcggcattttttctaccggactaaagtaatgcagaccgatgatgttctgcggacgctgggccgtcgcggcaatctccgcaatagggatcgatgacgtgttagacgcaaagatcgtatcaggctgacaatgcgcctcgacgtcggccaccatctgccttttaagcgccagatcctcaaacaccgcctcaatgaccatatcgcggtgagcaaaaccctgataatccgtgccgccgctgatgcgtgccatctgctgctgacgctgcgccggacttaactgccgacgtttcacttttttaccgagcagcgcccaactggtttgcagcgcatggttgatgccttgcaggctgatgtctttgatgcgcaccggcaacccggcattgatggcgctgacgctggcgatcccgccgcccatcagtccgcctcccaaaaccccaatccgctggatgagtcgtggttcggcacgggtcccgttctctttcttcagcgctgttgaggcaaaaaacagactgcgcagcgcggccgactcgggtgtcatcgccagctcgccaaacgcgcgtgcctcggcggcataaccggcctggctgttctgctccaggccgatgcgtaccacctcgatgatgcgctgtgccgcaggatagttaccctgcgttttacggtcggtttcacgcctgaccagcgcgaacagcgcctggcgagccaccgggccttgcagcagtcgatcgcgcaatggcagcggcgctctgcggaattttcctttttttacctgcgcaatggcggtatccagcagaatggcctgcggcacggcatcgtccacaatgcccagctttttcgcctgttttgctcgcagatttttaccggtaagaatgagcggtagcgctttctgcacgccgattaagcgaggcagacgctgggtaccgcccgagcccggcagtaatcccaactgtacctccggcaggccgatgcgggttttatcatccagcgagcagatgcgcgtgttacaggccagcgccagctcaagaccaccgcccaggcaggcaccgtggatcgctgccaccaccggaaaaggtaaggctgcgatagcggccatcacctcctgtccttgtctcgccagcgcttccgcctcatgggcgtttcgacaacgatcgatcatgctgatatcggcacctgcaacaaagttgtcaggcttgccggaaatcagcaccagccccagcaactgcgggttcttgcgcgcctgcgcgatgatcgccgcaatctgtgccgcaaactccgcctttagcgtattcatcttttcatctggcacatcaatggtgatcacgccaacgtgatcgtcccgcatttgtaatgtgaaagcgctctgttccattattcggcctccagaaccattgctgcacctaaacccccggcggcacaggccgtgactaaacccagccccccgccccggcggcgtaattcatttaacgtctgggtgatcatgcgcgcaccggtggcggcaaagggatgcccaaaggcgatcgatccgcccgagacgttaaagcgcgcctcgtcgacctcgcccagcgcatgcggacggtttagcacgtcccgggcaaagcgttcatcacggaacatttttaaattgcttaacgtctgcgccgcgaacgcctcgtgcatatctatcagggttaaatcacttagcgtgattccggcgcgatccagcgctaaaggtgaagcataggccggccctagcagcatgtcctgccagacgtcgatagcggtaaacgcatagctgcgtaagtagcccagcggctgtaaaccaagctcttttgcccggccttcacgcatcaaaatgactgccgccgcaccgtcggtaagcggcgtgctgtttgccgcggtgacagtaccgtgctggcggtcaaacgccggacgcagtcgggcatagtcggcggctttcgcatccatgcgcacattattatcctgttcaatgggcgttttccacggcggcacaaaagcggccatcacttcctgattcagcacccctgactgccaggcctgggctgcacgctgatgcgatcgcaaggccagcgcgtcctgctcttcccggctaatgccgtgcgttttcgccatctgttctgcagtatcacccatgcgtaatcctgtggaatattccgcgaccgcaggcggcaccggtaacagatctcggggccgcaaccgccgcagaatatgtaacttctgcgaaaagctacgcgctttattcaagtccaccagcgcacgcgccagtgttttactcactccgacaggcaacaccgaggaggagtcagccccgcccgcaatgcccgcagaaatggtgccggccagtaagctttcagtgacgtttgccaccgcctgaaagctggtggcgcaggcccggctgacgctgtaggcgtcggtattcacactcaggccactgctcagcacaatctcacgcgcaatattcggtgcttccggcatctgcaccacctgcccgaagaccagttgttcgatgatgtcgaccggaagctcactgcgggccatgatttcgcttatcaccatgcggcccagttcgaccgctgggatgccgtgaaaacccgtagcctggcgaaggaaaggtgtacgtaatccgtgggttatggcgatgcgctcgccattacgcgtcagcagtgactgcgctttgctcattgttttcacctgtacatcgtgaccgaggcatcattgccgaaagaggtctgacctgatccacagtgttaaccacaagccggggcgccgccaacatcaggaggagaaaagtgagatgagaaacacgaaaatgaaaaacgccgcacagaagcggcgtcgaaagccttaacgtaaaccgagttgaaaaatcagggtttcagcctgacagctaaaggtgaaatcgatattaagctgcacgccgtcggcctcttccaccatgctggcttgaataacgcagggttcggactcgacctgccgcgctttttcagtcagccgggccagtttactttccgcctcggcacgccgggcaaaccattctgaccagctggccgtacagtccgaattatccatcaccgtaccgacatcgacacaacagcacgcagccgtttctgtcgcgctacatttttttaaagcatcagtcatgggtctctcctgacaacacatcataaggtgggtaattttctgctaaaaattttacgccttcgtttttcaggctgccagacacaccgcgctaagtgacgaatatcacaataaaatttgatatggatcagttttaatcctgcctctcttgccgttttatcctgagaagtgttaagcagatcgaattttcatcgatcaaattggaaatattttaaaaacaatattgcaacatgtgtacaggtcggacctatactctccgcactggtctgatatgtacgtttgacatcagtccatacaatccgccgttccttgttacgcgacgtcacaacgttaaataataattcacatgaggttgtggtcatgaaccataaaaacctgttcgcaaagtcagccgtggcagctgcagtagcgctaatttcctctaacgtatacgcagccggatttcagttaaatgaattttcttccattggtttaggtcgcgcttattctggcgaaggcgcaatgggtgatacggcggcctcagccagtcgtaacccggcaaccatggcgctcatggatcgtcctgagttttctatcggtgcggtttatattgatcctcaggtcgatatcagtgggcaaagtccatcgggacgcagtctggatgcgaaaaacatcgcccccaatcagtggatccctaacctgcattacgtccagccgattaacgatcaatggtgggttggcgcatcagcgacctcaaactacggcctggcgacagaatttaatgatggctataccgcggggggattcggcggtaaaaccgacctgatgaccgctaacctgaacctcagcaccgcttatcgtctgaatgagcatttcagcttcggtgtgggctttgacgctgtttatgccaaagcaaaaattgagcgttatgctggcgaatccttctctgcactcggcattccggctgatacgcagattgcccgcctgaaaggtgacaaatggggctacggctggaacgccggaattttgtatgaagtggatgaaaataaccgtttcggtttcacctaccgctctgaagtgaaagtcgatttcgatggggattacaaaagtaatctgcccgccgctatcaatgcctttaatcttcccggtgcgccttttggcacaagcggtaataccattccggggtcactaaccctgaacctgccagaaatgtgggaagtttcaggctggcataaagtggcaccgcagtgggccgtgcactatagcctggcctataccagctggagccagttccaggagttgaaagcgacgggctcaaacggccagacgctgttttacaaagatgagggtttccatgatgcctaccgcatcgcactgggtaccacctatcagtacgacaaaaactggaccttccgcagcggtatcgcctttgatgacagcccggttccggcagataaacgttctatctctatcccggatcaggaccgtttgtggctgagcgccggtgcctcttatgcgtttaacgacgctgcatcggtagatgtcggcgtgtcttacatgcacggtcagaaagtcaccgtacaggaaggcaactatacctttaactccagcggtaaagcctggctgtatggcgcgagctttaactacaagttctgatgcgctaaacgcataaaaaaagcgacactgcgtgtcgcttttttattgtccaacgatcatcaacgttatcaggacgacagcgtaacagccttacatcatcctgcgccaatcctgaggccgccctttgcacaggcggcttttcactcgccgtggcttactgagaatcaatatctttcagatcgccctgaatcgccgcagcgttaggattatcttctggcttcaacttgccgccgcgcgccaggaagtcatagcgctggaaataggcgctacgcacaaaggcgtaaggatcgcgttgctgtttcaggatggcatccgagtccagcagttgcgcgcgtgattcaatgccttccagtgtccatttaccaatcgacatgggccaggtcaaccagccaagcacaggataaagcgtatcgacgtagtcaccgccgtcctgacgcaccgtgaagctcccatagccaggtaactgcacataaggaccgtaacccacaccataatgacccagcgtagtaccaaaacgctgcgatccctgacgtgccagttccggattggctttaccagcgacatcgatgaaaccgcccagccccagcaccgtattcaggaagaagcgcgtaaagtggatacccgcgttacgcggatcgccgaccaggatagcattcaccatactggctggctcgccaaggttacccaggaagttgctcaggccagcacgtgcaggcacgggcacgtagtcgcgccaggcgactgccacagggcgcagcacgtacgggtccagcacgttatagttgaagttgaacattgtgcggttaaagccttcaagcggatcgctacgccctgcaggcgcgtcgtcgtcaggctttgaactggcacaaccaaccagaagcacactggccaaggccaggctggtcaggcggtgatccatttttttctccctgtgcatgtaagttatttataccctgcaagtttcaccgggtagatcagcgcattgcagcaagcatagctgatatctcccgtgcggttcacagattcagacattgccagatagcagccggttaaggctgctgctgatcgatcgccacggcaatatgctgatgaccatcccagggaaccactgcgctaagcccgaaccagtcgcccggctctggactggcgcggccattgcgtgaaattctgacgcgcacctggatctgtttctgcgccgaaagacggcgatcttgcaacatggcattactgtcatccagcgtcagcgatacgggaaaatggccgggcgatagccgcttcaccgccaccgggacaggcgatataccgtcagtaaccgaaatatacatgactccgcccggcggtaacattttttctgcctgcggagaaagtgtcacgtcgaccgccagctgtgtgttttgctgcccggcgtctgttttggcttgttcaatgctgcgcgcgatgccgtcgcgacgaggatcatcggtcggcaacacgtgcaacagcgtttcccaactgtctatggcctgcgaatactgctgctgttcaaacgcattataggccagcagactcagcgtgcggatattctgcggatgctgtttaagcagatccttaagcaacagcccggcctggcggttatcctgaggatcgcccgatcgcgtcagtacctcggcataatcctgctttaaggccatattgttgggtgctaactggagtgctcgctcaaacgcctgacgggcggttgtggcatcattgagtaccataccaagacggcccagcatcgcccagccgccaggattatcaggttcgctttgcagttggctgcgcaaaccgagctgtaaacgtgagagttgctccagggtaagcggccgggcatgagggtccatgacctgcgcgcgcagcgccggatagtcttcctgtatctgcatccagccactcaactgcgttaatccgccggttttgagatagctcgccacagacacgacgatcaacacgataaggccgggtaacagcacccaacgacggctgctgctgtgcgcgtgggtctccgacgcaggcgggatgtcactgagcagggtttgctgcaactctcgctccatcacggcccgatcggcaatcacgccctgttcttcatcctgagtgagttcagccaaccgttgctgataaaaatgtgtgttaaggctgtcgcgcgcatctccgcgcgcctcgcgttgtcgccagcctgccgccaaaaacagcacgcaggccgccagcaggagcagcaacatcgtgattaaaaaaaccgccattatactttcctgtccgacttcaaaatcgccgccaggcgctgctgttcttcatcatcaagctcgctgcgggttttgcgctgacgactacgcagcacgatcacggcagcgcccagtaccacaaacagtgccggcccggcccataagatcagggtggatggggtgacaggcggctggtagctgacgaaatggccatagcgcgccaccatatagtcgacgatctgctgacgactctgtccctgtttcatcagttggtaaacttttaaccgcatatctgacgcaatcatggcgttggagtcggcaatgctgttgttctggcacttagggcagcgcagcgaggccgtgatgtcccggtactgctcttcctgcgcgacggagtcaaatgcataggtatccatcgcggcccacaggctggcgctaaacagcagcccacagatcatcatcacaagggatttcatgcgccgctctccttcatatatttatcccacaacggcttcacttcctgttgccagacgcgcggattcaggtcaccggcatggcgatagcgaataatcccgttgccatcaatcagaaaagtttcaggtgcaccgtagacgccaagatcgaggcccagcattccgtcaccatcatacaggctgagcgcataaggattgcccagcgtattcagccaggtcaccgccttttggcgatcgtctttgtagttcagccctacaacacggacgccctgctctgccagcgcattaagataacgatgctcggcgcggcaggttggacaccaggtcgcccagacgttcagcaacagcggcttaccggtaatcagcgtctgctgattataggtttgacccggtttatccagcgcctccagcctgaaaacgggcaggggctggccaatcagagctgactccagccgggaaggatcgtccccttcagcattccgtgacagttgccacaggagggcggctgccagcagtaaaaataatcccagcggaacaaacagaatttttttcatacctgcgcctcaggatcggctttcttgcgcgagcgataacgggggtccagtaaacagaacaggccgccgacagccatgaacagcccaccaaaccagatccagcgaacaaaaggtttgtagtaaagacgcaccgcccagctgccgtcattcagctcttcacccagcgcagcgtaaagatcacgggtaaaacccccgtcaatagccgcctcggtcatcatggtacgcgcagcagagtaaaagcgtttttcggcatacaggatggcttccggcttgcccttgcgagaaacatcaatgactgcgacgccgccactgtagttagggccttgtaactcctgaacatcacgaaaaacaaaatggtagtgatggatatcgacgctgtcgcctgctttcattcttacatcgcgctcaacgctgtattgagtactgaacgcaatgccaatcacggtgacgcccacgccaaggtgtcccagcatcatgccccagtgactgcgcgaaagatgacgtaatccggtgaaaaaacggtgacgatgggtggcgcgttcatgcagctccatcagggtcaacacgatgatccataccgccatcagtaatcccaccaccgtcatggcttcaacacgatcctgcaaccaccagggcagcagcacggacgcgatcagcgtgacgatcagcgctaacaccaaacggcgcaccagtttttgcggttcatcacgtcgccagcgcactaacggcccaataccgagcatcaatgccagcggggccattaaccaactaaacatcgtattaaagaagggttcgcctaccgaaatgctgcccaggcctaattgcttatgcactaagggcaatagcgtaccgagcagcaccaccagcatagccgcaatcaacagtacgttattccccagcaggaaagattcgcgcgaccagagttcattttgcacccgactgcgcacctgtccgcctttaatggcatacagcagcagtgaactgccaatcacaatcaccaggaatgccagaataaacatgccgcgcgcaggatcggaggcaaaagcgtgcaccgacaccagcacgccagagcgaaccaggaaggtgccgagcaggctcagtgagaacgcggtgatggccaacaacaccgtccaggctttgaaggtgccgcgtttttccgtgaccgccagcgaatgcatcaaagcggtgcccgccagccacggcataaaggacgcgttttccaccgggtcccaaaaccaccagccgccccagcccagttcgtaataagcccaggctgaacccagcacaatgccgatggtgagaaagagccaggcggcggtggtccaggggcgcgaccagcgggcccaggccgtatccagccgtcccgccattaacgaggcgatggcaaacgcaaaggccacggagaagccgacataacccatatacagcagtggcggatgaaaaatcagaccgatatcctgcaacattgggttgagatcgcgaccgtctacaggataatcggggagcgtccggctaaacggatttgaggtgaggataataaacagcaaaaagcccagattaatcatccccatcactgacaacacacgggccagcgcgtcctgcggcataccacggctcaatattgccacggccagcgtccagctgctgagcagcagcacccacaacagcaacgagccttcgtgcgcgccccaggtcgcggcaatgcggtaatacaccggcaggagcgtattggcgttattcacgacatagctgacggtgaaatcattaacgataaaggcccataccagcagcataaatgcgcccgcgatgcaggcaaacaaaccggcggcaagcgggcgcgccattgccattaaacgcgcgtcctgacgccatgcgccccacagtggataaacgctgagcaggagcgccagcgctaagccgagacagagtaaaaaactgcccacttctggcatcatggtgtgttccctgcctgctgtttcatggcttcctgcccttgcggtgcgggcttcattgccatggtaatttcgggtggcgtgtagttttcatcatgtttcgccagcacctctttcgcgttaatcagattgccgggttcaagaacgccctgagctacgacgccctgaccttcacgaaacaagtccggtaagatgccgacaaagttaacgctgaccacggcgctgccgtcataaagctgaaaggcgacggccagggtttggggatcgcgtgtcacgctgccgggcatcaccatgccgcccacgcgcaggcgcagtcccggctcaggcctgatatgcgcctcgcctttgccattgataatttcacccggcgtgtaaaacagatcgatattggaccgcagcgcatacattaccagcgccgtagccagcccaagtccggttagtatcgccagcacaacatacagacgacgacgacgacgggtattcacttttcctctcctgtcggttcactggcatgttgacgtctggccgcacgcaggcggcgctcccgggcatcacgctgacgaatgtcagccagcagacgacgatgcgacagcagcgcgtgcagtgccagccccaacatgggtagtaccgtacacaggacggccagccagacatagaaggcatagcctcccatggcaaaaaagtcatgccatgaggcaaaagcaggcgtcatgacttgctccttgagttcgcaagtgcaatcgcccagggacgtcggcgttccgttagcaggatgagattacgcaggcgcagtagcgtaagggtaataaacaacaacaggtaacccagaatcgcccagcgcagcggcgtgcgcatcggtggcgctatcgcctgctgcatcagcccggacgatccctggtgcagggtattccaccactgcacggaaaaatgaatgatgggcagattgatcacgccgaccagaatcagcacgctggccgcgcgcccagccgtccggcgatcgtcaaacgcatggtacagcgcgataacgccaagatataaaaacagcagcaccagctcagacgttaatctggcgtcccaaatccaccaggtgccccacatcggtttgccccaggcagaaccggtgactaaggcaatgaaggtgaagacggctcccactggtgccatcgctgccgaaaccagatcggccattttcatttgccataccaggccggtgaatgcggcaaccgccatggcgctgtaaacgcccatcgaccacattgccgcaggaacgtgaatatacataatccgaaagctgtcgccctgctgatagtccggcggtgcatagccaaatccccacacccatgccagcagcaaactcgctatgcaggccacggcgcaccacggcaccagccgaccgcataactgatagagccgttcaggctttgccagctgatgtaatcctttccacatgatgaattgctcacatttaattagtgcttatctgcacgtctgttgcgtgatgatttattgcagcgtgatgcgcaaggcagccgctgttgcaaaaggggccagcgtggcactgccgaccagcatggcacccagcagcgccagatagccgccaatggctaacccctgccccgccgcatcaatggcggcgctggcaaaaataaggaccggaatcgccaggggtaaaaccagcaggctgagcagcacgccgccgcgacgcaacccaacggtcagcccaaccccgatggcacctaaaaaactcagcgttggcgtaccgagcagtagcgttaatgccatggcccgccagctgtgcatatccagtgagagtaacatggcaaccagcggtgagagcagaatcaggggcaggccggttaccagccagtgggcgatcactttgcccatcaccgtgaccggtagcggcgtgggcgataataaaagctgttccagcgttccatcgagatagtcgtcacggaacagcctttccagtgcgagcagcgaggaaagcaaggcggcaacccagacaatgccaggggcaatgcgcgccagttgctgtggctcgggtccaatgcccagcgggaagagcgtgatgacaatcaggaaaaaccacaacggattgaccacctctgcccctcgacgaaatgcgatacgcaactcacgctggataaggcgaaacagcattaatgacactccacgcttttcagactgattttggttatttctccgcgccagccgggcaaagcctgatggctggtcaaaatcagcgccccgccgccacacaggtgatcggcaaaccgggcgattagcgtttcaacgccggttttatcgatggcggttaaaggctcatccagaatccataaccttgcctgggtcagccacaaccgtgccagggcaatgcgacgctgctgccccgcagagagttgcgatgccgcgacgtcttcatagcccgccagctcaacgctgtctagtgcgttaaaaatttgttcatcgctgcacgtatgatgataaaaccgcaaattttccagcggagaaagtgccgctttgatacccggaagatggcccagatacagcatggaacggtgccattcgtcacgttgccgctgaatgggctgcgactgccacagcacgtcaccctgttctggcgcgcttaatcccgccaggacgcgcagcagtgaggttttaccggccccgtttggcccttcaatttgcacaatgttgcccgctgccacgctaaacgtaagcgcctcaaagagcgcacgctcatcacgaacacaaagcagattgatgatttccaacatgggagggtaaatcgcgccagccaaataaggcggaaatgatagcacaatgttgcaatctgccgaagaccgcgcgcctcccgcttttcaggctgttgtagacattcgtgctttacgcgtggcgcaacggtcaaaaagcgctctccattaaaatgttgtaacttttgctagcaattgcagaaacactttcacacaccaaaaaacgtctacgcttataacgcatttgcactgttaccaggagaaaacatgaagccttcatcaagcatgaatcagggcaaaaatgatgttgatagcgaagaaaaggacgaaggcaaagaggatatcgaggtaaatgaagatgcccttccctcacgcgctgccgctatccacgaagaaattcgtcaggatggggagaaagagctggagcgtgacggcatggccctgctgtggtcagccattgcggccggtttgtcgatgggcgcatcgctcatggcaaaaggtatttttcaggttcatctggacggcgtacccggtgcctttttactggaaaacctgggctacacctttggctttgtgattgtcattatggcccgtcagcagctttttactgaaaacaccgtaacggccgtgctgccgataatgcacaaaccaacgatgggcaatgtcggattactgctgcgcctgtggggcattgtgttgttggggaatctcatcggcacggcattcgcggcgctggcgtttaacgagatgcccatctttgatgaggcaacacgacaagcctttaccgatatcagcatgaaagtgatggaacacacgccgggtgagatgtttgccaatgcggtgatttcaggctggattatcgccacgatggtctggatgttcccctttgcagggggcgccaaactgtttgtgattgtgatgatgacctggctggtcgcgctgggcgatctggcgcatatcgtggtgggttctgttgaggtgttttacctggtatttgacggcagcgtgccctggaccgattttatctggcccttcgctatcccgacattgctgggtaaccttaccggtggcacgctgattttcgccctgattagccatgcacagatccgtaatgatatgggagaagctgcacaggccaaagtgaaagccgaacggcgaaaagcagagaaaaaacgtcagcagcaacaagaagaacgctaaattgctgacagaatgagcaaacgcgcggcagtgtagtgaatcctgccgcataactgcgttatactgcgctggcgtctccttagttaaatggatataacgagcccctcctaagggctagttgcaggttcgattcctgcaggggacaccaaatgctagtctctcaacgtatctcaaagtctactttacccattccattcagtcacttaactaaacccgatagtccacctgcgtctccatcgggctcacaaaatccacagtgtcatgttggtacaattgttggtatgtttggttcgataatgcagataccatcagccggggatttttactatgccgctcactgagttaaaggtaagaaatgctaaggctgctgtgaagccggtcaaaatgacagacggtaatggtatgcatcttttgattaccccacacggttccaaatactggcgttttcagtatcgctttggtagcaaacaaaagattcttgctctcggtgtttatcctgaggtcacgttatcggaaacccgacgcagaagagacgaagctaggcaactcgtggcaaatggcgttgatccaagtgaaaaacgcaaagctgataaggtcgagatcaaagggctgctgacatttgaaaaggttgcacgagattggcattccagtaacaggacgtggtcggaaaaccacagaactactgtgttaagcagtcttgaaagtcatttattccctattattggcaatcgtaatatcacagaactcaaaacccgtgacttactgattccactaaaaagggctgaagcaacaggtcacctcgaactcgcttcacgtcttcaacaacgcataactgcgatcatgagatatgctgtccacaatgcattgattgagcaaaatcctgcctatgacctcgctggtgctgtaatttctaaaaaaagtattcaccgccctgcccttcctttagaacggttaccagagctcatgcaacgcattgaagcttacagaggcaaaggcataacacagattgcgacccagcttacactcctgacatttgtacgttcgagtgaattaagatttgcacgttggtcagaggtagatttcaaaaactcactatggactatacccgcagagcgacaagcactcattggggttagatattcagcaagaggggcaaaaatgaaaagccctcatctggtgcctttaagcaaacaatctaaaaaattgttgttacagctacatgcaatcagtggtggcaaagatctcatgttcatcggatttagtaatgacgacaaaccgatcagtgaaaacacagtcaacaaagcccttagaaccatgggatacaatacccaaactgaagtttgtgggcatggtttcaggactatggcttgcagtgcattgattgaatccgggctttggtcaagagacgccgtagagaggcaaatgagccaccaagagcgtaacagcgttagggcagcttacatccataaagccgagcatttagaagatcggaaacttatgctgcagtggtgggctgactatctggaagcttgtaaagaagaagcacaaacacctttttacttctcaaaaaaatcccaatctacagggacgtaatttttttgatagtttttaattaataagcataaaacacttagagttactaaattctaattcagacagttattcttcctgcaccataaaatgcatcaaagaggtcaggatatttttcttcttttccaaaaataaaatcatgccttacctgctcgtgcagatttataaccatagattcaaagcttgaatagtttttatttaaatctctagaagccttattttttaaattgttagctagttcaattgctgtttggttcattgagagcgataaatttagtgctgcaacaccagccgctaccgcgcaagctccgcttgtgcctttaaaattatgcgtatatttcttcaggtctgcggagagcgtggtaagacctaagtttttaatttctccatttgaagaataggcatcatgtgatggagcacaaagatcgataccaggtccaaaacaagaataagatgctttctcataaaaagggctaatagctgatacaactaatacattgctgagggtacttagattattgctaaaatgagatgaaaacttcggttcaccattaatattttgtgagtatactatcgttttatccccgtcatagttaatagggcaattactattaccagctgaccacaaaaaaagcacacctttacctcttcttcctccttgagaggataaagaagaaatcaaatcaatactttcattattaagaataaagtcaggaagctttgaccatgtattaacgaatatatcaactttatccgagagagccttaacaaactgctgaaacccagattggtttatgataaatctgttatcgtaaggccatcggatcggtaaaatctttaccataggggcaatacctataggaaggctattgctcaatggcccagcgatcagaccacaaattgccgttccgtgcttgaatttatcagagaaaactctatcagctttcgatttgtctttagtaatattaagcttaccgttttcaatgtaagtaaatgcttcaatattatctgagtaatcattactaaaattgtcaatcaaacacccatcatcagctactgcaacaactatgtcactatcaccaaaagactgatttgaattccaataattttcagcattaactgaacataaagagcctgaagtaaaagagggatgcttaccatgcaagtgccattggtgatcataaagaaaattatcttttaaaagagaattaagggcatcaaatgatttcattgagcatcctccagagatacagtttcattttcccaatgctgtttatattctttacaacttatcaaaagttcatggtgctttccttccgcgaatacactaccattttttatgaaaataaccttatccatatcattaatgatatcaacactatgagatatacatattactgttttattcgaaaaaaagtttttgagattttccaaaactttcgatttggtatttggatctaatgctgaagttacttcatcaagtaagagaacattatgttttttaattaagccacgagctatatttaacctctgtaattgcccacccgacaaagtagaacctttattcccaatttttgcatttaaaagagaggtgaaactttctttttcattcataaggtcttgcaaacaaaccgaactcataacatgctcaatttcattgatagataagttttccttagaagtgcaaatattatataaaaccgtatcatcaaagaaatttgcgtcctgagatacatatgaaatgttctctcttagacttgaggtattgaaatcatccaattcagatgtattaatcaatatagagccatcactttcataatcatataatcctaacaacaactttaaaatcgttgatttgccacaccctgtagcaccgactaaacctaccttttctccttttttgattttgaagttaatttctttcaagaccagcttttcgccgtgtttcattgagacgtttttaaactcaatcaattcgatattatttaaacagtgataaccttctttttctttttcattctttatcagtgtgtttaagcttgtattgaataaagcatatgcacgaaacaaagcagtgaattggtccattaatgtcgaaaaaagtccctccagcttaaataccaatgcgtacacaacagccacttcacctgaagaaataccttttgaaatccatagaaacaagatcatcagtgttatgatagccattatgagtgaacttgtaataatcattatcgtctctgatctcgtaattgaccttaaatacaaagcagatttatttataaaatcctttagtgaaaccactatcctgttagattcatttacatcattatatttagtaaataatttcagtgttaaaacgttattgaaattatcactaattactccattgacgttcacggattgatttgccgactcacgagctagttgttttgttttaggaacataaaatttagcaataaagaaaatcgcgagcatccacgtgaaaattggagcaagcaaatacaggttaatcgacgccataacagagaaggagaatataaaaaaagcgattgtaacccaaatattctggaagaacagagaggacatttcattgacagcctgaccagcctgccaaatagaagatgttattttaccaggattattactgtcaaaaaaaaccatcttgtttttcaaggtttctttgtagagctgaactcgaactaatgcacttaatttcgaataaactgcttgatttattgttagtaaattcaagcaccttaatagaggcctaataaacaaaagcattgccaagaaaagaataataaaaatttggttatcgcgtaatgctttaataatagtatcgcgatcccgactaacctcactaatcagatcaacaagctttcctgaagagtgaataataaaaacctcacaaccagaacataataaaccaagcatgaaaagtgaagaagctaaaagcttatgatctaatgcaagtttaactaacactcttaaagaatttttttcttttagaaaagcattatcctcttcaaatggcttaataaagctctcaaatttttttaaaatagaagttagcattttctatccttatttaagcaacagcgcaaaagcgctgttgcttatccctattgataattaagatttcatttagaagtgtccaccgacacccggtccgccaccaccagcgcctacggcacagcaaaggaactcaaaattaccttcttcatcttcaggatgttttgaaataaaagtaatttcaacatcttcatcctctagattaatatttttctcactttgatgcaatttcgaatcaagactcattttactctcctttgattggaaaaaacactactcacacatcattccgccagagactgctgtactccaaattttagcaattccctggtgatatgacatatcgggccatgctcggctatgccattcttatcgtaacgtgcagacaagcatcctgaggcacaactccatctggcaaaacatttagaacaatcactaaatgaagtattattaatttgccttaaagaattaacttttttcacatcaaacttaaagtcattgtctttgaatgtcccaacatggaacaggtcataaccttcattttcgcttcgactatatctatgacaacctgcgacttcacctttgggagtaacagcgaactctacattacaaaaacggccccccctgcgatcaacgttacccattagcttgtttgtgacattgatgccattttctttagctaaaaaatatgcttttttaaattgatctatgaactcttgttgtttgggctttgaaagttcactatcagtcgctcggccaatctcagccattggttccatgcgaacttccttggcagatgtatagtccctaatatattcgaccatttcgactaaccgtcctgttgattcgctagatagagtcgtcctgaaatgataaggaacaccatgcttagttaataattcgcttgttctaagtagcgctttttgtgaactttttccattagggaaaggacggttcagttgaagatcgggtaatacatcaaatgataaagttacaaagtcgatattttttttgagccactttgccttttcgtcattgattaagactccattagttattaacctgatataagtattaacaccagcctcgtcagctttatactttatgtaattatttatccatacaatcaattcccattccgtagtaggttctccacctccaaggtacctgaactctgcggtgtgactatggattgattttgcattctcaatagcaatgtctacagcctttttagctatttctttgctcattgcttcactcttctcacctgtggccctggcataacaatagctacaagccagattacatgtttcagtgagtagcaaagtggcctcaaacggtttaaattcctcaagatcttctattacaggtaattgcttaatgtgttctccaataacattccacttggacagtttttttattatcggatgatttatttcttcagcatccagattaacatgatttgcaagcttttcaattaatggtaaagaagccttactacttttaaaagctatacctcttaaaggcagatgagagtatataagcccatcatctccttcaaagtgatacatgggtgtattcaatactttatgctctgatgaactcataactcacctcactctatctaaagtaatatagtttttaatttctctttaagttcttcttctaactttatttcttgcgtatttcctttatcaagaaaatttgagtgccttttattaagaagtcgatgcaagtggtagtgagatggtttcttgattaagattaatttcattccatcgggaaattcaacaccacaatgtcttgtttcattcgcatacttatctgaaactaatttggatttgctgaatttaaggtttaactctttcttccagactcttatgtgtggattaattagcttcttgccatacatgtctttgtacatttttgaatttacaatataagacgatctagaattcaatgtatagcattcagtcattatggcttggtgttcagcatgatctgtgcagattctctcataaaaagaaagatcataaacatcatccgcatcatgttgcataacccaatcaacatcttttttgtacaaaatgtctaaggcagcattgcgagctgatatctgatcataacccccatctcggatcgaagtttcataaccagaaccatagttcccacatttaatttcgaacttatgcgaaaaacgctctaataattccaaagaggcaaaattttgatttatgtttccgttatcagtgatcaaaataagaatgttagaaacaaattcagagcgtgctgcaaaagatagtgttttaaaagccagcaatagctcattactactgaccgtgcaaaaaatccctacagaacacccatacttagcttgcttacaatatgctggatcattattaatgatgtgttcactcactactcacctccatggaattccaagaagctaactcatcagtaacgtgaaaggttaaaatcaacctaacactacttttgtgaagttatattcatcataaatgtttcagaataggaagttagtatgtaattttgttaattttatgttgcgtgtaaaactttgcattagctctggactataaaaaaaatcactatttatgtatagacactccaccattaaacagaattttcaactacaaatttcatttttatttattagctaaataggttttccatattaataagttacatttattaaaatcttaatactcctctatattttgctaataattcaaaaaaatatatttatcatgctaattatacatgttttagtaatcaagaatttcgtttctgtatttgaatgaagtttccagattattgctcacatgcgagtgaaaattcacatcatgccgtctcatatgagatgtgttgtccagtcaaaacaatgaatgtctttttgtatccataacagcagctctcgctgggcttctccttggacttgatataggtattatctcaagtgccctgccactctggtagccgcgattggagcaatctgtaacggctgggtttcacatagactgggaaaaaagtacagccttatggcgggagccatactcttcataatgggttcccttggatcagccttcgccacaagtgttgaagctctgcttacattcagggttttactcggactggccgttggtattgtaagcatcccggtaaaccgaaccattcgcttttagagatcttccgacatactgattatgtcctgtgaggagatcaccatgcgtaaagcccgattcaccgaacaccagatcattgccgttctgaagtccgtcgaagccggacgtaccgttaaggatgtctgccgtgaagccggtatctctgaagccagctattacaactggaaagcgaagtttggcggtatggaagcctctgatataaaaaagatgaaagacctggaggatgaaaaccgtcgcctcaaacagatgtttgctgatctcagccttgaatgccgggcacttaaagaagtcatcgaaaaaaagctttaaaaccagcgataaagcgtgagctcgtcggttacctgactgcgcaatttaccatgagcattcgccaggcctgcaggacgttatcgctgagcaggacggtctatttttaccagcccgatacccggcgtgatgaaccggtgatccaggtgctgactgagctggcagagcgctacccgcgatacggcttcaaaaaactgttccagctgctgcgcaggcagggtaacacctggaaccataaacgcgttcaccggatttactgcctgctgaaactgaattttcgtcgcaagggaaaacagcgtttacccgcgcgtaacccggcgccactggctacgccggaagcgcttaaccagagctggtccatcgattttatgcatgatgcgctggtctgcggcagacgcttccggacctttaatgtggttgatgactttaaccgcgaggccctcgccatagaaatcgatctgaatatcccggcacagcgggtggtcagggtgctggacagaatcgtggcaaaccggggttatccactgaaactgcggatggacaacggaccagaactggtctcactgacgctggcacagtgggctgaagagcatagagtgatgctggaatttatcaagccgggaaaaccaacgcagaacgcctttatcgaacggtttaaccggacgtaccgaacagaaatcctggatttttacctgttcagaacgctgaatgaagctcgggaaatcacaagtcgctggctgatggaatacaacagcgagcggcctcatgaatccctgaataacctgacaccggaggagtaccggctgatggccgtaaaaccggaaacctcaaaaagtgcgtggaactaaaacgggtgtgcttacagtatcgcctcctataccgcccctctctacctgtcagagatggcaacagagaatgtacgtggaaaaatgattagtctttaccagctcatgatcacctttggtattgtcgtagctttcctttcggatacagcattcagttacagtggcaactggcgggcaatgctgggtgttctcgctataccagcagttgtacttttcgtcatggttattttcctgcccaacagcccccgctggctggcttcaaaaggtctgcatgttgaggcggaagaagttctgcgaatgcttcgtgatacctcagagaaagccagacaggaactgaacgaaataagggaaagccttcgtatgaagcaaggggggttttctctgttcaggcaaaacaggaatgtgagacgcgccgtctaccttggtatgttgctgcagggcatgcaacagttcacgggtatgaacatcatcatgtattacgctcctcagattttcaaaatggctggtttccagagcacacaggagcagatggttgcaaccatagtagttggcctgaccttcatgtttgctaacttcattgcggtcttcaccgttgataaaacgggaaggaagccaatccttaaaattggattcagtgtaatggcattcgctactatggttctgggctactgcctcatgaaagcggatcagggagatatcagtaccggcctgtcatgggtgtcagtgggtatgacaatgttgtgcataggcggctatgcaatgagcgccgctccggtagtctggatactgtgttctgagatacagcctctgaaatgtcgggacttcgggattacatgctcaacgacgactaactgggttgccaacatgattatcggagcaaccttcctctcacttttgggtagtattgggccagcaggaacattctggctgtataccggcttcaacctggtctttatcgtgataacttttctgctaatccctgaaaccaaaggagtcactcttgagcgtattgaaaagaatctgatgtctggcaacaagctacgtgatttaggccagtaaattttattttacaatagaagccagtcacttaaactggcttttttcgcactgcactatggcatgcagggcattgatcgaataggtcctcaaaatttcataatctatgacttagttattattccgaaatcccaagggaatgtatcgatttcagacgtatttgatattgcagcccaattaattttggtattaacaggttggctggtgagaacatctttatcactatcccatgtaaactccacctctaaaagaggaccagggatttgaggcgataaggcaccaaaagcaatgtagtgccaggctccttttggcccttcccttccagttattagtagttcactgtgtcgataagaactcttatactcaagggagagttcatgaacggttaagagattgcttagtcttaacttaccaagattaggacaatcaaaatgctcagcaggaaatttgaaatttgttttattatctattaatgctacgctgatagtaactactgaatcattagaatcaaaacataacgataccatggagtcagaaaatctatattcccaccatttttttcctatcttagtaggtgcccctagttgttgttcaatccatcgtgctggtgcacccaattctattcccgaaaaaatattttctggagtttttcgcagttcaatccttaaacttggacgattgaacttttgtcttaataatctgactccacgtttacttattgccaaccagaaaagcgcagcccaacctaaaaagccaccgatagcattaacaagaacatcttcaaatggaaagtgtataaaaaaaacttttaaatgaaataaaaaagcgcatatcataaattattaactcatattttttaattttacactcgtggcatcattcacgaatatcgttagagcccagaaaaaatcatattaacccaactctaacaaatgggcttccatggcttctcggcttttttattaatttcccaacatataaatcccttacttctttagaagcaatacgtccaacgaattcgaaacgattggaattatcagcaatattcagaacgcgagtaaaatactgttgcgaaccagctttgacccaacaatctatttcgtatacttccataataagtccgccatatgttgcgtaggcaaatctaagttgtttatctttaggaatgttagcccatatgccacgtgtagcctcatatagttccagtgaagtcataccagatttatatttactgttgagaagaaaagcgagtcccgcatgctcaggtaaaacctcagtctcttcatttaggagcaaatgttgaagctcattaagagtaatacgccccatcattgaactgcttccacgtactttgtttgttaactctccaacacctaagagatcaatacaagttgcctctacaagtttcgccgttggctcatccatgccatgacgaagaatatcaatacccaatttattttttacaagaagctctttaatgcgttcagatttttgagagctatcaggacgtttaatgtggtcaagacaacgaccagacttccctttcccaatgtaaaagggcttttttgaatcatcatctatgtcataaaaggcataaacataatacttagccaattccaaagatttagtatattttataaaatcattcaaggtttttatctccggcaattcatatatctatctattaataaaaatcataatatactaaaaaaaggatcattatgtatatgagtacatcattttagatttccatcgttaaactgtaacttgccacttatcttgctaaaaaccttaaaaatattttttatcgaaccgatacctatcttaaactttttgatcggaatcaaaaaatcaaccaaaacaaaaaaatacctcttgtttgttttttagccaaggcgtactgtgcatttgcagacaaaaaatggagatagagtaatgcctaagtcagattgggactatgttaatacctctcaagaatacgaactcaacgacctactcagtaaacatggctacagagaaacagccgtgaacaggaaactactcaaagataatctaccagcaaatactaaacatggtgatgtcgctaatttaattcataatattaaggggttagagaaataacacccccccttaaacaagcaataaagaccgcttaaagcattttctatagcggtcttactgcaattttcagatagatgcaaaaaccttaaaatatactgatttttattaaaaatgacattcacaattttaagaagcctaaattttaaaaagttttaaaaattatcgttaaataattttagaaccagaatctgccatcttaattacaacctaaacgatatctttaaacttcaacaattgattaatttctgttatacccaaactttctagagagaagtatagttttccagtgcttttcacggcggttaatttcattcacctcggcattattgtcaatcacttcaagtatcgcaaaagttatatgttgcaaatggctttcgtcgcctgtaccaaaagcttccttaagccccaaattgccgccatgcccggaaccaaaataatgttcccatcgtccccatattccttcactgccgtcagcctttccaacataaagcttcccttcaagttgatcagttaaaacataaattcctttaactattgataatgcggttcgccaagattttaaattaagcctaagaattgcacctatactgctataatcaagtataatgttacggtaacctggaaactctccaaaactcagtcgcgttggagttatagcagttacatacaattggttttgaatactttcaccaacccggataaaacttctcgcaggatttttaaacgtgacatacatacgtcccgcatattcttcagtctcaaatatttttttaagatagtactgatagtacatatcctcccggttagcataggcattttttcccgcattgcccacttgttgaaatgcgcccgcaaacaaccaagtttcagaccctacaatcctgattagtgaaacaacatatttacgattgaactcaagtctcttctgccagcactgccaatcatcgaatgtctcttctcgaaatttaatcagtggatcctcattatagtcattcatttgtgccaaatggactttcgtagattcaggtgttagatctgggaatgtcatcatcagataatcaaaaagcttcaattcgtttcctcatgccaaatttttcaaaatctcagtaacgcaactacacgcgaccgtaaactatcggacaacttcatacggaaagaataattgagggtgcaccaaaccaaaatagtctattttttatacagaaatatcatattaacttatagttaatcttaaaaattggaaagaaaaatatacgccttcttgcaacacactgaattatatagataaataaaataacattaagattaattagaaaattcttaattttcacgctgaaacattctaatatgtacagaaaaattgcagtgatttaaagctaatagcataactcactgattactggtaaattttcaattcaaggttatgcgtaatggacgaaattgaagtctcactttacaaaaactccaatctgtcactcagccagaaacttgaaaagtcgcgagcagagttactcgatctgacagctagaaatcgtttacttaacataccaaaatcaaaaactacaaaatttttggaagtagttaatgaaagatctgacattttgttcaagatgctttttgaagaaggcaagccgttcacttttcttcatggtcgagaagataaaaagacagatgaaagcaatgagaacagtgagacagacacagagtccgaagacattattttcttagatgactttgaaaccaaccacaatgatacaaaactccagacaaagctcacgccaaagacattacaaaaaaagttattagatttatattatgattcaaaaacccttgaagaagagcaaggcgtaaacatcctgtttctttcgttaggatcgcttaaatgggtagatcctaataagaaaacaaacatacgctatgctcctcttttactattgccagtagaattaatgcgagctaaagcaggagaacgctttaaaattaaagtcagggatgaggacatcattagcaacctgtcgcttgagacattcctcagccgtgttcaccaaatcaccctacctcccctgagtatcgatgaagatttttctttaacgaattacttcgcagagataaaacaagctgtatcattgaaagaaagctgggaagtattagaaaatgaagtcaatctaggtctgttctcctacgctaaatttatgatgtatacagatttagatcctgataactggccttcagattcaaagatcacagatcaggaatcaataaagtgtcttttagaaacaggcttctctggtggagagttaatctctgacgacattgtaattgactcagtcatccccccacgagaaatgcttcatattttggacagtgatagctcacagactcttgccattcacgaagtacgtaatggtaaaagcttggttattcagggtcctccaggaactggtaaatctcagacaatcgcaaacatcatagcttcagctgtagcagacggtaaaaaagtattgtttgtagctgaaaagatggcggcccttgaagtagttaagcgcagacttgatcaggcgggtgttggagatgcttgtttagagctacatagcaataaaaccaacaaaagagcattccttgaagaactgaagcgagtctgggaactcggttcacctcggggagaatttccagatacattagtcaataatctcacagaaagccgagatatcctcaacaatcacccggcaagaattcataaaaagtacatgccatctggcttaacgccatacaaggttatggcgcaactggtatgtctcagacaatcaggttttgatcctaatgattataagcttagcggttatgaatcatggagtaacgacgatttcgccaaaagacatgcacttattgatgaattaattaagaggataagtgatattggcattcctgattcgcacccatggaatggtatcgatagaactgagatacttcctagtgaagttgaaagactcactgcctcattaacgaacctgaagtctgaactttcagattctattgaagagtctatcaatctttctaaacttaccaatgaagcctatcatataggctcattaaaagagttacaggaattcattctaatagctgaattaattaactcagcgcctaatttatcacctgaatcattaagttcgccattatgggccacttctaaagatgagacaaagacgttaattgaaactggattctcatttaaagaactctacagcaagcttgaaaaagaattacatgcagacaaattcaacaccgaggtcgccagcctttcagaagattatcgtaaattacctgtagatattaatattaatgcttttactactgcctataaactgaagacacttacacctagaatcttaaaagagtcttccagattgcagcaggagttgggttctaaaatcggattctcgaatttaagtgagattgaaagtcttattgagttgggtgaaagtattactcaagctccaaatgtgagtccagaagcattcattgccactgtctgggaaggtggtattgataaagcggcaagtctggttgcagatattaaacagcttagtatttataaagaaaaaatcaatctcatctttgttgaaaaggcgtgggaaacagatgcagaaagcacacgaaatagccttgaaaacaacactggcgcttttaaattccttaatagcgaatggcgaaagtcgaaaaagcttaccctttcattgataaatgataaaggtttgacgatccctcagcaggttgagtacctcgatctgttgataaaagcacaaaagttgagaaattccatcattgatttgaatgatttcggacagtctgcatttggttcagactggcgaggtgagaatagcgatagtgaattgctgaaatcacttgtcgaatggatgcgtaccttacgtggtattaactctgaagcccgaataattgcaagtcgcctctccaacaaagacgccttagcatatcaagtgagtcagcttaaaaaactcacccatgaagttttagatgaaagccgtattctttgggattcattgggagctacgccagaagagtattttgataactattattccgttaaaagcattccactggaatcattccttgtaaagtctgatgtgctaagcactatggactccgcgtataaagatgttttcatcaaagatgattattctgtttctgatcgtattgaattgttgaatttgttatcaagcgctcagcaaaaactcaacattatccatactttcgataatttagctcagtcaaccatgtatccattatggttgaaagaaaacagtaactgggaactgttacttcaaactcactcatggattgaatcaaataacgacctaagaatcttagcgtctaaaatagatgacagacagggtttagttgataaatcccgaagcttgagtgagtctattcaagcgcagtttgccaaactcacatcagtgattacttcgcttagatcttcctatcgatcaattttcaaaaatgaaaatattcatgaaatactatttaatctagtctatgacaagattactctttggatagataattctgaacaactttcaaaatgggttgcctggcaaaaccgtgtagagctggcgagaacatttggtatttatccattaatctccgatttgagtagtggagttctttcccctgaacgtttagcgggtacttttgacagaacttatttcgactcaattctgtctgtaatggtcgaagatgagccagaactggctcgttttgatggtgatttgcattcaagaagagtagcaagcttcgctgaaatggatctgcgaagaataaaagcttcgagttttgaagttgtaagagctcaccacagagcaattccctctaaagttggcgtaggccctgtgggtgtactgcggggtgagatggcacgcaaacgtggccatatggcgattcgacagctcatgacaaaagctggtgcagctattcaggccttaaagccagttatgatgatgagccctctgtcagttgcccagtttttagtaccaggtaagcagtcgtttgatttactggtaatggatgaagccagtcaaatccaacctgtagatgcattaggagctattgcacgaagtaagcagatggtcgttgtcggagacgaacgtcagttacctccaacttctttcttcgccaaaatgacaggttccgcagatgagcaggatgatgacgagtcagcacaagtggcggacattgagagcatacttggactttttgttgccagagggttgcctcaaaaaatgcttcgctggcattacagaagccgccaccagtcattgattgctgtgtcaaatagccagttttatgaaaacaaactttttatagttcccagcccctatacacaagaagcaggtatgggcctaagtttccataaagttgaagatggcgtattcgaatctggaagcaatgcaaacgaagcaaaacgcgtagcaacagcaattctcgaacatgcaagaagccatcttcatttatctttaggtgttgctaccttttctgttacccagagaaagcgtattcaggacgagcttgaagtgcttcgcaggttgaaccctgagttcgaggactttttctctgcacacccaagcgaaccgttttttgtaaaaaaccttgaaaacattcagggtgacgaacgcgacgtcattatcatttctgtcggatatgcccgaaattcacaaaactacatggcaatgagatttggtcctcttggatcagagggtggtgaaagacgcctgaacgttcttatcagtcgagccaaaaggcgttgcgaagtttatgcctcagtcactgatgaagatatcgatcttgaaagggctaagggtagaggtgtattcgcttttaaacttttcctgcaatatgcaagaacaggacgcttgtcagttgcagaacaaagtggccgttcaatggacagtgtgttcgaagaacaggttgcaaatgctctgcaaaaagaaggcttccaggtccaccctcaagttggcattgcaggtttctttattgatttagccattgccgaccctgatatgccaggccgctaccttatcgggattgaatgcgatggtatgacttaccactcttcccgttcttcgagagaaagagatcgcttacgtcaggcagtgcttgaggatcatggttggatcattcacagaatttggagcacagattggttccagcgccccgaagagcaactacagaaaaccctctttgctattcaggcggctaagaaagagctcgaaaatcgttctgaaacttctctatctcggtcaagagctgtacctgtcgagatagtgacagttgaaagagagactgtcacagagattggtcttgagacaattgatggcagtttcaatgaagctgtggcatatgttgaggcggttcctgacgttgacacaagattccagattcatgataccccagttggcgtgctcgccaagatagttgagcaaattgtgcttgtggaagccccaatacatgtgaatgaagttatcactcgtgtcaggtcagcatggggtttacaacgtgcaggggcccgtattgaagcaattgttagagatgcgataaaaatcacaacctcaaactcttcattttccctagaagatgactttttatacaacgataatctttccataacattgagagacagaacgaatgttaaatcagcaggattaagaaagtcagaaaatatctctaataaggagatggaggcgggaattattgagattatcaataaaagcttcggtgctactcaagacgagttggtcaattctttatcaagggccatgggcttcaaggctacaagtggtactttaaaagggattatcacttctgttattcaggacatggtaagcgataataaagttttttacaaagatgcaatgctctatatcgcataagttaataaataagcggctaactccattagccgcaaaaggaggtaataaatgaaaacagtaggacttgcatttctaatatactttattttaatttttttacttgctatcatttataaaatagctcagttcttttcgcctcagggtttcttagtagcaacccctgtgattaattcaatattacttgcaatgctctatatttctttttttcgaagaaaaaacaaaggtaatgatcttactagtgttatgaaaccagcgaatgatgctttattattttcttccgccgcactattaagcctcaccactttttcagctgagttttcgctttatcctttagcttctacgacttactttttattgatgcacccacaactttatctttttataaaacttttattagtcactgccgctttcgttaaagcgtttatagcaataatagaaatggcggcggaattcaacgttatccgtcaacaaaaataatagctattaaaaaaggaaatagcatacctaatatcacaagcccccccattgatgcattgtttaccaggctatctttgggggaaaaagcaaatatcaaagttgttatagttacgaacactatatagaatataatctcttgcttatgcgttgataacttatttctaaaaaccttattcatagcatctccttttttacattcacaaataacatagataactataatgtcaacacccacacttaataaaaattatataagcaagggctaactcagcgaagctgagtagccttgctttttctgcccttcggttgaaaaagggaagtcaaaacctacatcgtttacataattcatctatcggttataaatagaacaggcataaggaatatgcttatttttagaaatggagattctatgaaagatatataccgccctccccttgcagaaaatctacgtattcattgcgtcagcgtcagactcaataactcagagctaaatattttggatcaagagcgtaagcaacatgctaagggcgaatggcttcgcatgtgcttcatgaaaaaccaacctgttgtcgttcctgagatcaacagagcggcatggaaaatgtttggcgagataaatcacagactcaatgacattgttaaccacctgaacacaaagcagtcatgtaaccctcttaccaagactgaactgttcgccgttaagcgacagatcactgaacttcgctctcgcctccttaccgctgatctatggagtatcccctctgatgaagggcatgcagaagatcaaacgcggtaagagcttcgcaggagttgttctatacgctttaaagcatggaacgcaccataaaactgacccggtggtcataggggggaacatgctgggagactcagcagctgagttgatagctgagttcactgcttcggcttcattacgcacagacgtggcaaaaccggtgtggcacaactcgctccgcctatccatcggtgaatcactcacgacaaagcaatgggttatgtttgctgacgactacatgaatcgcatggggttcagtgagacgcacctacgctgctatgtcatacatgacgatgaggccggccagcacattcatatcattgcgagcagagtggatcttattggagggaagctttacctaggcaggaatgaaaacctaatcagcacgcgagtaattcaggagcttgagatagcgcatgaactgactaaaacaaaaggtccctcgccttcacatagcccttccccatccagtaagcgtaagaggctatcacgaagtgaggaacagaaagagaagcgcgaaggccagcaaagccccaagactttcctgcagaacacaatagatacactcctcagtactcacaatgacattcagagcttcgttgaagcacttcgcgagcacggcataacgcccttaccaaacatttcctccacgggtcgtatgaatggtttctcctttgaatactcaggtatagcttttaaagcttcgcaactcggtaaagggtattcgtgggcaacactgcaagaaaagcttagctacgaacccgaacgtgacaatcctctgctctttgctttgaaagcttcagctatgggaggtaatgagacgagtgattcagatatagaagttactaaggtagctattacaccgtcattaccagctgcttttgaatccgaacttacgcctcctcccatgcatgaacatagagctggagcgtttgagacaaccgaagcgcaaactcagctcaggattacacatatggcatgcgagcaaaccagcagcgcagactgcttcatgacaagagtattgaagtggctactgagcattccttacttggctgctttcacagacctgcttaaaaaggcaggtaagacgtttctccaccaaaaatcctcattttcgacaattcatacagtcctctcagctgagcctgagttatctgagccattaggcagcggcgaaatactgattgaacgcacaggagtgccctttcgataacctcctgcctcaacacaaatttcaagcctaagtccttatttgagcaaataattgatcgtttttacagatcgataaacaccatatgatagacaatagctatcaaaataagatcatcgatcggtacaagtgatttgcttaagttttgaactcgttcaaaaatgcgtcgtaaaagcagttaccaatcagccagttatgactcacatgacgttaaaggtatataaaatggatacagcggctttgaatggcagaaaagtgcgtaaaccttcattcttccggtcaattcgattctggattgttgtactggtgattgtgtggatactgactgattcaaatccaaaagacactgcagggttcctgttcatgtggactttacccgctttctttttactactcacagcatacgtgtcatacacgcataaaagagccaacgcctcgacgattgatcagttgaacgtcaacaatagcgggatctggagccatgacttccagaacaccaaaatgaccattgatatgaatcgtgagttgctaactcttgaggcaggtaagcgtaaaaaagcttacaagttcaatgaggttaaaggctggagataccacctggctaatggaggggaaatcgtagctcttgatttagtcggtatggcgggggctaaaggtcacaacaaccttactcgccttaaaaacttcgagaactcagggttcttcatacaggttagagacattgaatgcccggagtggcagatcaaatttcaccctcgtaaaggccggtttcaccatgaacgagggatccgggatacagaaatgcagttaaagcagtggtgtgagatttttgaccagacactcaacaaaaccacagcaacacaataattatcaatatcaaataagggattaagaaatgaataaactttcaacagttgcagccctgtctttggcggctctacttacaggctgcgacagcgaaccctcccctaccgaaatccagcaagctatgcaggacaacattgaccacacaaaccagcaagccagacagcggttcggtgaaaacagcaaagacatgctcacgactctgaacaaagctgaaaaggtttcctgcaaagagtcagaggcaaaaggcacttatctctgcaaagttgatacagacattactctgccatacctcggagaaaaacagactgtggctgaattcaaattcactaaaaatgagggtaactggaaagtatcaccttaatttaatccaacaattaacaaactcatttttcaacgaaatttcaaagcacatattttatgcgcaagtgttagcaccagggaaccattcaaaaaaataaaaaaaccagaagcctttcaaatgtgtgtccggtttgtatagggcttaggtaatgagttacaatcagactatcgtaagacaaatgaatgacgctcattatgaacaaaatgcaaatcgaagaaatgcttgtaaaagaaggatttacaccaaaagaagtctctgtgatacgtcagcatgctgagaaagacggttatccttatccttggctcctttcacagttaaagaaaagattcatagttgcaatgatattaatagcaatccttctcgcagggttcatctataccattcgcagtggtacacaagaaaaccttgtttcgtattcaatcacgcttgtagcaggtttcgttattttatatatattcgtacctttgaaacctgcatttaaagcttacagattcatgaaaaagcatggtcaatctttgtaagtatcagagattgatttaatggctgaagcgtcattatagacttctatgaatagctcttttctgctcatttccttaataccgcgaacgtagtcggtattaagaaaatagtagagccgccaggcctcaggtttttgtaccagacgcacgatgccatagagagacagtgccagatccattgaactgtatgctaactgcccaaccctctgatcgaaccctaaaaactcagctgttgctacataaccctgtttgagtaatcccacactatcagttttgccatataccaggttctcaacagactcctgaaaaccgttgagtccatgcagaaccaacattcccccaaaggctgaacctatgattgtccctgacgctagggaagcaccgatcactgatacaccggctattacctgcataccgctcagcactaccccaacaccattgattacatagccccaaaaatctccattcttgaccaattgtaccgaagcatgaaccgcagctgttcctgctctgagcattctgtcctgaatcgtaaggtattcattttcctttttgagattttggatgcactcctgacattgatcatcagtggagtctgaacggataacgttaagctgagcgttaacgaaagctttaacgttatcctgaaactgtaacctattaaatccgtctttaaggtagatgtgagaaaggtgattagcattgctaagcagctgatttgcctcagcatgagccatagtcagaaagtaatccttgaatcgttctggtttccagtagtccatgactgtgcctttatgtcattatacgcatcattaagtttatttaatcagattacccttctcagggaaagaaaaaggaccagtcatgagtacagatctcttcttgaaaattgatggaattacaggtgaatcacaggacagtaaccataaaggctggatttctattgaatctttcacatggggcgcgaaccagccagggaacatgtcagttggaggcggaggtggtgctggaaaagttcagtaccgcgatctctcggttcaagcccagatagacaaagcaactccagcaataatgcgctatgtctctaacggcaagcatattggtaaggtagagctatcggtatgtaaggccggagggagtcaaatcgagtattgccgcattacgcttgaagacgttcttatcaccaatgtgattttcaatggcactacaaatcgtgatttgatcggtgtctcatatcagttccaggcttcaaaagttaaaactcagtactgggagcaatctgcaagcggcggtaaaggtgcagaaagccagtcaggatgggacattaaaagcaataaagaaatgtaatttcacttatcgaaaaaattacatctatcaaaactttaatacttatagttaaaacatgatttataggattaatttatgttaaaaggtcttggcgttaaaaacctgagaagcttcgaaaactatgcttatagcgaattaaaaccattgacagtttatttaggaaggaatagtagtggcaagagttccttgatacgtttatttccacttttgcgtcaatctgtgcaggaaacaacaacaggcccaatactttggtacggtagatttgtagattatggaaattttagtgaagctatttgtaaaaacggtcaaaataaagatattatcactttaaagtttgatttgagtattcccttaggtgttggttttgattatttttacagcacaggtcaatattataaaggagattacttgaccgaagtttcggtagaattgaatataactgaacatgataaaaaaactctcaccaagtcaataagctttgagataaatggtgcaaaaatattaatcaccccttctttttctggtgaaaaaacttctgttatagcatcatcaaatacatacgaacattcaattgaagcgcaaccttctttacaaagagattttaaattttttcccgatttaatctggacaccagagccacaaaaaaaacaaaataaagaaacaagtctttgggtaaaaaataattctgatgatcgctatttagattacagcagccataatactcaattgaacaatgttaggtatcataataaaaaaactgcagaagcagctgcacaagcaataaaaaaattcttccattcctctacaagtatatctacgattgcaaaaggtgttttagaaatatattgcttcagtagagaagaaacaaaaaaacagactcttgaaatatttaaaacacaaaaatatttccttggtaaaatcaaagactctgaagcaatggaagatttactagatgttttattcccctttgttttgttaaaaaactatcagagaaccactaatgtcataaaccactcactgagagaatcttttttatcagtaaaatatttaggtccgatccgagccaatagtgagagattttatcgttttcaggatctacaagttgatgaaatggatcatacgggatctaacgtcgcaatgattcttaatgcaatttcagacactgaaaaaaacaagttccaagaatggaccaaagaaaactttggttttattgcattagtgactactgatggctctcactatgcaataaaaatcaaaactgaaaacgatgtaaatgagcataacattaatgatatgggttatggtttctctcaggttttacctattattatgtccgtatggttagaaattcaagatcgttctgagagtcgaaaggaggtaatatttgtcatagagcagcctgaactccaccttcatcctgcatatcaaaataaagtagcatctctttttgcaaaggttattaattcagtacgcggcaccaataaaaatattaaattcatttttgaaacccatagtcaatcaatgattgatgctattggtgattgtattcagaataatataattagcaaagatgatgtaaatataatgatttttgaaaaaaacaaagattctggcagctctacctacacagcaaactttgatgatgagggatattttatcaactggcctgttggcttcttctctggagaataatatgttaatcgaactattcacctccagaaaaatagatttagacgataataaaattgaaacttctattcaaaatatcttatgtgcacatcgtgaaaggaaacatattgtaatttctgatgaaagttttttgaaagagatgtctctccacaaaaacttaggtgcagttaactgcaatactgcacaaaatatccttcaacatacaaaagaaatgcatcttataaaaaataaagttaaatatttttgtagagtagacatgtcatcttctgcaaatggtgttattggatgtgataaaaaagacaattactttacagttgggtataatttttttaatgattcttcagtttctcagcaaaccaaactactttgcgaagatataaatgattataaattatacaaaataattggggagcattacaaacacagccaaaagatgttaggtattaatattaattttgatgtagtaagcggtggcggcgggggaactaaggcaaattacgaccatataaaaaatatgcaaaaactatgcttctgccttcttgatacggataaaaaacatcctcgctctaagttgggttcaactgcaagaaaatttaaagagtctgacaatagtcctttttgcaaatttttcattatcgaatcccatgaagttgaatctttaatacccatggaaataattgaagaggctattaaactgaaaaaattagacagtaaataccttgattcacatgatcaactaaaagctcttattgcttactcatccgaattaaaaaaatatttcgatcacaaactgggcatgtccgttaaaacaatcaacgagatagatgagacatacaatgacagattttggcatgatcccctagaaaaagctcctaacttcaaacgtaacaaatgtgttagagatatgaattgttcgtgtaaagaaccttgtattgcagtacctggatttagtgaaaaattattaaacgcaagctcagaagttttatcaagcttcaatctagcaaggttacccccattactaccgccacatatgaaagatgagtgggataatattggtgagttactttttagttggggatgcgctttatctaatcgagcgagaacttcttaaaatattaaaaaaaagagccgtattctatggctctttttttgaatttcgtttaaattctttttttctttctcttactcctagccgcaacgacctgattcaagagtacagctttctcatattttaccctttcctcacgataaatattttccgcctcttcttcattatcaatggcataatgaatcataaagcgaaagaaaaacgtgatctcatgtttatagccaaggtgctgactgattcttagagaactcgatttaagagcgtttgaaagcatagatatgatcgtaaaacgatcagcaacatctgttttaaattgtggaaggtagtacttaatgtagtagccgacacagaatagccacatatatctaattatcttgtcctgagcaaaacctgatttttttaatctctcaatgaacatttgtaaaagcaaaagtaacttttcttcccttgaaagagcgtctgtatttttcatagattgcgtccttgcaaaattgatcaaccactccctggttgtatatacaagataacatataattttaattgcgcaatacctgcgcaactaaatatttaatcagcatttgtttccctgtctatcttgggtaatccattattaagttgttcaaaactgattccgtgatttatagcattaaactgccatacaacgaaccgctcttccagactcctcagctcttctgccagcattttatttttgaattcgagattcctgatgcgctgtgaggcaactttcaaattagctggccgtttttcttcatcattaccagacttaatatttttcttcttaatattgaaagccatgacaatatctttgtgaagccccagtgactgacgggttggtcgcttaccaatcagaggttcaagcctgtcacaaagatattcccatgaaagcttacctgacttctcactgtcccaacctgctattgtgtttttaattatgttgatgtctttattatctagatgtttagccatatgactctccttttaattatgatttatcctttcatttccaatcagttcattcctgctcacgccagtgagatttttcatatgtgtaaaatcatcaccattcagtcttaccaacgccccatcctcaagttttttgcttttgagtaacgctatcaaatccagaagtctagcttgcgttttttcgtgataggccgcccacttgtcagccccgtactcctcgtcttccatgtcaacctttgccttttcaataagctgctctgtgtatgctgcagtagcttccagcctgcctagcgagtctttgtcccctttcacgcacgtatgatcgctgcaattgatacagtccctgaacttcgtacacggtgagattacgtagtcatgagtgcagtagccgaactctgtcacgtgaatggctgcgtggcctgtatccttgacatcaatacgccatgaaggctttgctacagctcgtggggtggtgttttctggtttaatgccaatattctgcacattatgcttaactgactcccgaaccttctcttcctggctgacgtggttataagttctgttttgtgtttccctcactcgtcctgaccacttggccagttcaaaatcgccaaggccaccacgttgtgcaattgtattaagtaagtgtcttgcctgatgacttctgagtgaaaggctgtttccatttgcccctctgtatccgtgcctgtcaaatatcgttgtaattgaatgattccgacgatattcagtgcttcccagactggtgctaaccatagtggcagttggtctgaaaagagatctttgcgtcgttaaacttgcactgagctgatatcggaacagaagacatagtgcgttgctgtatcgaatgttcttttctttatcgtaccaggggaagtctgggtaaagctctcggcccttaccggaaatctcaatctctctggcatatgtgcgggcgttttctgaaagagtcctcagcctcctgatagctatctcagcaaccgggaccatgacttcaggtatccatttcacatttccaccaaagcctttttcggaatagaatctcagcccatacctcagctttccttctctgtccgcttcacggatttcacaatacgcagggagcgtcaggatttctgttactctggaaggtgcacacataagcaacgcaaagacggagcttatgaacacgtccatttctgaaagctgaccgtctggaagtgcgaagatttcagcgatagcattcaacgactcttcgtcaggtaactttgcctcacgggcctcttgtgcagttttagtgagcctgttgcttgcttcctgcgctctgagtggactcttccagagcagtgactgcatgatcaggaattctttttctctgagaaatgaaagcagtccttccagtactttaccgcaggcatgcgctactgctttgttgtatgcgcttcttaaagtgacaacgcactgctccagaacagtgaggttaacgtactgaatatgaccccgcccattgacctgcaagagggctgcctcaagtgttctgaaaacaatattcagacgctgattgattttcttgcctccattcatgtagtggtaaaggacatagcttttagcgaactcaataaaattcttgtctaatggctcatttacaataacagagctttttttgacgcctttgacaggggttttagtgaaaaggaaaacttttgaccagttaacctcctcccagctcacaaggtcgtttttattgagagtgaaccgagagtagctcacaaaatcatctattttctgcgcgcaatatttttccctgcgcgtttcgagcacttttaacttatcatttttaatatcatccatttaacacctccgggtttgttttgatttctttgcacttatttatcacctctgatactgcaataattgttctatcaagtatttgtatagtcataggatcagccactatgcactgaatcctgttacgctcatcgagtaaatattcgagtaatttttcatgcggcccttcaacaaaaggtctgaaatgcatgcaggtgtaacagggtatgggcacacatgctgtgcaggatttgcaactggcgcattgccctgacttttcaccagtattgattctgatgttgccaccgggatatttatcctcacttttgttaatcagcactccctgaaacatctttgcgtagtaaccaagctcagtggaaacggcatcttcgattctatttaaactatctggacctgactgaacataaacgcctgtatacattaaagtggaatgatcaagtaattcgcctatgacgacttctccgtagccctctcttgcgagccgtgtacctaacgtatagcgaaaccgccgggcattcatatttattacttcacccgtcctttccgagattacgttctctgttgtagctattcttttgagcgtttgagtacactttatcgcataggcatgaagtctgtctgaggaaagaatctcatgtagattctcacaatcaacaatcgcttcaagcctttcctgacagacaaacaatggtaattctaatatctctctttcagagagctttctgccaagctgcttgctaaaagcctcagaaacaatacgagcctgctctttaaatatgttgaataattcatttgtaattctgaatcgcctgaatgaggctctgtatttttcaccttgctttattctgggaacatttatatagcattcgtttatgattcgttcgtttatgatatctttagtttttatctgtgtgatttgtaaacttcttcttcccgtatgaatggtgattaaggccattgccagatcagaataggatatcgtccccttctggtatgcgcgtgagacagcatcgtaaaagttatcaaactccatatctgtcagaggtccctgataagggtctcgtcttttaaccacctccccctttttattgtcttttatcgtccagttatccacgagatctacaccgtttggggtaatcccttcaaaacctagctcataccattttttgattaggatcctgagacaaataagatcctgattagagaaattattacttgattttgctgttaacattacagcttcgtcaattgaatcaaaactcataaacgaaatgaatttcatgaaaactctgttaatttgcttaactgaaccggggctaatttcttctgcgaaatatttcagtgtattcagataaccgtacctgaggttatctggcatcctttcagtgacctcacccacattcaatttaatatttctgctcagctcccagaattcatcatccaatccgaacgtgtaactttcattttttgcctgaaagatatctcgatgcgcattcttaaaacttaatttattcataggagacctcgctgcgctttttaaagatattatcctgaagttgcaatgctgcttttactgattcattaacaataaatcgtctgttgtatatttgtgctgttccagaacccggctcccaccccatatggtctgaacgcattttctcttgcatctcttcactcacatactcagtgctttcatccattagtttcgaaaacagatagttccaggtgtgtctgaacttatgtccggttaactggcttaaacctgagtcaatgcttctcagtctgtaaatgatcttatggtaagaaggaacggacagaggatcgccacgtgtctcaccttctttgtgcgtaataaaaaggtatccgtgctttttctttctgatattggcttttctttcgcctgtaatatatgaatggagaagtctggtaagttcgtcagacatgggtaaatttctttcaagcgtttttacgaggggctgattgactcttgtgtcctcaatactgtcagcccttcgtcttatgaaaagcatttgcgctgcaaaatcaatatcttctactctcaggttcaataactctccacaccttatccctagcgaatgtaatatcgtgactataagctgatttctctggcgaacttttttgtcgaatggattaaattcacattgaggattaataacagaatgaagcatatccaggtcttcttcttcaattgttttatagacattgccttctgaattcctgtattttatcttcggccttctggcttttatttttttcacaaagcaggagattttcctatagccatcatctatattcttgatagttagctgacacaaccattcgagatatttcgctattgtcgtaagccgtatgtactttgtcgcactgcatactccaggatgatgatctttgatattaatcactttcgcagttctcatcctctttccgacaaaatcccgcagaagatcaatttcgttgttatccaggaatcttgctgtttgaattcgctcttcaatgtctatattgcgtataaaaagaaaccgataaaaaagtgcgatacaccctgcctgagtctcaattgtctttatcgattcactactgtttctcagttgtgtagtaataaataaacatggataaaataccgggatacctgttttcttgttttttataatgcagtagcgctcaccatttttcattttaaacgttttaacaccaaatctttccataaactctccttttttttcagttaaattctttgcaaaacaggtataggttaaatattcaaaaacaatgacctacaataattttgcaagaatattttattaatataccgcttaataactgtcaataaaggatggtcctaaatattctttccaaatgttaataaggtatatattaggtgcagatataaataccgaaaccagtcttggtgataatgcattatttttttcagatgctgaaacgacatcttacttaattgagcaaggcattaattttacccataaaaacaggcaaggtgaaacggcaattttccattccgagaaagaagctttgaaaattttacttaatgctgggttaaacgttaaccatactaattcttataaccagaatgctttgtttttcgttaatgatttggaatcaatcgatattcttgtcaaagcaggaattaacattaatcatattgactcattcggcaataatgcacttatgacactacttcctattcttgaagaaaatgaagaatgttttcagattattgattacttctttgaacatggcttaaatattaatcaggttaatcatgaaggctataatcttttatttataggtggttatcagtatgcaaaatatttcattaataaaggtattttctatttacctgataccttaaaaacactctgcgtagcttgatataactgacttcgcattatctctgtaaagaattttgcaaaatttaagctattttggcttttaattctttccatttttatcgacaacttccacggcattaactttaaataacataactttttaactagtcaatagttgcttttatttcataattggttatacatgaataaaaacttggggagagcctatgattgacattaaaaacaacctggaaattatgtggatatattttcctgaaaatgaacatgaaatcttgcaagaattaaatgaatcctccgccttcgatttctacgaacgctacctattagagttatcagcaagtgagttccttgatttcttccaatatttatctgacttcaaaatcgacaatgaccttgatgatcaacattcaatatctcaactcattagctatggctttggtcagaaatctactctcgacggagaatcacaattcgaaaactttcagtctattcaatcacgtgttgccgatcttagaaacgaacatttaactcaaagaattaaaaatgaacaggaagtgttgcattcgaagattgaactactatcagaaaccataaaaaagcaaggcagattgtaattcatatatataaagggccatgcatatgttacatgaccccattactattactgccatattaacgctataaaaatacgatttgtttaaaataaccttacaacttgaaattcttgaattcatgttcagatttaaacaaaaggattattttggccagattctcaacatctgctttctgcttaaataaagacatccatattgaaaagactgcgtactgtaatttaaactcaaattcaaaaacagttgatattgcaccctttatatttcctgagagatattctcctaaccagaaagcaatacttttggaaaattcatcattacacatggctgtaactgcaacatgatcgaatctttcattaaatgattgtttttccatagacctaaaatattcattagtactaataaaatcgttcaacttcacattaaagccctcttaaatggtttcgtttcgtgatttagaaattaatacctctatccactcatcaatctcaccctcaataaatgccaccgcacgagagccaattttgataggttgaggaaattgctttttactaataagtttataaatccatgacttgctataacctgttttatttattaccgcacttaagcgaatgagctttttatttgaaatgttcatactgacgctctctcttctgtttcgatgagagctacattacaggaggaagatcgggtgagtgagtgtggctcgtgacaacggagccactggaggcggggtcagttggaatccgagagtttcatgacgtctgaaactctcatatttttaaggtgggggtttcgatttatgaagaagttgaattgccgaatgaaatcaatagttgctgctttcatagccagtggtctatcagcgtctttgatttggtagttaagacggattactgtctcatcgtcttcgtctgtgtacagcagtctggaaagccgctcgtctgaaacacgcaggtcatacatctttgcccataaaagaacatcgagcattgctatgagacgataagagataaccttcttgattgtgccgtagccgaagcgcacagcccctgactcgtcagcttcaatccccttcacgcgtctccattgcggaagtgctgacttgatagactctgcaatttcatcgtctgtaccactggcaaggtcgatttctaaaaggacggtgctctcacatatcgctgacataaccgtagatacatgggcttcatgatggggaaggtttacgcagtactcgtcactaccttgctcccaggagaacagattgacccggagacccgttacactaagttgagcaaggcggcttatgtctgtgatgaagatatgcggtgggctttgaagagtttgatcatcttgcatgtagttaagctgttcgggctcgaagaggaaaggcttcccattgaagatctgtctcatatacccaccgaggccgatcttttcttcttctgtggaccaaggtttaaagagcaatgcccttgcccacagctcatgatagagacagttaagcgtggtctcttcgaactttctatagcttgaaatgttcagccaggatttgactgctttagtatcttctgttgaccagtttttcaaagcttattccttcacgatttctccatgaaaagagtataatcaacactgttcaatcaacgtcataaagctattttgaagaataaagttttttgttggtatctttgttggtacaaatgatttcaaatttcatttttctcttaaattaagtcacttaaccgaaggttcgattcctgcaggggacaccatatacacttctcctgacatctaccgaattcaataaaacccatttataatcagcgacaaaccctctattctggctatgcgacgtcaacagatgtctacccatttcaacgcgaatcaataaacgcttgggggccttagtgggggcttatcctgttcaatgaaaatcgaggcccccaaaatgcccttaaatgcgcgtcaggtcgagactgcaaaacccagtgacaaagcctataagctcactgatggtggagggctatatctcatggtcaatactaacggttcaaagtactggcgcatgaagtatcgatttgccgggagagagaaaaagctctcattcggaacctacccggatatttcacttgcggaagctcgcgctaaacgagatgaggcaagaaaggtattggcgaatgataaggatcccggagaggtcaaaaaagccgcgcagttagccaaaaagctctcggttaccaacacatttgaagcaattgctctcgaatggtacaacgcaaaagtatctggctggtcgaagagttatgctgattacgtcaatcgagcttttaaaaataatgtctttccctatcttggctcccagccggtaaatgaaataaagccgctagagcttttgtctgtgttgcaacgaatagaaaagcggggagcgtctgagctcacaagcaaagtacgccagcgttgtagtgaggtttttcgctacgcgattgtgacaggtcgtgccgaatacaacccagcagctgatcttggtagcgctttacaaggccatgagaaacagcactatccctttcttaccgccgcagagctgcctgagtttttgcaaaagctataaagttactctggaagtcttattacccttctcgcaacccgattgctcttgctgacaggattgagaactgtagaattacgtctggctgaatggcatgaaatagacttcgataatcgtatctgggaaatccccaaaactagaatgaaaatgaaacgtcctcacattgtcccattatcggctcaatccttgagcgctcttcgtcaattgggagagttaacaggaaactatcagctcatttttgcggggcgaaatgatgtgaacaaaccgatgagtgaggctagcattaatatggttcttaaaaggattggttatgataagagagcaaccggccacggttttcgccacacaataagtaccattttgcatgaacagggttttaatactgcatggatcgagacgcaactcgctcatgtggataagaacagtattcgtggcacatacaaccatgcacagtatttggaaaatcgtcgcgagatgatgcagtggtacgctgattttattgatgaaccagaaggtacaaatacagcagtataaaagctcagcccgtaacagggctgagcctcagcgcgtttgttttttttaataaattaatcaaaatttcgtataatttgctcaaccatatcaacgatcatgatggactgatcttacgccagtagacaatttatgtcctcgcaacgaggtctgtcgaaacacctttgtagtggcgctaaccaactcttctaggtggcaccaggtggccacaggcagcttttacgaagtgtagtggtcaacaaaaactggccaccgcgttagagtttttccagtatcgattttccgattcgtttggtggtaacccaccattatattcatgcggcctgagtgcgctgtaatatccaacgatatagtccgttattgcgtgagctgcgtcgctgaagcttacataacccgtcactggcacccattcgttcttcagactccggaagaagcgctccattgggctattatcccagcagtttccacgccgactcatactctgtttgatccggtatcgccacagtaactgctggaactgctggaactgctggaactgcctgcttgtataatcgctgccctgatcgctgtggaacatcactccgacgggcttgccgcgcgtttcccatgccatttccagcgctttcatggtgagtctgctgtccggtgagaacgacattgcccagcctactggtttccttgcgaacaggtcgagaacaacagcgaggtacgcacagcgcttacctgtccagatacaggtcacatcaccgcaccacacctgctttgattctgttacggcgaactgccgctcaagatgattcgggatagcaatgtgctcatgaccaccacgtttataccggtgagtcggctgctggcaactgaccagccccagctctttcatgagcctgccagcgagccagcgccccatctggtagcctctctgggttgccattgtggcgatgcttcttgccccggccgaaccgtggctgatgccatgcagctcaagtacctgactgcgtaatacagcccgtctggcgtttcaggacggtttttccagtatttgtaactgctgcgatgaaccccgaacacatggcagagagtgaccacaggatactgcgctctgagtttcccgattaacgaaaactgttcagggagtctgacatcaagagcgcgttcgctggatctttgctttattgttaacaaacccatcgccgaagtccttttacaactacaggaacaacaggttgttgtgacagaaggaccagtgagcagaacgggggcgacaggtaacattgtgtctgtttatatccgcgacccagatttaaatcttattgagctatcagcttatgagtaaaagaggcggcagtgttactaaacattgtgcgtatggcatgctcgttatactaataactgttctgcaaacggccctgaccgaagcctaaagtaatgtgcatgttaattgatactggattgtgatggccttgtttgctttcagcgaaagcgcggttgaaaacccctgctcactaaggggattatcctggatggctcccggccctgaatcccaggctgaatgaacaggctcgatgcccaggcaataattacgaccatcccagggggcgtattcacggccgccgttgctgaaccatagcagacaatagggtaaccactcggtatcccattttaacgtcacctgcaaaccgagtcggggccattccattcccacctgatggacagggggtaatagctgcacaatttcttcggtcttagcaggcaagggtaaacgcgttaaatcccatgactcaccgttactgagcggtgccgcctttatagaggagaatggctgcaatggcatcagttggctcactcccgcttcgggagggtggggataactaagcgcaggaataccatccaggtccagcagatgcagcggcccccagtcccccccgaacgggaaaatgggatgtaatccaacgggtaacgcacagtcttcacgagcttcaattcgcaaggaaaaagatacctgtccgtcatcacccaggacaatagttctttccagctcgcgcagcggatacgactccgggtagctgtagcccatagttgcctggcttttcctcagcgatcgccagtgccataaactgttggcaggcattccatgtgggtattctggttgaaaatactttccatcgtcaccgtgcccgaatggaacacctacccattctccccccagctgccgcatcaacggaggctgtccggcacaactgtccagattatccagccagtgagcacgataaaagatcggttgtcgggagccattgcctcttgtcataaagagctgctgacatgctcctccctgcagagtcaggagcatgtggagcaggccatctgggctgtttaattcggtcgtcaaagcttcagttttcattgtgtttctcagctgaagagtcagtactggcgcgaatacacagacgcacatcaactaaccgctgctgtggtgcattgtgttccgaaagtagcgccacgccttcccgacccagcgctttacgatcaacccgaatcgtgcttagcgacggctcattcagaccggccccatcaataccgtcaaagccgatgatggcgatatcctcaggcacacgcaagcccattcgctggctcacccgcagagcgatgagcgctgcggcatcgttataggcaaacagcgcatcgggcggctttggtaacgtcagcaggctttgcatggccgcttccagactttgttccggtggtaagtggcccggtgcaatagcttcataatcaggaggcatcagtaaacccgcttcataaagggcatgtctgtaaccccgttccctctgctggatgctgtaatgtgccaggctgctggccaaaaaagcaatgcgctggcgacccaggtcgatgagatgatgagtggccagatagccgcctcgctggttatctggattgactgagttcaaatccggcgaaaataaatccacaagtgccacaggcaactgtaatttttgtagagaggccaaaagctcctgctccatatagccaacgaccagcagcccgtcgggattgtgctgacgcacccgtttttctacgggatccattgggcccagtgccagaaagctcagcgcaatatcattctcacggcataccgcttccacttccatcaacagcggggtatagaacaacaacgagagcgggacattatgctgttggtgaagaataaacaggatccgctgaattttattgccttgcaggcgagtaaaatcatagcccagatcgcgggcggtctgaatgacatgttgccgcggtttatcaccgatacccggctggccttttaacgcgcgcgacacagccccgaccgaaaatccagatgcactggcaatgtcccggatcctgacggatttactcatagcggcatgctccttaatgattgttactcaatttcataatgcatttccccccagccacgcggcccctctgacgccactgctgtcgccgtgtcgggcagtgacaacgggcgtgttagcatagcgtccgaacgtatactgactcatacaatcggctaaattggaatgcagcgggctgacattggacaaacctccgcccagcacgatgatatcagggtcaaggatattcacaatcattgccagtacgcgcgaaagctgatcgcgaaagcgttcaacccattgaatgctatgaggtgttggatgcaaggaataatcgtggaaaaactgctcaccgttcatagattcaccaaattcactgcggagctgccgggttatccccgtgccggagacgaaagattccagacaattccattgtccacaatagcagcggtgtggcgcgccatctcgttcctgctgatagcccggcagtgccacatggccccattcgccactgttgccattttttccttgctgtaactgctgtccaatcacaatgccgccgccgcatccagtgccaagaatgacgcccgcgacgcaatggtgtccggctccggctccgtccatggcttcggacaacgcaaagcagttggcatcattggtgagcgtgatcggccgctgtaaacgctgaacaagcagttgttgcacggggtgctgattaagactgaggatgtttgaattcttcagtaagccactttgcgggtccagactccccggtaaaccaacgcccaacgtacaaggttgtccgacttccgcctctgcatcccttatcagcaaaaccacttgttctaccagagcctctgttgactgcgtgtgagtcgcggttcgatggcgataaatgctggtgccgctcttgtctaatacctgtacttcaattttggtaccgccaatatccattcccaaatgaaacattatcttcatcttctctccggcagaatctcgtaagagtaactctaaccagtataaattgattagtaaacaaaatggcatcattcatgctgcctgagtaccggtattttctttccgtagccgattttacgcaaaaataaatcattcatggcatggttattagtgattgcggtcacggactgactctttttttatgtgtagtttactaaacattgttttgtatattatcgggagtcaggatgttttttactgaaaagaaacttcagcaacgtattgatgaactctctcagtaccggggccgggactggcagtcccctgccgcgctgtcgctctgttacgatcgtgagggagtcaacggtgcgttaccgccgggggacaatgccgattggcaggcctgtggtccggagactcagtggcgtgaaaaagatatttatgcatggctgcgtattgactggcacatgcctgatagctggcaggatcgtcaggtcatcggacattttgactttagtttaggtcgcgatcgccgtgaatttgaagcgctgctgttcattgacgagcagccctggtcaggcgtggatcaaaatcacccttgggtagttttgcccaaagaacgcgcaggcagcactgttcgcatgtactgtcggatttggtccggcattctcgaaggtaaaatccgtcagcattttgaagcatttcacgtgggcaattccatccagaacgttcgattcggctggcgggatgaggcgtgtgacgatctttactacaccgctctgtccgcgtggcaaagcgtgatggcgctggacgaaaactcggccgaccgcgcccacttgctgcatcaaactgacctcgcatttaatattattgactggcgtaaacccggagatgaggctttctacgaaagcgttcaccgggctgctgaccagctacggacggcaatactgtcttcagagaaacatcatcctgtaaccgtgcatgccgtgggacatacccacattgatgtcgcattcttgtggcagttaaagcacacacgtgaaaaatgcgcccgatcgttttccactgcattacgcctgatggaacgttatccgcaatactgctttttccagtcgcagccccagctttacgcctggctgaaatctgactatcccgtgctctacaaccaaatccgggaacgtattgctgaaggacgttgggaaatcgacggagcaatgtggctggaggctgactgcaacatcccgtcaggggagtcgctggtgcggcaggttctctacggacggcgttttatgcaacaggagtttggcgtcacgcctcgctgcctgtggctcccggacgtatttggttattcctgggccttaccgcagatcctcaaaaaatctggcatcagttacttcatgacaaccaaaatcagctggaatgaattcaatcagctccctcacgatacgttcacctggcgaggtattgatggtagcgaagtgctggcacactttgtcacgacgccagaggaaggcttcccccgatatacttataacggcattgtgaatgctaaatctgtgcaggggctatggaacaattatcgggataaaacacttaatcagacactgatgctgccttacggttatggtgacggcggcggtgggccgaatgaagagatgctggagcttctggagcgcttcagcgcgctacctggattgcctaaagttaaacacggcggtgcgctttctttctttgatggtttagctcaatgtcagaaggagagcggtgcatggcaacatgtctgggatggtgagctttatttcgaaagtcaccgagggacttacaccagtcaggcccaggtcaaacgagccaatcggcgtggggaattatcgctccgccatctggagtggctcagcgttgtttctgctctgcaccaaaaaggctggcaggattatcctgagcagccattgcgcgatgcctggacattgctgctgcgaaatcaattccacgacattattcccggatcgtcgattgctgaagtttatcaggatgccgctgaagaatatcaacagctggacgacaccattacgctgttaacagccagggctgctgcacctttgttgaatacagcggccgccggagtcaccctgttcaacagcagtgcatggccacgctatgcagaacctgtatttttggcggggcagactgaaagtggatggctggatactgaaggtcaacctgtacccagtcagcttaccgatggaggatgctggctggccccatcagtgttgcatcctcttgaggcggtcagttttcaagcaactggccatgcggcggtagagagtgataatcctttccattatcaggaaggacaactggatacccctctgtaccgcattagctggaacacaagcggacaactgacccgaatatgggatcgccaacaacagcgcgacgtactggctgagccgggtaacatttttaccgtttatgaagataaacctctgaagtacgacgcctgggatattgaaatattccacgtccaaaaatcacgcatgatcaccgagttgacagccgtatcgctcacgacttccggaccacttttagcggaagtgtcattccagtggcaggatggagagagtcagatccgtcagtgcatgagggtataccggaactctcctcgcattgatttcgtcaccgatgttgactggtttgcgacaaatcaactgctgaaagtccgcttcccggtggcgataagagctaccgaagcgacctatgacattcagttcggaaatgtgcgtcgttccacaacctggaacaccagctgggactacgcccgctttgaaagtgtggttcaccagtgggcggatttgtcagagtcaaattatggtgtcagcttcctgaatgacagcaaatacggccaggctatcaaagataacgccatgcaattgacgctgattaaatcggcgataagtccggacccacaggcggaccaggggaaacaccattttacctatgcgctgctccctcatgcaggtgactggcgacaggcttgtgttgcccatcaggcctggttcctgaatgaaacaccgtcggtgatgtcaggcatattagcgcagccgctggtttatccagtcaggttcagccatccatgtatacagctggacgccataaaacaggctgaagatgaacctgcattgctcgtcaggctgcatgagttcaccggtggacgtcaacaagtgacattacacagtgactacccgctcagccgatgggttgagtgtgatttgatggaacaacctgaacacgttcacgcaggttcagagcctgtttcattgtcttttttaccttatgagatcaaaacactaaaactttatttttcctgatggacggtgcctgcgccccggattttattcagcaactgagatgcacctttgttaacaaaggtgcaaggaactcttttatctaaaaagcagactgcaaggtgaaggtatgacagtgaaaaacagaaaagtcaccctaccggtagcatttggttttggtttgactgatattattggcggcggggcatttactattattggtgcctggctgctctatttttataccactttcgttgggctttcgcccctggaagcggcgtcaattatggcgattgcccgtattattgatgcagtgatcagcctgtttatgggcagtattaccgacaacttctataagaatcgcctgggagcacgctttggccgtcggcgatttttcttattaattggcgcaccactgatgctcagctacagcctgttgtgggtaacaggcatgaactatttcttctatttaatggtttatctggcattcgaaattgtcgttgccgtcgtgatgatcccctgggaaacactgccctctgagatgagcacggattataaagagcgtacccgcctttcgacctgccgtatgttcctgtcagccttagggacattcctggcaacgtttattccaggcattctgatacgtcatttcggtgaagataatccacaggcctatttctataacggattgttttttgctgccgtgttcgtgttatgtgtcctggcatcctgggctgccagttgggaacgacctttgacaccggaaatgatccaggagctggaaaataagcgtaaaccacagcagcggcagtccatctggcgtgttcttgtaaacgtcagccatgattatatctcgaccctgaaagtaagagctttccgcaaacatctggctatttatctgctgtcatttaccggcaaagatgttttcaacaccgttcttgttttcttctgcgtctattgtttaatggttccggcttcgctggcagcgggcttactttcgctcagtattatcggtttacccgtcacgctcattgctgggtttgcgtttgtacgctttgggccacgcgtactcttcagcacgtcatatctcaccatgctggtatgcttagcagcactgctggttatttatcttatcgatcctgcttctaaaatagcatggctatatggcattgctgccttatatcaggtgggccgttgcctgcttgaatttactccctggaatgtgttcccgtttattcctgatgtggacgaactgatttgtcgcaaacgccgcgaagggctgttcgccgcagtgatgacgttttcgcgtaaaacgacggtggcaatagcgaccttatttatcggcttaggtttgcaatggggcggatttgaaaaaggtgccaccacccagtccgcgcatgcagtactgactattgccgtcatgttgtttgtggggacagggggattactgctgctggcactggctattgctcagaccctgaaactggataaacgcaatcacggtatcttggttgctgaggttgagcgtttaaaaagcggtggtgacagaactgccgttacgcaggaaactcgtgaagtggttgaggatttaaccggatatcattacgaggatttatggcctgtttcaaaacaaaactcgtcgaagtcatttgaatcggcaccacaaacactttaacaaaaagtcaattgggtattgctgttcaatatcgtgaccagcaataccttactgtgctttctgtacctgaatcagcgcaaagcagaggtttttgagcgtgggatcattaacgtgtttaaagggctgagctggaactataagagcaacagcccgtgtaagtttggggagaaggtaatcgttgacgggctggttcagtatgaccgctggggatttcattttcgacatggccgacggcgggagcaactgtcagatttagaccgcatgctgaatttgctggacggtaagcccgtccctgagaatcgcaacgatctggccgtcaggctggatgcgcatatcagtagacagcacgcatccgttttcgaagacacgtatgttgagatacgctacttccagaagggaaccgggcacatcattttcaagcgtcccgatttggttgaaaagatgaatgacatcatcgccagacattatccaggggcgttgcccactaaacagtaaggagccaaattatggtatcattttcaaacacggatggtgctcactacgattccgtaaaaaaagccagagcatcgtctcatcaaaaagcatccagatggacgtaaaaattcccgttcaaccgttaaattttgatgtcatgcataaagggggccttaatgggggctcattaatgaatcgaatgaaacaaacttcattattatcaataaattaaaaaaataaattcgaagtctgcaggggacaccagatgttagcctcataacgtaccttaacgcctactcactcccttataatcaataagttaactcattttcgtaagctacctacgtcttcattagtctcgcaaaatccacagcgccatgttggtacaattgttggtatgtttggttcgataatgcaaataccctcagccgaggatttttactatgccgctcactgagttaaaggtaaggaatgggaatgggaatgggaatgggaatgggaaggctgctgcgaagcccgtcaaaataacagacggtaatggtatgcaacttttgattaccccaaacggttccaaatactggcgttttcagtatcgctttggtagcaaacaaaagattcttgcactgggtgtgtatcctgaagtcacgttatcggaatccagaaggcagacaactcgttgtaaaccgtgtcgttccaggcgaaaaacgtaaagccgataaggtcgaaattaaagtgatgcttacaccttgactgctcccttctcatatatgcactcttacatctctgaaatggtaaaaagctctacttatagatagctaaagcagattatatgaatttaacaagcaagataaaaattcaattttaaaatgaaaattttttatattttttctaaaataaatttaaaaactgttacttacttaacttaaccaccttccaattaaagcttaacgtaataaattatctacttttaaatctcactaaaaagacgggccagtgctttgtaaagcagattatttttccaatcgcaaaatccgatcacctctccccccaattgcaatacattcaccgcaggataaatctatgtaatattttattggattaggcatgttttccatcatccacggaagctcttcagagaatttcaagtctgaggttgaaactacccaaacagatttaccatctaaagatgatctctcagcctcatgaaaacgctcgtcccaaccataaccagtttcctttgcatattctttagcaatttcaatagctttgctttcagttatcatttctgaactccataccatacattatacattaacccaccaactaccaccggacctaaaagaatgcctgcagcctcatgccgtaataatgtataagtgatttcatacgtatttccaagaggaaatttaaacccttcaatgatatattccctactcatccccctggctcttaataagccaattgtttcagcaagtgcctcttccaggtatcgcagtatatatgatttattgtatgcgctttgtctcatgaaaactctaagttctcttaataaatagaacttaggggcaatcgccatatgtacctgctcgtggtaaagagttgatagcatctgcaaataagcgtcatctttcgacattgcaccaggatagtagttacgtccaacttctacgtccccccaaggttttgtgcgtccctgaacgacgtcactattctttgtgatttttatcttgggggtataacgccatcctccagtgcgaggcaggttcattttcctaccgatgtcgctgctgtacctaggcatttttactcccctgaaaggagttttaaatgtgtcaccaggcttcttctttaaaagaagcgcaaggacagtattaacccctatcagagtgatagcatcggctaagtccttagcggcagcgtcaagatctccttcgctactagctgagttagtcttcgtcgcaaaatcaaacaacttcttagccgcttcaagcgctacgcctcctacagccacccaacctacaatgagaagcactaaatcagcgatttcaccaatcccaaaaaagtgcgcaccagcccaaaccacgattacccccgccatagtggctaatgctgagggggtgaccatagcaagaagctattgacctacgtcagccggtaaaagagctgccgctttcgagatgactaattgtagccttgtctgtatatcgctagggataacgtccatgcttcatcctcggccagttctaaatcactttagaataacccttcttataccctgccatctagtcattttcacttttgagattcaactctttgcctgggaataacagaatcattctaatgtaaaccatcctcctttccctaatttaggcaacttaatattagtattttaacttacatcagcctcctaattatttttctcgccattaaatcttaaaaaaccactccactgccatcgtaattaagatagtgtatcgctattaccaaagccaatagttacccccccattaactttcaccaatagcaccaatataacctgaccatcacgcccaataagtcagtttaaaaaatgatttaaaattattctcatcaatcattttagtcaccatactgacacgaaaacgcaacactaattctgagcaatcccgcaccaaaaaataattatcaaacggaattcattgattaaaatgcggacaggaaatatacctttaatgtttacccagttatcttactcacttgagcacactatgtctcacagtctagaacgatatgtagagcaaaaactgcctgcagatttgttagaacacgccgcagcaaatcgaacctccattcgtatagaaaaccatgaaggaaaaggcttgccagaataaaaatgaagtgtcctcatgctgtaccaggatcgatccaatccttgatcgccctttggaaaccggaagaactaaccggaaacgaccgccttatttttgctggacgatacgatgactgaatcaaccccggcttttagcgctgtgtttatttttctgtctgctgtttcagttcagcataatgggctgtcagttgtttcagatgcatttccagttgagaccgggcagcagcaggtaatggttttcccgcaggatgttgtgacagtgcccgcagttgttcttcagccggtatggattgattaaaaaattgcatcgtggaaaaaaccactgatttcagctcactgatcgtcatgtattttcccttttgctcatccagtccgttcaacctgtcacttagtttctgtagcgtcatcattccctgatgccagccattcaggcgttctgtcggcaatgcggcagcattgagttgttgctgccattgctttatcaggggttttgtctgctccggccacagtgccctggcctgttccaaaagctgtcgactcaaggcgatattccagtcaggaggcaatttatccagtcgggcaagttgctgctgtgtttgtgttatcactgtttgtgatgaaagtgtttgctgacgcaacatatccagttgttcaggcgtgagcgttgcaggtaaaggcgccagggatgctgcaagctgagcctgaagcgggtcaggccggtgaaaatactgccagctccacactgcgacggtgcttatcaccagcatggtgaacatcccggcagcgaaggatgttcgtttttttaccggagcaggtattgccgccaaaacgtccacattcgcctgatgttccgcctgcgccacgtacacccacttcactgcgctttctggcgtattctcaggcgagctacccgcaaggtccctcatggaggcttcggcatcatgcatcacggtggccggcaacactataccggactgaaccgtcgccgttgtactggttgtcccatcgctgttttccagccggacagcgcaattgtgcattaaggtacgcaaggtatcgagctggctgagatgtttaagctccaggcgcttgagcacttccccgataccggtaagccgttgctcagcccggtacaactggctgaggtcgctgtaattgatcgggagcgaacgcatccgttgctgcaaacgctgactcagactgctgaggatttccatgcgggcatggacgggctgcggccacagcgtcccccattgatggcttatcagggcgtcgagtatcgcaagtccttcattaaggccgaccagtccggccagttgcgttcgggccagcgtgtaccaggctgccgtctgcagttccacaccgttctgctcaaacagtgagaggcagcgtttttcaacatatcgccagttcacatccgggcgcgcgggatgtatgagcttactcagttcatcgcgcagagcggcgtaatccgctaacgtgcgcgggtcgccaccggttttgattttacgaggggggatgtcatgcatgaccagttgtccatttgacgtaaaaggagctgtggagggttattgcttatgcggctttgctttctgcatattcgagacgctgtagatactgaagtgccaccgggtcagcgatgtattaaatcaacatatagctgaaaaagtttctacccggttccggggcgaaagcgatgcttaacaggctctcttcgtgatgtgaaaccttaaaatttaacgtccaatgcataccgggattcatcgtcatttaagacctgccttatcaaccaagggccctgtaaaagaccatacacaatgaaaaaaatcatagcgtcaccataaaaccttagacccgcaccagcgtccaaccagagagcgagtgctcccttttattgtccaccaaagcgcaatcctgttatcaaactcaatgaggtcgttttcactctcaatgagctgaaaaaatcgttcatcccgccacagacgcaagcagtagtaatgagtcagtaaaaagagtctcatcatcaacacgcaatcgactgaaaaaaaattaaaaatcaacactaacggcggcgtcagcgcagcgaaataacgccagctcgccagatgaaactggcaggatgtgatctcgccttagagaagggttctcgtgtcgagatactgctgttgcttaagatggcgtaacagaacccgaccttcaggcataaactcagtgccatagcggaccaggccaacgcctttgagttctgcgtcaatggcatagcgcaactcaccggggacgttctgctccagcaggattaccgctatccttttcagtcggggctcatatttgagcaggacggcggacaatgcccccatcagctcatgggccgttcccggcatgccttgcaggattctggtcatatccggcagaccataatccggcaggtgtgccagggttcccgcacggcagttaaggatacgctgcatgttatccagtacagagaggatgacctgattttcttcactgacctgattgagagcaaggccaccggtaaaatggccggtgagcatttcatacagcgaaggcgtgtgatgttcccgtggcattagtcatccttgagcggttgcagcatcagatagttattaccggcttccagaatacgcggcttatccggatcgaggtcttcgcgctgaatcaccagcttccaggtattcttaaccctgtccggatgacggaacagtcccgccaccgccacaaactgcgcaccggcttccattggcatgttaaggctcgcatctccgcccggcttcaccaccacatcccggcgggcaagcaggtcggctttcagaatggtgtcaccttcctggagcaattgctggtagagcgttttgtcgaaggttttgcggtctttcaactggtaaatccgtatcacaacaggtacagacaacgagttgctctcgcgggcgtcggtattcagcgcctcacgtgctgtgaaatcaaggtgcagcaccttgatctttttgtaaaaaacagcgttaaacgccgattgggtactatcggcaaccccctgggttattccgcagcccgccagactgaatgccatcagaggcatcaaccagagcgttttagtcaaacttgtacgtaacacgtcggtttccttgttgtggtttcgcaggctccagcccggtgtagtaacccagttcggtcgtaaaggtcgcagggatatccgccggaagctcatcgccctctgcgcccagcacaccgttcatgccgagccagaaagggtcttcgcccagcagtggcacggccagcaaccggacagacgtggtcagggtaatgcgtgctttgaagcgccatcccaggtacacccgcagcatgaccagaaaatcctgatacagcagaccatccggtttccagccctgcgcctcctgttcattattcgtcgcgagcgcaaccagcagttggctgcccgcatccatcgcttcgtcacccagtggcgtattgccgtccagcagaaaatcggcatcaccatagaagcccagtggccgagtgacctcctcgggtcgaaggcagtacgggctgaccttcacggtggtatccggggccagtagagtgaccagcgcctgcatcccctcttgagttttgcccggctgtcgcagtacacccagcagcgccagaaagcgcgataccggcgtggcaatgtggtttgctgtgccgggaatacccaaccccacaaggcccagcagtgactgcgagatgctgtcggtaccgccgggctcaaaggtggccgggtaagagtacttacgccagatgcggtaaaactgcgtcagaatgcgatggctgaagatatccagaaatccctgcagcgcttcgtgcccttcactgcgctgagagatgtcatcgagataggccgtcggcaatggtgagtcaaccccatacatccccataaacgtggcacggataaccggtggcttgctgtcatcgtcctcatcatattcaacggttttcagctcactggccggaaaccccatgcccggatgcggcgcaaaacgtaccgggtcatccccggggtggctggtcgcgcccattaatggcctgtccggattacgtttctccaaaagctgacataaacggtaaaagttaatgcggtgaaggtcggcctccagccttggggtcagccgggaatgcggcggttgtgcttctcttcccattccaggcgttctccggtcggttgcaaaatgataatcaggcggttaaagagatagatgtcggtatagagtgcaaagaagcggctcagcatctcgccaaacaggcagatatcgccgcgcccggcaaagccgtggctgtccagcgtcacgtcaatctgcacaccacgaaccaggtagccctgctcgaaacgctctgtttcactgtgtttcacgttgaggatggcttccaggcgacgacggttcatctcgctgtccgtccattcatacagcgccagggtaccgcgcaacacatcggcattatccatcatcgacaggaacccgctgccgagatggctcagtacgcgccagtgaaaacggtcccttgccgggggataacagggtagcgtcggcgcacacaggttacgtacggcgatgctggccgaagtggttttcatcaccgtatcaagcacggtgctttgcagcgcacgtcgcggcagttggccgttggtgccggtgagcgtcaacgacaggctttcatcttccggcaccgtatggttatcaaaggcttctccaccgaggataagccaggtgttatgtaacccggacggaccgcgacgcacgcgggtgtggtaataatattccggcgcttcgtgacgcatcatcccgcctttgtggcggaagctcgaaaacggtacgtaggtatgctggctcgatgagattaccgaatccactgcgtaaatctccgtatgtccatcctgcacgcgcatcgggcgcaacatgtattcggtctgcagggagttgagcgtcagcggatcagattccagcgggaacaggttaatcaccggtacgcaattcaggcgcagatgcttttcggtaaagctgaaatcatgctcccagcgttctgtcagcaccacgtcgatctcaaaccagggaagttcagccggaaagagcacgctatccaggccgcacagggcagtgaacatgaatttctcacggaaggtgaaatactcgagtagcaactggtaaccactgaaactgctgtcacccttcggccatagcccgtcatcatcaccaaaccccagtgcggtgaaataaccgtcgagcggtcttctgtccctatcacccggcatccgcagccacagacacgccgtgttcatggtaaaggcttcatgcatggcgctggccagcggtgcgtcagcgttgaagtagaacggaatctgactgagatcgacacggctccagtcggcaagatggctacagttgaaacgcaggttgatgaccgaacgcccgtcaggatcagtcgacaggtggacgtgctccagcgacaacggctgaagggttatttgtttggtggtggtgtaccggcagcgcgtgcccttcacaccaattggtcgtgagttcacttcgaaacctttggcaatacgcatctgctctttcatttcacgccagtcaggggtgaactccaccaccgacatcgacggaatggtgcgcagataatgcggccacaacaggctgaccagcccttcggtcagttcaggcaggtcgtcatcaagcttctcacgcagccggcccatcaggaaggcaaagccttcgaacaggcgttccacgtacgggtcgcgcgcccccgctttatcgagattgagcattgccgcctgctcggggtgagcgcgggcaaactcttcaccggcttccagcaggtagcgcatttcagcgtcatagtaacgcagggttaagtcatccatatttattctgcttagtaaattgctgcgtgttaaacacttaagcagactccgggagtctggctcgggtattcatacagaaaagagaaccatcaatgctgagtacaaaggggcggttctatgacatatttttttgccataccaggcatccaatccgaagggagcccctggcattctgtgtatccttcatgcattaaaaatgtcgtatgtctttctgaaaagatgaatattcacaggactgttagctccaagataataaacgaggtactgagtaatcttttacctaatgtaacgattatacccccgcaaaaataacagaaaaaaaaccgccaataacggtgagaaaaaaaagaaaaatgcggcagcaaaagttacctaataagagaagttaacgacatcggggtaagaaaggtattcacgcaacttaaaaataccgagatatgaaatcccgatggaaaccaccaggaaaaatatcacctcacaaaatgcgatgactcgttatttaaaaggatacattgtatttacttgttacttacattgcacaaagacgaatcacggacataacgagttgccgttccaggcatccatcctgacgggatgccactacaacgaagatatcctttttttaccagaactgttgggtaaaaaactgaatacataaccccaataattactaaagcaatacagccccattttaaatataccacatacgcatccatcgttttgaatgcatattctttaccttttaataaaagctaaatgaaatatataaatggaaagatcattaccacaggtaaagcgataaaagaaaccgtcaaccacgaaaaaacgatgttgtcaccaaacgaaaaatactcattaaacgtatcgttcccaaggtaaacacaaagactccacaaccccagcatgagtaatatggctaaaacaggccgaacctttgtttcaaacatcaatacaacctccgctggatactcattatgtcatttctgacttatagatatctccctaaaaatcagtaggtaacatcacaactcttacgctgcattactttatttttttaccgcctacaatcagccaaatttaaagcatattttgtcgatagcgcagaaaaggccccgagatttttattatgacattcaacataccctcgactcttaatttcataaatgtaataagtacgaaacagaacaccagaaaaaacagctaaaacaaagccccagattattatcttacttaaaatagtcgctatcttatgctcaaagcgtctgccaagaaaaatcaccggaaacccactaataaacacaggcccaagaataatagctgaaaaagataaaataacgcatccagtagagtactcaaacgcatctggaaaagacaagtacttaacaatagaaattacaccgacataagtaaatacaattatcaaaaatgcaataagcatatttaaaaagaaaagaaccactcgttctttcaacgaaaacatttattccaagctccttaaaccaacatcacggatagcatttcggatatagcgtttaacttctgcctcgataacccttcgtcccttttcaagcatcccatcaacatacatagcccccaaatcccatactccgcgctcgatacctctggctctgtcaacaaactcctgctgtgctgactctatataagctaccagtttatctgtaatgccgtattctttatcaatagcatttagtattattgctgtaccaacgccagcaaatacgacaaccgctaaaggtccaagaacaaaaggtaagaatgcattcgcagcatagccaacgccccaaactacggctgacgaaagaccaacttttacgacatcagtagcaagtgtccccataaactccgcgagggaggtttcatcattaagaatgaaatcgactgtatcaacagcggatacataaattaacccgacaatagttccgtctataacagtctttgcaagcccatatttaccaattgccatttcaataatttttgggtgcttcaaagagaaaactggagcattgagtgcttttctgattcccggatagccagtaagctttatgagctcagttcctctatggttaataaatacggtgcctttaatccccattgtacccaactggcttacaatttttgaggcactaaccacatcattaatatttgtccagtaggtctttacgatactgccgggagtgctcgtcgtaatagaagtccatgtatgctttacaaaatcccatgacgttataatttcgagacattctggcaaagtaaggatcatgcaatcctgtctgttaacttccagcatagcccgaagtttatcatcgggcagatagtgagtatttatcagaacaggataatcaggcacaaatcctgtcggcttttgctcgccggtcagataacctggcagctcaggagatgcctgcgtaggagccgctgtaaagccggctgccaattttccagcggaagctccactgttcttctcgtacgtatcattcatcatcgacggaatgaacttcgccttacaggggcaggtactatagctgtcgagggttccggccattcgccggtcatgaatggtatcgttgtcaatgccaccggctatcctgaaaagcccggcatgcttcccgcaggtcaccctgtcctgctcccgggcaacaggtttatcaaacagagtgtgatcatctgcgcccgtggtgattttcccgccgcaggtcgtcttgtccccctgcaccaggtaaaagccttctgctgccatattcttcccttatcgctaaattccgtccagattatccgcaaagcaccgcactgcttgccgggtcgagcgcaatcagaccggacagaagcaagtccatctcgggctgaagccgtgatttatcggtttcactgcgtgtggctttgatgcgcagcagtctgaggcgacgcgatttcacttcaaacagtagtgccggtgtccactgcgtgagggtgattgactgtgcggcactgtcgagctcacccagcagatgcagggccagttcatttttgcctttctgctcggccacgcgggccatcagcagacgcagtaaccatttgtcttttgtggcgtctgtgcccgggcgggtctgcagccagtgaagtgtggcatccagaccatcagtatccgctttctccagcgcttccggctcaagagccagaatatcgttattatccccactgtcggcactgaccggctcatcccgccagccagccatatcgtccagcacgttctgatttatccagttcagcgtgacctcatcggcaaagggcgtaccgtcattaaaggccagggtttcaagcccggtaaggcggcgcagcagtcctttcaggtcggcggcgatgatatcagccagtacatcctgtcccgatttcatcagggcctggtggacataccactgcaaatccagccagaggtgattagcgccacgcgagaaagtgctgtccgcctgctccagtatctccagccagctctgctgcaggtacaggcgtttgagcatggcccgctggtcagcgcgcggcggttcgatgcgcgtttttccttcggcatccggggccggaatagcactcagcgtgtcatgacgcaggcttttcatcagccggtgtgcggcaagccatccatcgggttgctcacgcagatatccggtcagggtgcgggcctgggccagcaaatcctgaccggaggtaatgcggctcagaaccggcgcttcagcctctgtcgtgtatgatgcctgtgccttatgaccgacgttttgcggcaccacggcatccacgccaccggctttgatcagtcgggattccagcgcgttgtacagggcattcagaccggggcgtgagacttctggctcagtctccagacagtcactgataagcagcagtgcaccggcagtacgctgagcatcttccctcatcacttccggccagagtgacaggctgtcaagcacacgggagcctgcgagccactctagtgccggtttacggctccgctcgcgctgtggatgaagctgcgtgccatagcgctgcagcaatcccgccagcagttcaagcccttcggcaaagccggtttctccgtcctggtgcagacgtgcccagcagtaataggtggcaatccggatatctttggcgatagtggtcagtagtttttcgccaagcgtgcaaatcagcccggtatcaatgccggaaagtttgttgacttcctcccggatgcgctgaaaatcatcgtcatagccgggatcttctcccgttgcgctggcatcgctgaccggagtaagccagggctgccagttttcagtacgtgcctgcgcctgttgccgcagttgcgtttcgtcagcctgacaggcggcaaccagattctgcagtgtgctcattattcttcaccctccctgtcacggcttcccgtgttagccatcaccgcactgtcgacactgaatatctgatccggcagcgtgaacccccgcagttccagcagcgccagcggaccttttccgagttgtgagcgcagcacccactgcagggttcggccatccggcgcgctgaagctcatcatccactggcttcggtcaagctgctcgcgtttccccttctccagccagcgaatcagcccccaggttccgctgtagtccccgaacaggcgcgctccggcattgaccgtgctccaggtcagcatcgtccccggcctgtaggtgtcgcccggccagcgaaagcgctgccagtcggccatctggttaaagtagtgcagcttttgtccgtcaatggtcagctgagtttccaccacctgcggcacaggacgcgcctgcagctcaaagctgatgccctggctgccatcggtgaacagaatgtccgacagctggctcagctgattaatcgcccgcaggaaggccgggttaacgctcagcccctggctgttgaccctgtcagttatccactgactgccctctttgtgcagcacgccactgagttccgtgttcaggaagcgctcaatgcgcccgctgtccctgcgcacaaactccgccagcatcggcagagaggcgtcacttttgctggcgacaaacgggaaacgtccgtccgaaggcggtgtgccagttcgccaccacggagcggcgccacttgtcattcaggctggctgccgacggctgaagtacggtttcccaggcccgggtcagcggctgcacaaacatcgtgttgccgaagccgctccacgcctcgcccaggccttgccgacatcaggctgccgtactgccgggtgtcggtgaggtcgacgcttttgccccggaatacggtctgcgccagggtctgcatcatcgcctgcgggtcagaagcaccggccacctgctgcaggcgcagacgcacgcgggtgatgcgggtcagatacgtctgcaggctcagtgaattgtcagccgacatcacatggctgcctttgtttttccccagaagctgaagcagcgggccaaaggtttcaccgagcggcccctgtgggccggaagcggacgggtcagtcgcggggttgtctttcccgcctacgaggtctttagccgatttgatgagggcgtccgggatgccttcgctttgctggccggtctgcccctgccaggcgagggtattcatcagggcaatcagcggcgactgacggacatcactcatcagcgtcagctggtcggtaacgtccgcaatgttgctggccggattccagtgcaggctgttgaggaagctcagccagctgccggcaaagtcgctgaagtaacgctgcgtcagacgcgccttcagggcttccggcgacaggtctgcggagacggcactgcggctgtcgctcagcacccagtcgatttcatcccggcgcgaacgtgcggcattttcgacagcctgctgaatgccgccttcccaggcctggcgggtgaacatgcccggcaccacttccccggtggtgaacagtcgccgcgcatcggtaccgccggtcatgtcttccagagagacatcggcgaagtgacgacgcacggatttgagcatgttttcatacagggtgctttcggcgttacgccgtccgatttgctgtaacagtacctggcggctctggctgaccagctgcgcatccggcgtgattttccactgtggctgttcaggcagtccgctgatgtggaaggcccacaggtccggcgacaggctctgccacagggcggctgaaatgccctgccgcgccggctgcacggccttcatggtccgggcgtaggacgcgccgtcggctttatccggacgggccatcatcagccaggctttcagctggtcatagcccggcttcgccagcgctgcccgctggtcactgtcgggggcggcgttcaccagcgcgctgagcttctgcatcagggcggcgtttgccgggtcgcgtatcaggcggttgttcgccacgccgtaccagggcagcatcgcgctgagcagctgcgtgttgtggtccagaccgaagcgctgataccagggggcgccctcctggatgcggtgctgcaggcggccggccgcgttacgcagcgtgtgcagggccgtcagctggtcatccgatacggaaggatgctccaccagggcatgcgcctgctgcgcaacggagataatctgctggcggttgacggcaaacgacagcagcagccccgctccccaggcacccatgatggccatcagcgtcccgccggtcgcctgttcccacggcacagcgacacgccggccgcgtacgcgggcacagtcgtccacaatgccctgccaggtcaccggcagggtcagggcatggcgttgtgattcagggcggtatttttctgtcatggcagcgtcaggagatttaactgccccggacacatcaacgggggtatcccgcggcaggctgaacatcaggccgcgcagcggcacgcgctgctgagaggcagccagccatggcaccagttgctgagcccggcgggcgataccgccctctctgaggtgccggcccaggcgcagcaggaagtcgtggctgtggttctccgcgacctggcttatcccctgcgcccgcagggccggcagcatccgctcaagctggcggacgatatcatcttcgctggcgcgcagtgggaacgttgccccgaccgcctgctcagggcgcgtggcctgcggccagtcgctgctgcacaactgccacagccagaccggggcggagtagcgcagccgttcgctgattttctccagcccgcgaaggtcgttgtcgctgatgtgtggcgtcaggttaagcgacgcaggcatgacgcggacaatcccgtccagcgggcgtccgcgacgcagcctgcgcagcgcggtgtatttttccttatcgggttcagccgtgaggctgccgccgtaaatcagcacggtacggttgccttccagccactgctgctgctgcaggccgggaaccagctgttcgattgccacttcatcaccagtaattaacaacagacgggttttacgacgccagtaaaggccaatacgggagcggagatgtctccgaatcttgttacacatggccaccgcagggtgaactggcgctttatcattttcccgtttctttttctcatcatcaccgttggtgttgtcgacaagcgcattaaactcctgcttaccgacaccacgtactgccgccaaaagcaccacggatacgataagggcgctgcctgaaatacatccgccggcgataagccagtaaatttgctgctgacttccgtcttcaatcccggctatatccggatgcttccagaccattaacgtcataacggctaacagcaaaaagaaaatcaatgcgacagcaagatagcggccttccgtagtcttcggtgctaaaggtagcttcacggatccatctcctgtcgggaagcaatcggggtaatgagcgtgctccacagcacattctgtgtggtatcaccgcagataatcatctgtggcgattgagttagtcgggcaatttcagtggcggcagcgatagccaaccagggagctacggctccggcatgccccatggatgtatcgagcgaaatgacggcttcgtcctcgacagactgcgcagggtgcgcattctggcacgcaataacttctgcgcgctgctcacctgtcagcccagcaagccataaatttttcactatattttctttgagcgggacgttataggcggccatgttcatcccctcccttagttcacctgttggagcagaatctggccggtgaagcaacgcgagaggttcgagtgcctcctgggtcaggcggttgccaagaagcagagcaacggctgcttcagcagtattgtttgaaacaaccggatcaatctggagaccaacaatcaataacatcgcatcatctttaatgcggtgatccagccagtggttgactacccttggaccattgctgtctgtgtactcaagaacgcaggttatgccactctcctgccaggcttcctgccagatatctctgacagctgggaatgacagagatgacgagacatcaaggatggcaacaatcgaagcgttctccggaaactgatgaactggaagatcagcaatcagctctgaaaacagacgtgagatgaccaatccaggggtatcctctggttctgtcaggatacgactcagcctcctgctttcttcgcctttccagtctgactgcgaaatgataatgctgtgattattgagcatttcaattgcaacagaagattgttcatcttcctgatgggcggtaataaatgtcgtattcaacacctgaagcgcacgacgagccctacgggtctcacacaagatccattgctcccgacgccggtcaaaaccattcgctttactgtcctgtaatgaccatgcccacatgcgaatagtgaaactcacaatccacataactattggtgcgccaatagccaacatccagaagtggctgttattgatgtatcgttcgaatatcctcatagggatcacgctgatgaccagcatcgccaccaatacggcaagccaacgggatattttaggtggtacttgccgaggataacatttcggaagatctttcagggaatacgacattcacactctcatgctttaaaatttccaaatttcaactaaggctagtcaccatcaaatgaaatgctctcaaataattaaaattcttctttaggtagatcttcacatttaccatccaaagaattaataccagaaccacatagggcattatttttatgtatcaaaaaaacaccctaacctaacattccatctttaagtttcgccataatatcaatagccataaaaacagatacatcttttcttttaacctgtaataaagatagatgatttactttcccatttttcacatatgtagcatccggaatggatttccgtatattatctttttaatcatacacaatcttattatcgacgccactaacactgtccctcttactgttcacttgctgtacatcacacatcgattaaaatgcttcatcagaatacagacaagtccactccgatattggttattctttttctaagtactcatcatcagacaatgccgggtatttaaaatcactaaaatgcatattgcatgcatcaaaactggatgaagaaaaaatgttggcacttgaaccagatgacagggttcacgttgcagatacaaatcctgcgttaacagcaagaacagaagccatagagaaagaactgaaaccgataatgaatgacatgtaaactttttactaacattacgtcctgtgcgtaaatcctttcagggatgttttaatgactatgaaattttattttccttcaggcttcgaccattgatatgctttttcaattaaatgttttcaactctatatcgcacgcttacatatcgaaagcaattatttaagactttagagggggatgaaacatgactttgaagttttattgtcataaatcatattaatcaaatcatgaccttcaatccgtacgttaacaaagtcatcgccgcatgcaggctttatctctttgaactttttgtcagcaggggaaaggacaaataaactataatcaaaaaatcatcaattcggcttgataagcttccctcctaactcatccaaggttttatcacctgaaaaaagctttttgcatttactgtcaatcacagtatcatctttatcttctgggaatacaaccttcattttcttagctatatcccacacacctggaaatgaatcagcagcacaatccaaatcgtttggtgcaacatattctccattgaaagatattccccctagatatattgaaccactaagataaaacaagctattttcatctgacctagatgggtaatcactccaaaaacccttgccagacaaaaggtttctatttccattaaacctagagactatcgcctgacatgatctaaagtgagcatcaatcacaaccaatgccagaactaattctttctcaaaattcacatctataatagaagaaattgcattgttaaaatatggaatagaatgaatgcggattgactgtcctttacaacctataagctccttaagatcaagatatttatttcctgatgctataagcacgcctacatgatcactagttagagaaatacctccagcaccagagagtaatgaatcattccaattttcaattttgcatgagtaatccgtatttaatttctcatcgtggacacttacatatccagctttatccttatcaaaatgaataattacgccatcagtattaattgtgttgtaatatcccgcccaagaactaaaagcagtagcaccaaacatcatgaacaaaaataaatttttttaaacttcatcatcaataatctcttttgcttttttagtggctatttttctttctgcaatccctttatctgcaccatttatacctttagttactttcaaaacaatgctgtcatcatcagatttcccaaacttgtcctcatccataattttgagaactttagatttgaaacaggctataaaaaaaccacccgtatcaatacagttatatgcactctctgtcactttctgagggttctcaatttttggtggttttttcttcatgccggctgcatttttcttcttgtattccgggtcatcccaaacaatccagtgattctttgacgatgagtcaccattcgtatcaacgagttttgaaataatgttgtatatatttatccaaggctatttaaccttcagtgaataggttttattaaatttaccgcttttggtatacatagaaccatatgtaaaaccagaaattgaaactttaacagttcctgattctgatggcacacctgaaatggaaagaaaattgtatacaggtaacccatcccttctttttttattagaaagcacctgcagtcctatatcagcagggtaaatatctactttagtattctctgccgttaggaactctgggttatcctccaagttagttcctataataatctcttgattataaggcacacctacccttgcatcaggtaatatttcccaaaatggagtgaagccaatttgaggtgaggaacatgatacaatcaataaaataaatgaaagaagtattaatctacggcacataaattactttattggcctaaaaaccaaccctccaaatgtatgtttcatgaaaacactcagacttgcattattctttaactgatttttaacttttccccacgaaaacaaggttaaatccaccttgtctaaaacggatgtgcttgcagatattattctgccaccattacacctaacttgactatcccagactatccaatgattcttcgatgaactgtccccaggaaaatctgataacattccagcagagattaagcttacaactttgtgcccgctactaatatagttattcagacttataatatcgttcacatttgcatgcgagagacttatattatcgaatactttctcataaccggccttttcgaaccattccgttaacttcccccacattgtaataccagcaacctgatcatccacttcatcgtaactcataattgaattttcagaatccctcaggctagccaatgtgatccaatccagacctgatactgcttctctaccgtagtcatcataaaaaattcctttaggatgcctacacccgtctccaggtgagatctccaaagtgcctattttagttttcccatgcaaccaaagttcgatagctgcttgtttataaacatccggcctgtccatctgcaaacaataaaaaaatgctgcgggtccacacaaactcgtccaaccttgattaggataattactgcggttcattctcgatacaatctgattttctatcttctttctatcgaaaggatcatcagtactaccgacaggatattcttttgctataaatgcccttccgaggcaggttatctggactctatgaatattttcatcaccgttatcatttaagggttttgtctgcgctttagtctcaaaatagcagatattttctcgcttattttttgaatatgctgcccctgaagctatttcacccagtgtatacattttcttcgccggggatgaaagcaccgaaatcagcttaccaccgtgcttgcggtacaaattaatttctataatgtagatcactgacaaatcatcatcagtctcatttgtatcatgaggctgagtataataaccagggtctatcggttgttgtgctactgacagcagaacatgttttttattattgccatcagttttatagacatcaaggtcataaaaaagatcggatactggtacatttgattcaatttttgtatatatcttatacttaggcattgataactcccggcatcatatgcaaaaaaacatcctgagtctgcgcagaagtaaacagcttcgtatacccctcaccatcactgaccccctccagcactgagccatcagccaaaaatgccctgtaaggcgtattcaacattggaactccattatcatcagcacacaaatagcgaatattgtggctgccgtcgtcgatagcattggataaaggcgaaatatcaggcttatgctgcgctttttcccgcctgacgtaatacccggcccttgttctgtactcaccagccgtcgccgactcaatggcattaacatccagagtgatatagctcccgccgccgtttaccgtcagcttcttcttcgcgatgattttgatttcatcttcagtactgacgatactaatttccttacgagcaagcagtgccatcaggtcattctgcgcctgtacctgcaccggcccctggttcgcgatgagcttgatccccagcttacgaacaaacacgctcagggcattacccaccccgatgaacagatttttcaccacgctgacgtcggcacttctaccggccgtagctatcaggttctgcccggcagaaacctgcagatgttgtccgctggccagtgccattccatccggcgcgctgagcagcagcactgattttttgaggtccgtaacctgctgttccagcagtgtgatttgcgcctggagatcggccgggttcgcggtcgccttctgcgcgtcaccggagatggacgtcatctgctcccgggcatcacccagattgctgaccgccgcctccatctccagcacctggccctgtgctttcgtctggccatcagcgctgatgaacatccctttgtgtgcccggatggctccccacttatccgtccgcagctcaaaaccctcaccgcgcttctgcttctcagcatccactaaatgtccgagattcagctggctcttgccgccgtattcggtggaaatcttgatgtgctctttaccgcgctcgtcatcgaggcggattttgttgttcgccggggtgcgcagcacgttacgtttgtagttgcggatggtcacgtggtcaccgtgggccgagtcgtgcagcacgcccgcgatgtacggccggtccgggttgccgtcctcaaagccaatcgccacctccgtgcccgccagcagcggcaggtgcaggccgtaagtatccccggcatacgggcgggactggcgtacccacaggctctcgaacccggtttcccagttatcgcggtcgaacagcatgttcacccggtagcggccgtctttatcgatgtggccataggtgtcgttttcggtggtgctggtgacgcgcgccggtacggtgccggccatcaccgggcgtgagcccggctccgggcggaagcaaaaatccgtgctgtccgggatgccctcaaaatgcacgcgaaagtcttcatcccgccgcgcctggctgtgcatcgccgtgatgaccacgccctgcgcaaacacctccgccacttcataaccgccggtgactttcagcacctgccccggagagagggtcgggcagctggtgatggcatgagtctgcgtctggccgttcaggtaacgctcatgccggatgcgggcataaaacgcaccggactcgggcaccggactgcggtcacaggtacggcccggtgacaggtagttatccgcccagtggtaggcatcgccgtaggtggtcgcatccccgcgggtcacgtccaccagagcgttcatgtcttccgtggcctgacggtagttgtagtcccgggtgctgacctgcttctgcaccacgctgtgatgactctccatcccccacaccgaatccacgccctgcgagtgctgccccgacggcggcaccgacggcagcgtcaggcctttctcatagccctgctgaccgtcgcagaactccaccacgtcgatgttcaggcgcgtgtcggtggtgaagcggaaccagataccgacctcacccagcagacgggtaatgaagtgcaggtcgtcctcaccgtactgcatcacctgctcgcggcgcgggtactcttttgtgagcgagaacagaaagtcctggccgcgcatgttatggcgcccgcgcaggattttttccacaatctgcggcaccgacatgtcctggtagatggcgttctggtgcgaacggtcaagcaacgccagacgcggccggagcgtcagggcatagcgggtttcctctttagaagcgctgaggcgctcaaagccggtcaccacgccctgaatcacccgtaacgtctgctgcactttactaccgaaacccgtgtcagccggggcctgcagcgtcagggaaccgggcttcatcagcatcatctctttgctgatggcatggtctgtacaggtgaattcaatccggtagcggaacggtctgcttaaggcttcatcgccttcaaaagccagcacatcaagctctgcgccacatcccttcaccgaaagccggtggtggttgtgactgaatcttatgggggggttgttgctcatatggccactccttcagtccggttgaactccagtgagacaccttcttcatcgctccagtcgagtgccagtttgcgtggtttctgcttctccgccatatgggtaagcaactgctggctcagcaccggcagaatctgctgattcagcaggctgtcgacgttacgggcgccggtgtccggcagcaggcaggcagaagtgagagcgtcatacaggctttcgtcaatatgcgtggtcaggccgtagtgacgatgtaagcgtttgctgacctgagccagtttcatttccacgatggtacgcattgcggcttccgccaacggacggtaaatgacggtctggaagcgggcgagcagtgcaggctggaagtgatcgcgcaggatcgggcgcagcagttcgtgcaggtcgccttcgctggcttccggctgttcatcgagcagttgcatcaggtggtcgctgccgaggttcgaggtcatcagaatgaccgtgttgcggaagtcgatttcccggccttcaccgtcacgcataaagccacgatcgaacacctgatagaacaggttcatgacatcacggtgcgctttctccacttcatcgagcagcaccacactgtatggacgcttgcgcacggcttcggtgaggatgccgccctggccataacctacgtagcccggaggcgagcccttcagttgggaaacggtgtgcggctcctgatactccgacaggttgatggtgatcagcgatttttcaccgccgtacagcacgtctgccagcgccagcgcggtttcggttttgccgaccccgctcgggccgaccagcaggaatacgccctgtggaccgttttcggacgtcagcccggtcttcgcagcgcgcaggcgccgggcgatggcagcgagcgccatgtcctgcccgaccacgcgtttaccgatttcattttccagggacagcagatcagtctgttcgtctttcatcagcgacgacagtggcacgccggtccagtcggcgatgacattcgctacggtgcgcacgtccacatccaccgtcaacaacgggttactgtgctgcatgccgttcagcgcctgttgcagcctgtacatctcgctctgacgggaagtgtcctggcggcattccatcagttgttccgtgagtttcagctcctcaacgtaccgggtttccagctccccgagttccgccatcaggtgcgcttcttcctgctcaatcgccgtcagccgttcaccgtggctctgatgaccaacgacaatatcctccagcaacgcctgcttctctatgtcgagcgacgtcatctgcgagcgaatgcggatcagctgttccggtacagtgtccaggctcatgcgcacacgggcgctcgcggtgtcgagtaaatccaccgccttgtccggcaactggcggcctgttaagtaacgtcgggaaagcgtaacggcagcacgcaccgcatcgtcggtgatgtgcacgttgtggtgttcggcatagcgggatttcaggccacgcagcatcagacatgccgtgtcatcgtctggctcatccaccttcaccctctgaaagcggcgctccagcgcggcatcgcgttcgaagtactgcttgtattcggaccatgttgtcgcggcaatggtgcgcaattcgccacgcgccagcgcaggtttcagcaggttggcggcatccgcgccaccggcctggttaccggcaccgataatggtgtgggcttcgtcgataaacagcaggatcggcactggtgactgctgcacggcatcaatgacgtttttcagacgctgttcaaactcgcctttcacgcctgcgcctgcctgcaacagaccgaggtcaagggtgcgcaagataaccggtttgagcgattccggtacgttgccctcggcaatacgcagcgccaggccttcgaccagtgcggttttacctacgcctggttcacccaccaggatcgggttgttcttgcggcggcgggagagaatatccaccatctggcggatttccgtatcacgcccaaacaccggatcgattttgccctctctggctttggctgtgacgtcgagagtgaatttatccagtgcgttctgtaacgctgggttcagttcgccttccttcacgtcctcgccaaccgggcgaaccacaaattcaacctctccgccatggatctgtgccagttcggcttcctgctgcacttgcgggcgttcgtctgactgtgcgtccagcagcggacgcaggcgttcaagctggctttgccccagggtcagcagcggccacagaccatcacagcgtaccaaattctgtttttcaaccagcgccattagcaggtggtgacttcggatctgttcttcaccgttaagcgaggcaatcagccaggcttcctgcatcagcgactggatattatcggagagctgcggtcggtggcgcacggagcgcggctgtttatccagccagccgagtaaatcctgccagatgctgtccatgtcccactcgtaacggcgggccagcaccgtcaggtcaccttccccctgttcgaacaacttcaacagccagtgctccggcaggatttctgcatgggcgcgggtctgacacagagaggcagccccttccatcgcgcgggcgcagtaagggttgagacgtcgaagaaggattgccgggttttccatgtttttaaactcgctctctgaagaccttcaggcacgctaccgcccatcgctttcctgttgtcaggaacctaagcgcatcaggtcagatttctcggttgtaggatgttttgctcagtacccgccgggcaggcactcagaaaaactgcggacaagtcgccctgcccgcatcaggcttacgccgtggcgcgttcgttccacgaatcggaatgaatgatgttgccgtctttgtaggtccaggtgattttttcgtaacgcagttcaatgcgctcaaggtggttgtgcttctctttagaagggtccttgatgtcgtacatctcagggttcactttcaccacttttacgttttccagtttggtgttgaagtactccacttcctggcccgcatcgttgatcttgtaccacctgaattccgcagacttgagggtctggccggtggtcaccgccttgtagagatacgggctggaggagtcgatctccttggtgaacaggaatggggtgtgaatgcgggtaccggtcagcttgccggtgttgttatcggtcgggatatacaggttatgctcctgagccaccacttcgatgctgccttcacgatcctgaacgtccacagaccctttaatgtccgcgccgccgtcgtctttcagccagagataaacaggaattgccatggaattactctccattgtgtagtgatgcgccatcatcctgagatgacgcctgggtgtggcccggtacctggcaggcattggcctgtggtaccagactgatttcgacacggcggttgagcgcgcgcccatccggggtgtcgttggttgcgatcggacggctttcgccatagccctgcaccgcaaaacagctttccggcacgtcgccggtgtcacgcatccagtcgcgcaccgcttcggcacgtttcagtgacagtgtttggttgatcttcgggttaccgctgttatcggtatggccggacacaacaatcagccagcccggcttcgctttgatgccgaccagcgagttcacaagccatttggtggacccggctttcagcgccgatttccccgaatcgaacagcgatatgctgttgaggcgcacgatttttggttcagatttgggtgtcggctgtggtgcggatggctgtggtgcggacggctggggcggcggcacatacgaacggatcgcatccaacacgggcattcgcaggcgctcgccccgatacagaccgaggctcattcggatcggctcaccattgcgcgcccagctatccagttctgccgcatcgttacgcaggacagcaacggcagcggctttggatgcgacatcatgcatcgggatacggtcatagcgggcaatatcgaagcttacgcgttgcaatagctggcgattgttccagccactgctgagcaacgaagcaatcgccgccacagtgaacattccgagcgcccaacggaaggctctcccacgtggcgtcagtccttgcccttctggcagcagcggcaggataaaatccgggaacggggaaataaccgtgctgtcggttcccaccggctgccagcccttcacctgctgcatcccagtgtgacgggaaagccatgccgtccaggccgatgtggccaggcttccgaccagaatcgggcccattccccacagcaccgcagtaggtgccatgacaggaacatcggggttttcatccataaagacagctttgacatgctgatggaaccagctcatcaggctgttcatcaacacctgctgctgcatcgcaggcgttccgccggtagtgatccatgccgcgattgaggccggtgctgaagattcgcgccagactctcaccccttctcccgggatagccgcctgccagagcgggttagtcgtcatcgcgctgccgatctgaccattcagaatcagcggcactgcatggccggtctctttacgcagttggctgatttgccagcgcagggccagcaggcaacaggtcagggcttcgctgtctgcgtgtttctgcggacagacgctgaccatcaccgacagctgacgtccccagtcaggacgcagccacagtactttacgggctacctgctcaagatcctgaccatccgccacgcgaatccagcatccctgcgtgacagtgagcaccggtgacggctgcggccaggccagcggcagatcgccacacaccagcacaacgggctgacggtaagtggcttccggaagatcatccagaggcagggtaacgttgtgctccgcgcgacgactggcgacagtccagaacgccaggataagccccagcatcgccagcaggacaagtacagatccccatctggataccggtaaaaaactcagacataccgccgcgctcagcacggcggcccacagcgcaagcccacgctgttgtgcaggactcatttcacggcccccggcaacagagtcagcagcatctgatccagccagtgatccagtccccaccagagtgcggcaaccaccaccacgctcaggccgatacgcacgggccatgacgccagcacgccgcccattcctcgtccgatatggctttccgccagtaccggatggttttgtggatagctgaacggtgtgacatattcactgagtgcgttaacgagtttctggcgctcagggtcgtttagagagcggaaactgccgaggaatcccagcatcatgactcgctggaagcaggtcacgacagcatggtcaggcgccggttcacgcagcacttcgcgcatccgatcgcacagcgtatcaccggcgtccatggtgccgaggaagtgcccctgcagaggaatgtgataccactgtacacaggcgtcatcctccacaccgcgacctttgaccgcctcatcaagcaacgcacactgtgcagtgaggatgtgctgacagctggcttcatcaagttcgctcgctttcagctcacgctgcacacgctcgacatcagcgatgcaacgctcccacagcgtacgcccttctccatcctgaaatttcgggccgtgacgcaggctgaccacctgtagccaggtatcctgcagcagggcatcaatatcaatggacgcggcagcgccgcgtttaccctcactcatgttcttagtaccgcaaagagttcaagttcaggctcgccgagcatgcctggaacataaaacatacaggtgccgctctggagcatgtcgttggccagaggatgagagacatcaaggctgaaatactggttttccagacgcagtggaatggcggcaggcacatgacgcagtggcgtcagaggtacgcccacccgcgatgaattgacgatactcctgacatgatcgggactgccgaccttacactggcgcgggaactgttcctgcaactgtgccaccggaatcggtgaacgcacggacagatagtaatccgccccttcacgcaaacgtggatcgtgcagccgggcctgccagacgtgaagtcgggcatcatgctcaagcgcaatcgccaccacccgcgacggcaggctggcttccagcagatcgcccagtaaatcaaacaacggcgggaagacgtgattcagttgctcatgctgccagaccgggattgcactcacctggtgctccagcgagaaagtcagcaggctgccagcgagtcgtgccagctccagatacaggcgctcaggcgggctttgcgggtggcgctgaaactgtcctagcaccggctcggcgctattcagggcattcagcagccagaaaagggacacgtcggccacggcaaaatcggccatccgctcattgctttcacgacgcattgccatgagacgactcagtcgggcacgcaactgggtcatcagctgctccaactgggtcagcagccagtggctgccctgaatggtcagaagggggggcagaaacgtctcatcacgttgccacaatccttgcgaatcctgctgcaggcgcgcgaccggacaggtcaggtaatcgctgttgttctgatggctaaaccgcagcgtcagctcgggttgcatcaccgcaatctggcggatatcgtctccgaacgtattgcgtacatcccgccagcgctggcgataacgcacaggacgctcggccacttcatcaggtttaaggcagttaccgccattcgcccgcagcagcggaagtgccagaaccaccacgacctcctgtgattccccctcaagcgccagtaccggtggcaggtcgtcagcattatccgtgtcgataagcgtcccgtccggaaagcggatgtgcagatggctggcctgcaggcggcccagtttcagtgtttccggttcaaaagcgacattgatcacgccccagggctgtgataatcccattcgggcgataccttcggcagaccaggccgcatacgcgacctgttgctggaagtgctggggagagatcataatgcccctgccccataacggttgttccgttttcatcggcttcctgcctttcgttacgatttcgccttcggcatctgggaaaccagtgacaggttgacgtccatgccttctacctggaaatgcggcaccgcgaagagtttcacgcggaagaagcccggattgtcttcgatgtcttccaccaccactttcgcatcacgcagcgggtgagacgcctgcagctcatcgcccggatcggtcatctccgtgaccagactgcgaacccaggtgttcagctcaagctccagcagacggcggtctttggtcgtaccgatattttcacgctggatcagcttcagataatgggcgatgcgtgacagcaggaagatgtagggcagacgggcattgatacggctgttggcggtcgcatccgctgtatcgtacagcgccggtttctgggtggagttcgccgagaagaagcacgcgtagtcacggtttttgtagtacgacagcggaatgaaacccaggttggcgaattcaaattcgcgggtttccgggatcatcacttcagacgggatcttcacctgattaccggtgcccagatcgtacagatggataggcaggtcctgaacggcaccgcccgcctgtgggccgcgaatctggacgcaccagccgttgttgataaagctgcgtaccatattcgcggcaaaggcaaacgaggcgttggtccacagatatttgttatgatccgggcctttcacctcttcgacatagttgaagctgcggaccggcgtggtatccgggccatacggcaggcggcccagtacacgcggcatcaccagaccgatatagcgggaatcatcggtttcgcggaaggatttccacttgatgtattccgcgcggtcaaagtagttgccgatatccttgatggccgccacctcctccatggcgtccttgaggaaaaatttcggacctgcggagccgataaacggcatatgtgctgcggcagagactttcgagatattgcgcaacagggccacatcctgtgcagaggcatcaaattcgtaggcggagatcagcgcggcaatgggttcgccacccggtgtgtcatattcatcaatgtaagtgtgtttatacagtccgctctggataatttccgggctgtcttcaaagtcctgacgcaggtcttctttcgacatatccagcagttcaactttcacgttctggcggaaatcggttttatcgaccagggatttcacgccgcgccacagactttccaccgcctgaaaagcatcgtgatgcatgacggcatcaagctgacggctgatctggtgatccagttcggcgatatgatggtcaatcaggtttctgtcgagtttctcaacttttgagccagattttgtcaggcattccagaaacacctgcatgccggcggtcagacgttcatccgccgttgcatccgacatcgcctgtgcatcctgccagatatccagtgcgctcagctcagacaccgggttcagattgattttttcaaacagggacgcataaaccccacccgcggctgggcgttccagtaccacgctttcgccacccgcagccttctcattttttacagacatcaacatcttccttattaatccgttattaatccgtcaaaacactctgaccgttagggctgtttcggggccagagcagacagctcagaccgaagttcggcacttaatgccggatcgagcagaatgttttccagctcttttcggaaagtctggttatccagcaggttggcctttaaatcacgaagcaaattgcgcatggaaagcatggctttcagttgaggtatttgtcgggacacctgttccggagagaaatctttcatgctctgaaatgtcagacggatattttcttcgctaccgtcaccggcaagcgtgttttgaacggtaagattgacttctggggaatattcggaaagtacggcgtcgaaattatttttgttcagattaactttttttcgctcggataacggtgcggtctccttgccatgactgaaatcacccgcaaccagtaatttcagggggagctctgttttcttgctcgcgccaccggtatgcagttcaagttttagattaatacgtgctttcggaatttcggactgataggaagaattagacatggctgtccctgttctattgcgttatagaaacggtcaatgccagcgagaaattaataagaaaagcaaacccagcaagaacaacgtcccggttcacgtcatccgacgagaataaaaacccggaatcaaaagcgggtgcattccattcaccagcatgtcgacactgtattgttgagcgtttatctgcgatggaaaacattcggataaacgccaacggacagagtgtaagaaggttaaacacatgacagtaaatgaaaaagtgtaacaaaacgttacaataatcaggcttaacatttttatatcatctttttgatttatatgacttttaattaataagcctttcatgccgcatgggacaagggtgttcagtaagtgatcaatttagcttagggattgaatcccgaaaaatcccgaccacaatgtaaaatatttaattttagttttaacaaaaataataatcaggatgcgactgcactcgggaaaatatgaagacatggtcatactttcataattctcttttcgttaacctgggggttatttatttttattgaaggagagtaacgatcaccactgggctcttcacctttttcatgccagtgcctgtgacaggtaaatctcaggcaccaggtgcctggacgatcgggaacaataaccgtccaggcggcaatatgcagggagcggcgcaactcacttttcagcgatctgaacgtgtcgataaactgaatggcatcatcgacagacagaattcggtaacattgcctgctcaatagtgatgagccagattaaggtaatatttcaaacttcccatccatcccctgataaaatcgtgcaaatcacattggtgacgcgagcgattagtatcgtttggcagcgggccccagcaaactaacgccgtatggtgctgaaaatatccgggcggttgaggttgatataatccacccccgcagacgctatttcctgatgaatctttatgtcgtcaccaccgtaataaaccatgatctcaaggccagccttacggcttgattcaaggattccgggattacgcatctgctcaacgttcatctcgatgatagatccatgatgcaggggtgcaacaagagagggagacatggcgatatcgagggtcatcattttgcgaaactccggtgccacggcctgaaggccagtgcgcatcgcgtcggaaaacgaaaagaagaacgtgtcgcgcaccataccaagatcccggactaacgcagccactttgagcggatcgcagtatttcagctcaatatagacacccgcgcgaccacgcagatgttcaaggtagtcatcaagccgcggcacaatggcacctttaaagcggtcgtcgaaccagcttcctgcatccagtgtatcaatatcgcgcgacaaggcatgaccaacgaggcccgtgccgttcgtcgtgcgatccagggtctcgtcatggataacgtagagcacaccgtctgcgctctctcgcacatccagctcaatgtaatcggccccctgttcaagcgccaggtctgcggaaaagaaggtattctctggtgcaaaatggttggcaccacggtgtgatacgactcgggtcattaacgtattttcctgttagctagccagcataaacatgtttgctggggtggcagaatacagagaggttggcatgaagatcgacgatgcgtttaccagaagcattgaacataagggtcagttcgggttgacatgcgataccgatccgggaaccggtcgcatgacgcaccgcttcaccatattccagcgcgcggagaatgccggctggcgtgtcaatcgtgtagaaaacttcacgtcccatcggctcgacggtgataacgtcaccacagagaggcgcatgatcggcggcaaccaggttgatatcctccggacgcagaccgaaacaaacgggtccatcgtatccgtgattcagttcaaaggatgattgtcctaattgcagaaaacggccaagtgcctgtcccttcacaaggttcatgggcggtgagccaatgaatcctgcaacaaagagatcgtccggacgcctgtaaaggtcgtctggcgtgccgatctggactatctcgccatgattcatacagatgatccgatcggccatcgtgatggcttccaactggtcatgggtgacgatcaaggtggtgaagccgagacgtttctgaagattcttgagctccgtgcgcatggtgatacggagtgttgcgtcaaggttagaaagcggctcgtcaagtaacaggatattcggttccttgaccagtgcccgggccagcgccacgcgttgttgctgcccacctgaaagctgcgatgggcgtcgatcgagcagcgcgcttatttgcacaagagtagccgcctcttccacgcgccgggccatttggtccttatcgatttttttaaaacgtaacggaaaggcgatgttgtcgcgcaccgtcaggtttgggtaaagcgcataagactggaagacgataccgacattacgatcgcgggcatcaatgcgattgacattgtgcccgtcaaacgcgatctcaccgctgctcggcgcataaagccccgccagaagaaacagcgtcgtcgacttaccacatccggatgggccgagaatggcaacgaattcaccgttctcaatggcaagattcatcggtttcaggacctgggtctcaccccagtttttggtgacattgttgagcgtgatcgaggccatgacaattatcccttaataccgccaaaactcatttgggtgatgtatttctgcgtgaaggtgtagagaacaagcacgggaagtaagtagatgatgccgacggcggcgatcatgccgtaatctgcgcccgtattatcctgtgcaacaaagaaaaggtagaggctcatggtcatctggcttttgtcgataagtagcgtctggacaaaaacgtactcctcccaaccgcgcaaaaaggtaaaggtagcaatcgcaatcagcccgctacgcacctgtggcagaaccaccaggcgaaaggcctggaagcgggtcgcgccatctgtcaccgcactcatctcaatatcccagggcacgccgtcaaaaaagcccttaaggacgaagatcgcgtagggcagctccagcgcactcatcaccatcaccacgccggagagatggttgagcaggcccatatagtgaagctggatgaagatagcgatggtcagggccagcgcgggaaaagcatgtaacagaagcaaaccgcgaaggaaattttcccgaccggcaaaggcaaagcgcgataacgcgtaggctgctggcgtcgcgacgatcgtcacaatcagcgtttgggagacggcaaagatcagggagctacccagtgccgtccaggccgacggcatcagctccacgcgcgttgtgccggtattcgcaatatcccggttccacagaaaacggtagttgtgcactgtcatatggggcatcaggaaaatcatcacgaggagcagcacaatgataccgagcgcagtccaggacaatatcggtctgcgcaggcgatctgccagaaaggcaagcacgatcgccccgaaataagccacgcccgcaatggcgctggtgcgccaaagcacaagccggctgacggactcatcagaggtggtcagggattttgccaggagccagaggtaaggcagcagaatcgggaccgaaataatcgtcaggaagagaatgaccgcagacaggaagccgacacgattgacggtgcctcgacgttcaagacgcgcccatttcgattgggcaaccgctgtggtttgtacgcgtgacatcacaatacctcgattttcggcgcggcaaaggtcgcgcgcatattactaacacgccattgcactaaggtcgcggccacgccaatcaccatcaaaccaagcgccagcgccgcgccataggcgtaagccccattttcaaaggcacgacggtagatatagagcgcatacggcgtggaatcgtagacagggccgcctccggtgatgagcaaaatgtattcgtaggtggtcatcagggagaggccctgatagatcgtgataaatcgaatgggctgagacagcgcggggatcaccacataacgcagcacgccccattcgctcgccccgtctgtccgcgccgcattggcgagatgtgaggggatggagcgaattgatgacgtcagaatgaccatggcaaaggatgctcccaccaacccattcgccacgacgatcagaaacaaggggaagtcattgcgcaaattcacaggcggcaggcctaaagacccggatacctgattaagcaaaccggacggcgtgggatcggcaacccatatccacagaatgctgtagagtacggccggtgacatgcgtggcaacagccagagaccgcgaaacagattaccgagtctgtcggggatggccgtcgacgttatggccaacagggcacccagcccgacattgaaaataaacaatgtcgccgtgacgtaaatcagcgtcgtcaggagcacgccaggaatgcgcgcatcgcgtgacacgatccgctcgaaattctgcagtgtaaattggccgacccgaagatccgcgcccatatcggtaaaggcgatgacagtattgacgatgatgggcgccaggaaaaagacgaccaacaacgcgatagcgggcgcgagatagaaaacgggtcgggctggccggtgcgcccgaggctggaactgagacatgacctcatctccttaagtattaacgatcacactaagcgcgacacccgacgggctaaacactatttgttggcgacagaggcgcgaatctcaatatcgtcgccgaactgcagttcaagctcttcagcgataaaatcaacagcctgttttgcggtcattttccctgtctcaacggcctgaagaccgctgaacagcaccttgttatagctgccaaactgaatgtgattgggcacgaacttcgcatgcgccatcattggcgaggcggctgacagcacccagttatcccggtatttcggcatcgccgtttgcgcgttgctgatggccgtatgataggaggtcacagcatgctcgttgttgaaatagggtaaggttgccagtgcgacgagttcggcagcaatatcggcatttttacttttggcattcaccgtatagagaagcggatgcgacaggtttgaaggctgaccgccctttttggccgccggggccggaatccagcctatcttatgaaaataaccctctttgtctgacggccagaccgccccatttttgtcccccacctgccaggcaaccgcccagacaccctggtgaaagataaatgccttctcctgtttgaatgccccctgaatggcatcccaactcatcgccgtattatcgacaggggtaaccccctgcttcgcattacgcgcataccagccaagggcgtcggccatttcagccttggggaacatgagtttaccggtcttctcatccatgaatttcacgccgtaagactgaaagaccataagataatcaataccgacgttcgggcggtgcagcatgccatattgggctgctttgccgtccacgacttctttggcaagtgcggtcagatcgtcgagtgtaaaatcaccggactcaactctggccggaatagcgttaataaaggcttcatccttgccgatttttctcaacatatctttgttgtaaaaaaacatgcgtatttcagcatcctgcggtatgccatagatctttccatcttttgctttcgccgattcccacagcacaggcaggatatcgctataaacccacggtgcagcggcgatcttatcgttcatttgcaaggcataaccgtccttagcaaactgaccgatccactcatggggcagcacatagatatccggtccctggccgacggacattgccttcagcatgtccatggcaaagtcgtcccagcctttgacagcactgctgttggcctgaaccacaatatgcttgtcgacacccgcagccttaaattgcttgttcatgatgtcggcggcatcttcaatattggtgatgcggttgggagcactccgctcggcgagcgtggagagtttgatggttatctcttcggcgtgggcaaggccgccacacagcgcggaaatcaccaaggtggcgaggacagtcaattttttcgacatggtttttattcccgttgtgcctattatttaagtaagttaatttatttaaatgacaagttcatgaccatgtgcaaatgaccgggagaagatgaattgacttcatcgaagcattgggaaggaatcggtacaacgcagtctgccgtgttacgttatcttcgtcgcaacgactctgcatcgcgtgctgaaatcgccgattgttgtggcgtgacagcggcggcggtgagcatgatgacccgcgatctcatcaagcgaggtatcgtcgtcgaaggggctcgtcgtccgtctggccggggcgcaccgcacatcgatcttacgcttaattccgcaatcggttatgccatagggattcatgccagccgcttttctatcacgctgatgctgcttgatttcaaaggcaagttggtcgatgaaattgaactgatcggcctctatgaaacctttgccgaggctcggtcagcgatgcaggagggtcacaaaacgctgctggagagaaatcacataccgcatcatttactgattggtgcaggcatcgccatgccgacacggtttcaacgcggtgttgcgcctctccatctggctcccgaagtgacttcctgggatgaacccgggctgtatgagtccatccgtcaggctttgggctgtcctgtgctgatcgaaaatgatgccaatgctgcagcaatgggcgagatggcgctcggtaatgcggctaatcatcaagactttgtctatctctatctgtcagaaggcatcggcagcggcattattttgggcaaacaacgctatcgcggtcatcttggcaatgcgggcgaaattggcctgttacttccactcgaaagaccacggccctcttttactgaccttgctgcctggtgcaaaaatcacctctgccagataccggatggtcgttcacaagccgtctggcaccgtttcctgagcgaaaacgtatcggttctcgacgggtggattgaacgcacaggcccggaaatcgcacgcctgggctttatgctaaacgctgtccttgcgccagcggctatctatcttgggggcacactgccgcaggtcgtgcgtcaacggcttgctgtctggctcgatttttccgcgttagatacgttcaatggcactcatgtcgtgcaacctgaaatctgcctgccggatatctccgctacggataccgtcgcattcggtgccgccgccatggttctgcataatgtggctcagccggatgcgggggaatcgtagcgcatttaaccgccacctcagcgtgatttaacatggcttaaaaacacgtcgccatgggcggtaagcgctgtcccgctaacgtaaagtggaagccgtccaacagggtatttatcgtggccattctgtttccagcgttgtaatacctctcaatatccacctccgccgggatcggtctgggttgatgcgcgtttatcccggcctccacctgaaaaagcagcccgcaccgacaaataaaaccactcgcttctgtttctgtcttttcacaggggagaacaaatttgccggggtgaatatcccgttctggcaggaagcgatcatcgagtgcgcgtgaagcattgagaataaaccggccggcaaggcgaatattcacacaacaatgccagaataaagaagagccgccgccatcagaccagaggcaggcgttttattccgcgtgatcagaaccggcagagttgggatgccacgcgatccagcgctctgtcataactggcccgttccccagcactcaagaatccctgcttcttaacaaattgattagtgtcttttcgcacctgctcaacctgccgccacattttttccgcctgtggttgtgtcagaagacgggctttgcgtgcagtagcaatatcggcctgaaggatattggcacgtacggcgatatgcgcctgacggggatcggtaatggcaccgcccacattgccctgcacatcatgttgcgtgttgagatcgcatcccggatagtctggcgcagccgacgcggcgaaggtgctaaaagcgatcagataaagcatggcgtaacatagcattctcatggcggctatcctggtcatcgtcgttaataaacctgttcggctggcgcgttgggcagccctgaggcgaaaatccactacaatccccactcagggccgtcggatgaaagcgtaatggttacaggttctccgcacacttcaacacagggcgcgtcatgcgtattccagcgaaacaggcagagatgccaaccgcccgggcgacattcaggctgactcacctaaacgctctcaacgcccatctgtttgtgccggtgctgttttctggtcgatggcggatgacaccgctcatgggtgcccggcagataatagtgaccatcagcagagcgcgccgtaccaccgggacaaccgtccattccgcgctgcccgttctttcccgcaaggccctcaccgccaggctgtccattttggctgccgccgttgccacctgcgcccccattaccacccgatccggcgtagcaggcggataccgataaaagcaacattatcccggttacaacagctaacttatgcatgaacataccgccttcattcgccattattattcgacagtgatcgagtccggtttttgcgccacgatcttaagcgaggtgccttttatcgcgtcactgaccgcttcccggagggtcatggttccctgcaccggattgacgtggacagcgccggttcgcgacagatctgtctcaataaaacagcctgaagcatgggctaactgctgggccgtttcatcaaagcgcgggagattaacatggtaagtgccctcgatatcacatttacccggagaaatgtgaccagaggatgaagggctgcatgaggtgcaagcggcggcgagcatcagcacgccaaggctcttcagactgactgaatacataaacctctccggcagaataaacaggaatttattattctcacaagacagggtgactgtctgcatgcggaatatgtctgagtatgacgcgctcagatacgtgcaggcacttaatcgccggttaaccaatcgctcaaccgtcacccactgttacgcatcgccagcatcccatctgaggtaagcgtgagatttagcaggatttatcgatgctaatgccaccggggcgagggaggtgatgcagttatgattaagcgcgggcgaaaaagcaatgccggttaagaagctaaagattagaggtaaaactgaggacaggtaaagttgaggatatcgacgccatccctggcattaccatgatgatacggtcagttttcatacattaggcatgagccactgtcacgctcttgctacaggctgaaccgtaccgggcgtggaaccctttcctgtccgggcgtcatgcccattgttgctgctgattgacaagatgttgtggttgatttattgccttacgcgcaatccagtagagcagaactcgctcgtcgtcactgtcacgatccgccattgacaataatttcagcgccagcgtagatttagtgacaggctgctgctctgcgctcaattcaatcactgcctgaccgataatgcagcaaacctcatcctcactggtgacggattcatatgtccggtctttcatatttcctcctgttgaatgaacttttagcatggcaaaaaaacgctgactctgccggaaaaaagcactgtttgtaacattcacttactgctatttacctggggtcatcacatagctataccggtaacgtttatcgctcctgccattcatgccactctcgcggcatttcattccattttgcattccattcatgccctttctccccgcacgcgcaaggctaaggtttattctggccgcagtttccagtttcccatcgggagtaaacatcatgaataagccacaacaggctgtctgccagcgtacacgctggttaactcttatcggtacggtgattacccagtttgcgctggggtcggtgtatacctggagtttgtttaacggtcagctgtcgcaaaaactgtcggcatcggtcagcgaggtggccttttcatttgggttgctgagcctggggctggcggtggcgtcttcgctggctggcaaacttcaggaacgttttggcgtccgtaaggtgactatcggcgcgggcgtgatgatggcgctgggcttatggctgacctcccatgccgataacctgatgatgctgtatctcagcgcaggcattctgctgggcctggctgatggcgcaggctacctgatgacgctgtcaaactgcgttaaatggtttcctgaacgtaaaggggtgatatccgcctgcgcgattggtgcctacggactgggaagcctggggttcaaatttatctgtggcgcgctactggctaagtttgggctcgaacagaccttcattatctggggattattggccatgacgatgatgatcatcggggcgctgatgatgcgcgatgcgccattgcaaagcccgtcgaccgtgcaaaaccaggcaaaccgcaactatacgctggctgaatcagtgcgcctgccgcagtactggatgctggcgctgatgttcctgacggcctgcatgagtggcctgtacgtgattggcgtcgctaaagatatcggggaaggcttagtgcatctcagcacccagacggcggctaacgcggtgactgtcattgccgtggctaatctgagtggtcggttagtgctgggcgtactgtctgacaaaatggttcgtatccgggttatctcgctggcccagctgatttcgttagctggcatgagcgttttactgtttacccagatgaatcaaaccacctttttcctgtctctggcctgcatcgctttcagctttggcggcaccattaccgttttcccttcgctggtcagcgactttttcggcctcaataatttgaccaaaaattatggtctgatttatctgggattcggtattggcagcgttttaggttcgctggtcgcctcactgtttggcggttttaccataacgttcagccttatcatgacgctattggtgatgtcattactgctgtcactgacgattcgtatgccgcagagcccgtctgttcgcgagccgctgctgcagcgtcagtaatcgcgaggggccaggtcagactggcccctttttttagccgcgaaagcgcggttccgccataccggccacatcaagttcaaccgcaaaaatatcacccgactctggatagcgctcccgatcttctttactgagattctctcttgaactggtgatatacagcgttttcaaatcgcgaccgccaaaggcgaccatcgttggccacttaaccggcagactgatctcatccacgatttcgccatcttgtggatcgatacgcaccacccgaccgccatcaaataatgccgaccagtaaaagccttcgctgtctacggctgcaccatcgggcaagcccccgcgggcatcaaaacgtcggaaaacctcacgttcgcccggttcgccctgggcatccaacggatagcggtaaagcacttcgttcggtgtgtccgtgtgatacatccactgacgatcgggtgagaaggctacgccgtttgaaatcttgatgtcacgcgctttaacatcaagcttcaaatcgggcgtcacacggcatagcaaccctccgtttttatcctgtggctcccacaagctgccgcaccagaaattcccccagggatcgacacgtccgtcattgaaacggcttttctccgcgatgcctggattatcagccactttcttctgcggtttaccctgctcatccaacagccacacgccaccgcgcagggcggcgatgataccgccctgctcacgcaatccaatgcaccccacctcttcctgttggggaaacgtcgtcagttcgccactgatgggatcaaaacgatgaatagctggagccaaaatatcaacgcaccacaatacctgttccttgaccgaccagagcgggcattcccctaactccgcctgaagttgcagaatattttttaccttgtgagccatgtttgcctccatttattgtcctgctaataatgtagcgccaatttccagacccaggagaactattttcaccgtatttttaagacggttcttacttctgcttgcgcttattcatcccattctgatgggaagattaaaattgctttgtcgacattgccgaaaaagaaatataaagaaatacttctgcaggtaactctacaatcgctacatgtttgctccactatttcggcgtaatatctaaaacatcgaaaaagaggagatggcgtatgaaagaaataagtacaacagtccttcccatggtcgcagcgggttattttataaacgggccaaaaatgctatcaggacataaggatgacaggcagcgacagggaaaatggtctgccagaaatgagaaccactgaagggcaaagatttcacacagcataatataaaaaaagaaggtgggattaaatcccacctcgttttattggttaactcttcaccgcataattacactgataccaggttttctttaagcctggtattgtgctgtcctgaacaggtaaattttctaccttatcaaaacctttattcatgcagtaattcgccacatcaatttccatcgcgtcgcgattaacttttgacgggtcgaaacggtattgtacggtgtttgaatgagtatcttcatctactcgctcaaacgccccgggtttgctggcagtacagccgctcagcagaataagtgccagtgcaccaataactatttttttcatttttacctcacattttgtcgcagtgtaaggcgcggcaaaatgggtatctataggaatagtacgcgagctgttgcgtatttacgaagttttaccaattgattcaatactgttaaacagttggcataatgtgccattaaactgcgaaactgcattcaacggaaaacattcaaagcacaacaccaggcattactctaaaaaaaagcctctctcaattcagcccgcgtttagcgggctttttttcgcttatccctcgcccgaaagcgcaatcattctacgaagcagattggcggcttgcttgtcagggagtgcgagaatcgccgtgtagagatcgatggacatggcacacatagatgagcgatcaaccgccgtgtctgcaggcatattgagctgttgcagcttatcaccccatttttggtaaaggcgatccacgatatttttcaggtcgtgctgagcctggtcgcgatccatcggctgttcttcggtcaaactgttgagcagtaaatactcggtggcttctgcatccttttggttcagtgcggctggcagcgttttggccagattcaccccgcccttcacctgcggataaaggaattgaaaacagagtccgggatcaattttattcagcgcctgcatttcgttgacggaaacgccaatataattaacgacggcgcgacttgagccgcgcatgagccgctgattaatcacatccgtgagccagcctcttagttcaccgacggcctgaatcatcggctcgccttcacgcagtttgtgagacagttcgcgcgtcagtaactgccacagggcgggttcctgggtgcgcagcacgcgataaaccgtcgcttgcgccatatagtccgccgcccgctcatagcgtttttcctgttgctgctgaggcaaaatccagttgaaccacaacatattcgacaggataagcggcaggataaacagcacgacgccctgccacacccgcaaccgggtggttctgaccaacatcacaatgataagcgccagtagcacaaaggccaccagcgtaataaaaagcagggaagtcatactacgttgttaatccttacgcacatcaatcagtaccgggcaatgcgcgcgttcaacaacagcggcactcacagatccttttaataaacggttaaagggtgacaaatggcgccgccccataataatcatattggcgtttagctgttgcgactgggcgacgatggtatcagcggcttcaccggccagtataatgccacgcgccttaatgccagcctgcagcaacggggccagtgcatgccgtaccaccatctcagcggtattttgttcatcctgagccgccacaaaatccgccggatcttcgcctgcatcaatatcaataggttggctgcaggatgaataagcgggatcgatacagcataaaacgacgacttccgcacggtgtgcctgcgcttgttcaatcgttaaagaaaccactttcttcgccaccggagaattatcaatagccatcaacactgttttcattgagcagtcatccttcaacagcggcaattttgccaatttcgcgaatcaacgcctgtttgcattgcaacatttcctcacgataacgagcctcgtgtttcttaaaacgtgccgtaggcaccagtaatgacacggcaaaacggccaaagagcgtgtccagcgcaaaggccatcgtcgagataccttcaagcgtttcaccgcgatcgtaggaaatactggttttacgcacctcatgaatcatctgtaagagctcggccagcgtcttaaccgttttatcggtcagttcgcgccaggcgtcgcccacccgtgcctgcacgtcagcgtcactttccagcgccagcagcgctctgccccctgaggtgctgtaaagcggcagatccagcccgatacgcggaacaacccgcaactctcgtgatgccaccacgtaatgcacaacagcaagctgtgaaccgctggcgcgggacagtgatacggtttcattggtatccgcagagagtttttccatcagcggtttgactaaatccaccacatccgtgttgacgctggagaggagcttaagcaaagccgggccaaggcgcagtccacccgcaccgctgctacgaaccagctctgcgctatccagggccgcaacgatgcgctgaacggtggaacgcggcagatcaaccacctgtgcgatctcgcccaggctcatgccactgggatgttcgcctaaggcattaagaatttttgccgcacgtgcaataacctgaatgccgcccgttttttcatcctcgcggctggatgattgatgagtcatagcgtcgtcctttttgagctggcttactgtaacccgaaaagcgcaccttttacagcatgtaccgcattgcaatacagcatattgccatgtaatatcgccgcgctgtatcgcattgcaatacatcgaatcataataacgagaccacctgctatgacgacccggcctggcaatgcgccgacgctgcatccctttactctgcgcctggcattaggcttgcttggcgtgtggatcgctgcgctcacctcaggacttaacgatcgggtcagtgatatcgccctggccgatattcgtgccgcccttggcatcggctacgaccagggaagctggattgtctctgtctatcaggctgccgaagtcgccgccatgatgattgcgccctggtttgccgtcacgttttccctacgccgtttttcgctgatcatgtccgcggggtttttactgtccggcatactgctgccgctcatgaccaatcctgttctgtttatggcgttgcgcgtcgtgcagggtctgtttggcggcgcacttccgcctatgctgatgaccgtcgcgctacgctttttgccgccgccgattaagctctacggcctgggtgcctacgcgctgaccgccacctttgggcccaatatggcggcttctctggctgccttctggacagatgaagtcagctggatgtttgtcttctggcaggtcgtgcccggtatgctgattgccatcttactgatggcctggggattacctcaggatccgctacgtactgaacgttttcagcagatcgacctgtttggtatggtcaccggctgtagcggcatggcgctgatcattctggttctcagccagggcgaacgtctggactggcttgattccccccttatcacagcaatgcttttcgcggcgttaccgctcctgatagtgtttttgattaacgagtggtttcatccgctgccgctgtttaagttgcagatgctgagacggcgtaatttgatgcacggtttactggtgttggcgggcgtgctcattgtgtcgttatccggctcggccctgccttcaacctattttgctcaggtcgacggattccgcattggacagtttgcgccgctggctttaaccatcggcttgccgcaactgattattgcgccgtttatcgccgccctgctgaatattcgctggatcgactgtcgctggatgctgtcgctgggcctgatctttcttatcgcctcatgcctgctgggtatgcagatcacgacgggctggtcgcgggacaacttttggctgattcagggtttacaggccgtgggtcagccgatggtgattctgccggtattgatgagtgccaccagcgtcgttgccccaccggaaggcccgtttgcctcagcgatgtttaatacggttcggggtttttccagcattgccgcctccacgctggtgtcgtggttcgtcagccaccgtgagcagtttcactccaacattctggttaatcaggcagccagcaggccctggttgatgacggcgccagacagcagccaggccagcgccagctatccgctcctgcccgacggcagcgccagctctgtcgaaaatctgcgcggctttgccatgcaggtcaagcatcaggcactggtactcggcctgagtgatacctggatgctgctgatcggttttgcgctactgctgctgctggtgacggctctggtacccaaacgggtctggcctcctcaaaccttgatccaacctgcaacctccacgtcgggataactgaatatgcgtgctttagcaatgagaagaaccctgctgctttccctcctgctgctggttttactggcgatggcgctggcggtctgggcggtgatgacccgtaacgatcaccgcaccaatgatgcctgggtgaatgccgattacaccattgtcgccccgaaagtgtcgggctacatcgcccgtatcaacgtgaaggataaccagcaggtcgcggcgggcgaactgttagccacactggacgatcgcgattatcaggtggcgcttgagagtgccaaggccgacctgcaggtcagtgaagccaaactgttgagcagtcaggcacagctggagcagcagcaatcggtgattgcgcagcagaaggccagcgtcgcggccagccaggccacagcgcagtatgccggtcagagtgcggaacgctataaccgtctttatcagcgcggcacggtggccgcagatgaacagcaaaaagccagttctgcacaacgatccgcgagcgccacggtgcgccagagtgaagcggccctggcctcggcggttaagcaggtcggcgtgttacaggcggcggtcagatcctcagaagccgatgtcgccgcagcgacggccagcgtcgatcaggcgcgtctgaacctgtcttatacccgcattgtggcaccggtggccggcatggtgggacagcgtaccctgcgcctgggtgcctgggtgtcagcaggcacgcgtctgctggcggtggtgccgttgcagcacacctatatcacggcaaattatctggaaacgcagttgaaggatgttcgtccgggacaacccgtgcgcattgaggtcgacgctttgcccgatcaggtctttaccggtcatgtcgacagcattgcgcccgccacgggcgcgacgttttcagcgatttctcctgataacgctaccggcaactacactaaggtcgttcagcgattaccggtgaaaattgtgctggatgaaggacagccgaatctggcccagttacgcgtcggcatgtctgcggttccagaaattaacgttcagtaaaaaatgtgaacaaactctcagaaccaaactatttcttttcggtctgattacgcgtagattagccccgatcctgttctgagttattcagttcgtccgggagaccgttgaccgttgacctgaacggcgaccttgtcccatctgtccgcgttgcgctggatcgggatcgccaacatcgtaaccgctcagaggagttcgcttgtgaaatatgctttgatgggaatttctttcttcgtactgctttgggtcggcacctttgtgctgatgctgtagtatctgcaagcattccgcagggggcgacagacggtcgccccagtggcggactagatctgttcttccatgtttttcacgctgcccggcaatataccatccgcacgaaacatcgctttaatccctctgactgcctgacgtatacgatcgctgttttcaatcagcgcaaagcggacatgcgtgtcaccgtagtcaccaaagccaatgcctggcgagacgcagactttcgcctcctgcagcatgtgcttcgcaaactccagcgaaccaaggtgggcatagtgatcaggaattttcgcccacacgtacatcgacgctttcgggatatcgaccatccatcccgcttcgtgcagcccttttaccagcacatcacgccgccgtttatattgctcagcaatatcgcgcacgcactgctgatcgccttccagcgccgcaatcgcagccacctgtaagggcgtaaatgtgccgtaatcgtgatagctcttgatacgcgccagcgcggcgaccaactctttgttacccaccataaagccaatgcgccagcccgccatgttgtagctttttgacagcgtgaagaattctaccgcgacatcacgtgcccctggcacctgcatgatggaaggcgctttccagccatcataaacaatgtccgcgtaggccagatcgtgaatcaccaggacgttgtactgcttcgccagcgcaattacgcgctcgaaaaagtccagttcgacacactgagatgtgggattggagggaaaaccgagcaccatcattttgggcttgggatagctttcgcgaatagcgcgttccagctcattgaagaaatcgatcccttccaccagcggtacagatcgcacctgtgcacccgcgataacggcaccgtagatatgaatagggtaactggggttgggcaccagcaccgtgtcgccatggtcaagcgtcgccagcatcaggtgagccagcccctctttggacccgatggtgacgatagcttcagattcaggatcgatatcaacctgataacgctcttcataccaacgagaaatcgcgcgacgcaggcgaggaataccgcgtgaggtcgaataaccgtgcgtgtcttcacgttgtgcgacctgacacagtttgtctacgatatgaggcggcgttgccccgtcggggttgcccattgaaaggtcgatgatatcttcgccacgccgacgcgcagccatcttcagttcagcggtgatgttaaaaacgtaaggcggcaggcgttcaatacgtgtgaaacgacgggttgtgctgttatcagccatggtgtcctctgggaaacgttagcgcccggaccgtccgagcgacgctggtcactgcggtgacctctacaagaacataacttgcagataacaactttgtcgagaggagcagaaaattttttatatttgtggattgagccgttcaagcagccagtcattcacccagcggtcatttaacagataattattttgcagcgtgcgctgtagcgtgaagccatttttttccagaatccgccgtgatgcccagttgccctccaccaccagcgccttgagcttgaggaaatcggcgtcgaacaaacactgacacaacgcccccagggcttcactgccgaagccctggccacagtagcggtgcagcagcatgtaaccgatttcggcctggcgagcgggctgccattcaggcgtacagccaaataagccaatggcttctccgctgtcgcgcagcctggcgaccaggcacagcatgtgaaagctgcctacctgccagggtgccaaacgctggctgaaccgttcacggatatcctcttcgtcaggaatttcactcacccagttcatcgtgtcgcgatcttcgtgcaccgcccggaacagttgccagtcttccgggcgtaatgtcgttaacgtcaaacgtgaagtggtcagatgcatactctgctcccggcagacaggtctcaaaggaaagcgactgcgctgatcatcctgtcaggcttcagtaccccgccccgaatcgaaaagagggaaataagcgttcccctttatcgtggtcaacatttccccttttcgctgttttagagaaattgatctaaaacatgaacagtcatgctgaccgttgggcgcgctggcgcattatcattacattttttatcatagcgttctttaacatagctgaagagtcgcctgtgacctcacactttaacatgctcctggccgtctttgatcgcgcggcgctcatgctgatttgcctgttttttctgacgcgaacccggccttttcgtcagttattacaaaaagatgagcacacctcgctggaaaaaagcgctgtcattgccattttttccctgtttgccttattcagtacctggtcaggtgttaacgtcgaaggttcattgcttaacgtgcgggttatcgccgtgatggcgggcggtattctttttggcccctgggtggggatcgtgacgggcgtgattgcgggcctgcatcgttttttgattgatattcacggcgtgacgtccgtgccctgcctgattaccagcatcattgccggggtggttgcgggcgggatcaatcgtcgggtgcagcgcgagcgacgctggctggtaggcattctgggcgggatgttctgtgaaagcctgacgatgctgctcattctgttatgggcgaagcctgtcgccctggggctggcgattgtgtccgaaatcgccctgccgatgatcctcggcgcatcaagcattggcttaatcgtgttactggtgcagagcgttgagggtgaaaaagaggccagcgcggcacgtcaggccaagctggcgctggatattgctaaccagacgctgccgctgttccggcaggtaaacagcgattcacttcggaacatttgcgacattatccggcgagaaatcaaagcagatgccgtcgccatgaccaacaagcagaaaattttggcctatgtcggttacggcgagcaaaactatcagcacggcgatgacggtatcagccccaccacggctcaggctatccacagcggtaaaatcatcattaaaaacaatgatgaagcccacagaacaaaagacattcactccatgatagtgattccgttacgggaaaaaggcaacgtcaccggcaccttaaaaatctactatcgtcgcgcgcaccgtattaccggctcgctgaaagagatggccgttggcctgtcgcagattatctcgacccagcttgaagtctcccgcaccgagcagctgcgtgaaatggccaataaagcggaactccgcgcgctccagagcaaaataaatccgcatttcctgtttaatgcgctcaatgcgatttcgtcttctatccgactcaatccagatacggcgcgtcagttagtcatcaatttatcgcgttatctgcgctacaacctcgaactgaacgacgatgagcttatcgatatcaaaaaagagctgtggcaggtaaaggattacatcgccattgagcaggcccgctttggcgataagctcacgatgatttacgacgtggatgaggatttgcatttttctctgcccagcctgcttattcagcccttagtcgaaaacgccattgtgcacggcattcagccctgtaaaggcaaaggtgtggtgacattgagcgtgcgcgatttgggcgaccgggtgcgcattgcggtgcgggacaccgggcaaggcatcagcgatgaggtcattgacagagttgcacgcaacgaaatgccgggcaataaaatcggcctgttaaacgtgcatcaccgggttaaattgctgtcgggccagggactgcatatcgtgcgtcatcaacccgggacagaaatcgcctttaccctgagcaaaaccggacagccactggtgggaaatcttgcatgaaagccatcatcgtagaggatgagttccttgcccagcaagagctgagctggatgattcagcagcacagcaacattgagattgaagcctgctttgatgacggactcgacgtgctgaaatacctgcagcagcaccgggttgatgtgatatttctcgatattaatattccgtcgctggatggcatgttactggcgcagaatattcatcagtttgtgcataaacctctgattgtttttattaccgcctggaaagaacatgcggtagaggcctttgagctggaggcgtttgactacatcctgaagccctatcatgagtcacgtattatcacgatgctcaacaagctggaagccagctggcaacagcagcacacaattacccaggcaccgagcgcgcaaaacccccttacggttaacctgaccaaagacgatcgcatcatcgtgaccgacgtgaatgatatttactacgtcgaggctcatgagaagttaactttcgtgtatacccgccgtgaagactatgtcatgtcgatgaatatcagcgaattttgctcacgcctgcccgagcagcaattctttcgttgtcaccgctcgtactgcgttaatctgaataagatcagagagattgaaccctggttcaataatacctatctgctcaaattaagggacaaggactttcaggtgcccgtcagtcgcagcaaggtaaaaaccttcaggctgctcatgcgtttatagggaaaccacaggacggagagaacccttcccgttggggaagggcaatggcggttatcagagaatacggcccagggtttgacgcaggtgagcacctgcacctaacaagcctggctgatcgtgggtgatcatatagaccggaatatcggcaacgtaatcgcgaaaacgccctttgtcttcaaatgccgcacggaaacccgaggatttaaagaattccaggaagcgcggcacaatgccgcctgcgatgtacacgccaccaaaggtgccgaggttcagcgccagattaccgccaaaacgccccatgatgacgcagaacagcgacagcgcacgacgacaatctgtgcagctgtccgcaagcgcacgctcactcacctctttcggcttcagattctcgggaacgcgttgatccactttcacaatcgcccgatagagattgaccagacccgcgcctgacagcacgcgctcggctgacacatggcccaattcttcccgcaacacttccaggatttgatcttcttcttcgctgttggccgcaaagtcaacgtgaccgccctcaccaggcaggctgacccagcgcttatcaacatgcaccagatgactgacgcccagtccagttcccgcgccgtaaatggccactggcttgtctttaaccggctctttgccaccaaactggatcacatgttctgcgcccagcatgggaatggccatggacaccgcggtgaagtcgttaataatttccaggtgttcaaaaccgatgttctctttgagctttttggtggaaaaagcccagtcatggttggtcatttcaacccagtcatcggtaatcgggcaggcaatggcgatacaaccgtctttgatatcctgcttttgttcatcaagatagtggcggatgacggcttcgaggctgtcgtagtctgatgttgcgaatgttttggcctgggagatgctgccgctttccacctcacacaaagcgaggcgggcgttggtgccgccgacatcgccgaccaaggcataagttgtcattcttctggtgctccgcttgggggtcttaaagagttggaggacactataaaatcctgccgataaaacaacaacgctcaccgaagctatgggtgagcgtctgactcgtgtgtgcaacagcctaaccgcgttagtctggcgtgcacagaggcaactttccgaatctcaaccgccgttgcgctggctcaggcaggctgagactttacgcagtaacggcggcaggtcatctttttgcatcaccacttcaataaacgacagcctgtgctgttgtttaagtagcgtcatcagtgcctgcaactgcacggtttcactgatgcgccagctctgcgcctggcattgcaaactcattgcctgcggcagcgctgtccagttccattgcgcgatatcattataacgttgagcggcaccatgaatcgcccgctctacagtatagccttcattattgaggagaaaaataatgggatgctgttgatcccgcagcatggaacctaactcctgaatggtcaactgggccgaaccgtcgccaataatcaggataacgcgctgagcaggctgggcagtttgcgcaccgaacgcggcgggtaaagtatagccgatagagccccagagcggctgtaccaaaagctgcgcaccgacgggcaaccgcagcgacgcggcaccaaaagccgccgtcccctgatcggccagaataatatcacccggctgcaggaacgcctgcatcgcctgccaaaaagcagactgactgatgatagctgcatccggaaccggctctggggccgacggcggacaggcggcctgccagtcggcaccatgacgttcaaacaccggcagtaacgcgcttagcgcatccgccatcgtcaggggtgcgaacgtttgccccgccacgctggcgctgtgcggctggatatcaataagccgtgccgggctgaattgctgggtaaaaccggccgtaatcgtgtcggtaaagcgtacgccagcgcaaatcgtcacgtccgcgttttcaatttgctggcgcacgtcaccttcactgccttctcccgcataggtgccgacaaaacccggttgctgttcatccagcacacctttgcccatcaacaaggtggcacagggaaaggcgcgtcccgcccgcaaggctgccagtgccggctgctgctgccagcgctgcgccagaaaatcggcgagcagcgatacacgcttcgcaggtgccagcaaccgctctgccgcctgctgaaacgcgatgcgcacctcatgaggtgaagcggtagggcgcattagcggctgctcaggcgctgaggtttgccgctgggcaacatccaccggcagcattaaatagccaggacggtgctgctgaagcgcggccaggatgacccggtcaatttcagccgtggcattgtcggccgtaagctgtgccgtggcagcgctcacctcctgcgccatccggatgaagtgaccaaagtcgccgtctcccagcgtgtgatgcacacaatccccctgctgcatcgcctgactcgaaggcgcgcccacaatgtggataacgggcacatactcggcaaagctgcccgccagaccgttaatcgcgctgagttcacccacgccaaacgtagtcagcaacgccgctacgccggagcaacgcgcatagccatcggctgcataggctgcattcagttcgttagcacatcccacccagctaatgtccggatgggcaataacacggtcgagaaactgcagattgtagtcgcccggcacaccaaataaatgcctgacactgcactcctgcaagcgagccaacagatagtcaccaaccgtaaaatcggacatagcgcgttccttttaggggattgttctgataagtatctgacatggcgtaaatttggcgagaacggctgcagatttagccaatctattgcatggcaagcccgcgttacgaccgtgtattattccgtgaatatgcgacttcacgcggattaatactgagtgtaagcgtatacactcctccggttttggcacatttattcgttttcactcaggacccttatatgacagctttccctcatccggaccgatatcagcatatgcagtggcgtcgcagtgggcgcagtggcctgaaacttcctgcgatttcactgggcctgtggcataactttggtgacagcacacagttggatgtcagccgccagctattgcgccacgctttcgactgcggtatcacgcatttcgatctggcgaataactacggcccgcctcctggctcagctgaaacgaactttggtcgtatcatgcgtgaagattttcaggcacaccgcgacgaattgcttatttcgacgaaagccggttacaccatgtgggaaggcccgtatggtgactggggttcacgcaaatatctggtggccagcctggatcagagtctgcgccgtacgggactggaatacgttgatatcttttatcaccaccgtcccgatccggagacgccgctggaagaaaccatgcgcgcgctggatcatgtcgtacgtcagggaaaggcgctgtatgccgcgatttcaaactatcccgcgcaacgggcggctgaagcgatggcgattctgcgcgatctgggtacgccttgcctgatccatcagcctcgctattcgttatttgaacgcacgccagagcagggattacttcagacactgtatgaacatggtgcaggttgtatcgcgttctcacccctggcaggcggtgtcctgaccgatcgctatctacagggtattccacaggattcacgcgttgccagcggcagcaagttcctcaacgaaaatcagcttactgatgaaaaaatggaaaaagtccgcaagctaaacgccattgctcaacagcgcggccagaagctggcgcagatggcgttaacctgggtgttacgtgatccacgcattacatcagtgctgattggggccagtaaaacggcacaaatcgacgatgcagtgcagatgctgaatcaggctcctctcacggatgacgagcttgccgccattgagtctgccctgctgtaacatgcgccgcctgcttcgccgggcggccatcccggaatactcttaaaccctgatttctcgcggtttttcagacggtttccacaggtttctcagacgcaatatcgacagaatagcgaaccagcagcggagacacgctgccgtcaggagaaaatcataatacgtggaattttactggctgcctttgtagccatgttaacgccgctggcaatgcacaccgctcaggcctcagggtcatcaattaatcttgcgccgggcgtatcgcttcatctgggcgatcgcgaccgccgcggctattactgggacggcaaccgctggcgcgagccgcgctggtttaacgatcgctatgcgtataaagagcgtcgctggtggcgacacgaagcgtggcgacgtcatcagcagtgggaacgtgaacgccagtggcgcgcgcgcgaccggcaacgtcgttgggagcatgaacgacgccactggcaccacgaacgccgcgcgcaccaccgttatccggaacgctatcgctaaagcgcctctgtcggcccacgcgtcggcagatcacctgaggcgatagcgctagagttagaggtgtttcactcttgccataacaaacccatcccagcccttttcacctacggtttgaatggctgtggcctccagacgggcatcgctggaaagcagctcgaaaaacgcacgtaccccctgcacgttgatgtctgcggaatcggcatcggttaccgccccgccgcgcacaacgttgtcggcgataatcacgctgccaggacgagccagggctaatgcccaattcaggtaagcgggattatttttcttatccgcgtcgataaagatgagatcaaagggtccctgcaggtgaggcagtacatccagcgccacaccgatgcgcagatcgacgcgtccagacaacccggcattgcggatgttatcactggcaacctgcgcatgatgggcgtcggcttcaagggtggtgattttcccttcttcgcccagcgcctgcgccatcaggatggtgctgtaacccccaagcgtgccgatttccagtacgcgtgctgcgtttagcattttgataaacagtgcaagcatgttgccttgcagggcagaaacgtcgtgggctggcagccccgcctgactgttggcaaccagcgcggcttgagcaaggcgatcggtagggaggagtaactgagaaaaatagtcgtcgaccgcggcccattttgcgtggtcttctgaaggataatccggcttccgcatcattctgctcctgaatcatcaagacagaagaaaatataaaccgatgcggataaacctcaagacaatatcattcacaccgaaaacagacgcctgcctgaccgtttatcaggcagacgcgttacattcccattgcctgaccgattaacagataagcgttaagactcaccaccagcaccacgatgacgcgccccgtattttgcatcagccgtgaattgaccaacgcatcgcccatcagctcgcggttgccggtaaacgccagcagcggaatgagtgccagtgcgataccgaagctgagcagcacctgactcatgactaacacgcgcgtcgggtcccagcccgcccagatcacgagaaacgagggcaccatggtcactgcacgtcgtacccacagtggaatatagaatttaataaacccttgcataaccacctgaccggccagggtgccgaccacggttgaagacagccccgccgcgaccaggcttaggccaaataccgttgcggcagcgtgccccagcagaggctgtagcgtggtgtaagcctgatcgagttcggcaatcccactatggccgctaaaatggaaggcggcagcggccgtggccatcatcgccaggttgacaaaccccgcaatggtcatggcaatggcgacatccagtttggtcgaggaatagcgctgagcctgactgtcatcgcttttcccctgggttaaggcggaatgcagataaatcacgtgcggcataatggtggctcccagtacgccggcggcaagaaagaccgcgtcggtattgggcagtgacggcagtgccatgcctttaaccagttcactcacttttggctgtgagaaaaacagctccacaatgtaagccgccgccacaaacagcagtagcccgccaatcaccagctccagcggtttttgcccacgattttgcagcatcaaaattagcacggtggccacgccggtcagcacggcgccctgcatcagagatatccccaatagcagtttgaatcccagggctgcaccgatgaactctgccagatcggtcgccatggcaatgatttctgcctgcacccaatagaaccataccgccggacggggaaaacgatcgcggatatgttcagccaggtttttacccgttgcgatgcctagcttcgctgacattaactgaataagcatggccatgatgttggcccataccaccacccacagcagttgataaccgtaagcggcaccggcctgaatattggtcgcaaagttgcccggatcgatatagccgatagcggcgataaaagcaggccccaacagggcgagtttgacttttctggctccgcgagcggcgcgctcggcggcacggctttcaaacatagtggctaccctgtctttgttttacctgtgcagcttaaggcgacgcaggcgcaagtgaaatttggttttggtaatcgctgtaatagatagtgctataaagtatagcctttgctataccctgggtatgtaaaaaccctacaacttaaggcgcaattccgtcactctacgtgttgtgtaaattacagacaatagatttaagtgaatatgatgtgaacaatttggttacagggcgtgatcggtgagagttttctgagaaatttggcgatattgaatacttatattgtggtagagatctcgtttttcggtaagccgttacatagaatacgcagcaaaatacaatcctcctcaaatttggagcaatcatgtcccatattttgcagtttcttttagcactagtggttgtcggtgtgctggccttgctggtcagccacgacagaaaaagtattcgaattcgctacatcgtacagcttctggtcatcgaaatcattctggcatggttcttcctgaactcggaagccggtctgggcttcgtcaaaggatttgccggtttcttcgatcatcttctgaaatatgcggctcagggcactaatttcgtcttcggcaacatgaatgataaaggcctcgccttcttcttcctgaacgtgctgtgccccattgtcttcatctcggcgctgatcggtattctccagcacttccgcatcctgccatgggtgattcgcggtatcggtactgtgctgtccaagattaacggaatgggcaaactggaatcgtttaacgccgtaagctctctgattttgggacagtctgagaactttatcgcgtacaaagatatcctgggcaagatgtcacaacgtcgtatgtacaccatggcggcaaccgcgatgtcgacggtttctatgtctatcgtgggtgcttacatgaccatgctgcagcctaagtatgtggtcgcggcgctggtgctgaatatgttcagtacctttattgtgctgtcgctcattaacccttaccgcgtagacagcgaagaagatctgcagttgcaggacctgcatcagggtcagagcttctttgagatgctgggcgaatacattcttgctggtttccgcgtcgccattatcgttgcggccatgctgattggttttatcgcactgatttccggcctgaacgcgctgtttgacttcattttcggtgtcaccttccagggcgtgctgggttatgtcttctatccgtttgcctgggtaatgggcgtgccgtctggcgaagcgctgcaggttggcagcatcatggcaacgaaactggtttccaatgagtttgtggctatgatggatctgcagaaagttgccggtcagctgtcacccaatgcagaaggcatcctgtcggtgttcctggtctcgttcgctaacttctcgtctatcggtatcgttgccggtgcgatcaagggcctgaacgaagagcaaggtaacgtggtttcacgctttggtttgaaactgctgtacggctcaaccctggtcagcgtgctgtctgcggcgattgcaggcctggtactggcattctgagttagcgctctgcaaaacattaaggcgagtcaaatgactcgccttttttgtctttatcccgcctgtttgcgcctgcccgctggcatgtgttcagacacaacgcttgatcgcgcttaccacactcatcaatactgcccgactagtgggagcgcgccccgattataatccagagcgaatcccctctttccaccggttatgtttgtttgacaggagccatgatgagtctggaccccgacagctacatccccacgctagcgacagctgacgttcagccggcgtttcaggctgtcgtcaacgcagctgtggcccgtctgagcgctgactatcgggatggcctgcacagcatttatctttacggtagcgtggcgtgcggaaacgccgtcaagtgcagatcggatttagatctgtgtttactcttcagccatccactccggcaagagcagcaagccagactgtcagcgttaaaagaggcgctggcggaagagcatcctgtggtgagtaaagtcgattttgatatcggcacggtcaatgaggcactcgcgccggaaaaccgcctttcctggggctactggttaaagcaccactgccgctgcctctatggccaggatctctctgtgtactttgaacgtttccgcccgtcccgcgcgttggcacgggcaataaacggtgatgtcgcagcggtattgagtggctatgccacgttattatcccgcgccagccaggctcatgagcagcagcaatatcagcgcgcggcggccagaaaactgattcgctcaaccaatatgttacgcacagataacgatatcgactggccacgcagcctggaggatcatgttgtgcgattcgttgcgctttatccggaacgtgaagacgcgatcaccttctttttagcagagagcaagacgccacaggcaactgttgcggaatttacttcacgccttaatgatttcagtcgatggctgttgcagcaattaggttgaacgggggcggaatccaggcgttaagtggaatgagaatgcaacgcagtgcagttgaaagatgtcaggaggcgataagcgggatcgaaccgctgacctcttgcatgccatgcaagcgctctcccagctgagctataaaattacttttcagtaagttagctaagtagcttccccccacatctggaaactttaccctataagcggcccaatcataaatacgtttaaaaaataacaactatgattacattaagattcaacaatgaaaataaagatatattggcatggtaacactttactatttcctgcattgaaggaaactcaaacagaaaaatgaattacttattgatagatatatttttcaccacctattaacgtgaaattataatctgttagagagaccttatttccccaggcgcgtgaatcagacttttcataataccacttgccatttcttgaacgcgaaagccatgacttatcccatttcattatttacaatcgcacagagaaatactaacacattaataattaaaacttttatatggctatcattgatacaaccacgttcccgctttagctgactcagcaaacatttttactgttaaaggctgcctgtgttgttttactggctcttttttaaaccacgcacgaaaaaaccaaggcgtcgtccagggatagtaattatcaatattcaacgttgaaacatcaatattaaattggtcagaatactgatctatagcttcaaccaaatcatcaagttctgcgtattcctgtaacgggtcattgatttcaagtggaacgattttgaagctgaacgttcttatttgcggcaatttttgccggaagaaatctaaaacttgctcatcagttaccataacttatcatcacctcgtgctatagggttgtagttggtcatggcattgaaggcaatttttgatacgtctgaggcgaccataacccagcctaatatagggacagttctgccaaccagtcagggcatcttctacattcacgggatgctgttgagtttcttctctattagtctaacaatcacctgatagccaatcacggttactaaggtgcaaatcactaacaatccaatcccaacaaagccttcaatgtcacgctggccaaagattttagccacagcaatccagaattgttgttgtcccggcgttgagggatctgaaggtctggctatcaagaatgtaataataaaaatagcaactccgatcaggattctaaaccccgttgggacacgttttgcttccatttaaaaccacctcgattgttccaaacgacatcagcccattacgtaatttcacttgcggtgtagagagcaatgcttgccttatggctgtaaaatcggttttgtgctgtagggtaatgcagcctaaagaaattccaagagggccgcgagggtgaagcctaaaattccctctttctacgttatttatccaggtatgatcgtctatctttccatcatcacgatacaaagcaaaccattcatacttaataacgggtgttgaagtaggccacgagtaaaaatcgtgtaagtcagttctgacaacacctttccaaccacctgttgggcgtttaacgatgtgatatagaccgtcaggtattggcccattatctggaactgcaatacatcctgcactgttgcggtattcgccattaccagagaaggccataaacgttcctacgccatacattagcagaggggagtagtctgcatcattaacagtgaactttccttttaatgccatatttggctccttcaacacacaccctaacgataaggatgacttatcataaagccccatcataaaaagacaatagaagccatacagccccgttggcggtaaggcaataacgggagcgtagcgacttcatcaattgtccagaatgaccacaacttatcaggatgtttgtgtatttcttagaagcgtgagcgaaacgctggcagagccggaactgtagctaccagaatcaaccaccataagcctgtttagggccataaaaggccgcacatcgggcttaaaatgcgtgtgatcagactgttttgtaagaagtgttttgagacggaggcacgtcattagctttcgagttttgaattgctacctgttcgagctattaactacaggccacagtgatgttattctcacaaattgccactaacaccactgtggcagtgtatgagtaaagtcactcactcgaaatctattaacgtattgatttgaaaacaagaaatgattggtggagataagcgggatcgaaccgctgacctcttgcatgccatgcaagcgctctcccagctgagctatacccccacatctggaaatcgttttttcagtgccaaacttttgggaagaagtttggtggagctaagcgggatcgaaccgctgacctcttgcatgccatgcaagcgctctcccagctgagctatagccccgtaccgaaaaaaccgtcgtgttaagcgacggacggcataatatgaaaccccccatggagtgtcaacggcaaaatcacattctgtgtttgatcgctgaaaaagacggcaaactcagcgtgatgacgggcgtttgtttctctcttgcccttgttaacatcatgaaaggagcctgggtttgattagtaattttttatcggctgctaggttaatacgcggttaaatatgttataggaattatcttgtcttccctgtaatgtcgtgtaaaacttagcccgctatgtaatacggctgcatggttttctccagcgcaccgttcttcaaccaggcgttttcgctccaatactaaaatcaatagagaatatatgtcgctgcatacacccaaagagatcgcccaactggcgattcaggctggcgtggcaaaaagccatgcctccattagttccttaattattcttggcttcatggcaggtgccttcatcgctacaggcttcttgttggatgtccacgttatcaactcactcccagcggactggggttcatttggcggctttctaggtgctgcggtgttcccggtcggtttaatcctgaccattctggccggtggcgagctgttaaccggcaatatgatgacgttgcctgttgcctggtttgcacgccgcgtaagtggctacagcgtattacgtaactggttctgggtaaccattgcgaacttccttggcagcatcgctatcgcctggttctttgggcatatgctggccatgaccgaaggcgactacctgaaaaagacattggctattgctaacgcaaaagtgcatgccgatttcctgcacgcctttatctctggcatcggctgtaactggctggtatgtcttgccgtgtggctggcattcgccagtaaagacgtggtaggcaaaattttcgctatgtggttcccggttatggcgttcgtcgccatcggcttccagcacgttgtcgcgaacatgttcatcatccctgctgcgattttcgccggacagatgagctgggctgaatatttccccaacttcgtggcggtattcttaggtaacgccgttggcggtgccgtcttcgttggtctggcttacttcctcgctttccgccccgctgccgagcagccacgcaccgcgcaataaactttctttgccttttgttgagagacaaaaggcaatttcgtttccagttactttcacgcgttacgatttgctgtaatatgtatggctaatgtatttaacagggacagcatcgtgaaaaaggaatggctaactccggaagaactggcaatcgaaacgggctacagtcggcagacggtgaacaaatggatcaaacgcgagaactggacgaccacgccaaagccgggtgttcagggcggaaaagcaagactgattcatattgatgaacgcgtgaaaagtttcattcagtcgacgcgcaatcttaatgaacccacggcaaattacacgcctccagcgaattctttacctgcgttattgataagctctgtccagcaaatgagtcagaatgaacaagatcagcttacggcgttgattctgcgggaagggattaaaggtgtactcggccgtctggggattagtgaagagtaagaaaccggaagcgtaatgcttccggtttttttattagttctgtgcttcgcgctcggcaataaaggccagcgctttttcaatacgcgcgacactgcgggtgcgaccaatcgcttccaccgtgacatccagtcctggggactgacctgcgccggtcacggcaacgcgcagtggcattcccactttacccatgcctacgcccagctcatccgcgctctgctgaatcgcctgatgcacggtttcggcattccagtcagtcaatgcagccagtttatcgcgaaccacttccagcggttgacgtgcaaccggacgcagatgctttttcgcggcatcggcatcgaattctgaaaagtcctgataaaaatagtggcaggacgccgccatctctttcagcgtcttacagcgttcaccgagcaaggtcaccagcttcgccagctccgggccagtgcgggtatcaatattctgctgttcaatgtgccattgcagatgtgttgccacatactctggcggcagcgcgttgatgtagtgatgatttaaccactgcagcttttcggtattaaaggcgctggcggacttactgaccgcgtccaggctaaacagcgctgtcatttctttgacagagaagatttcctgatcgccatgagaccagcccagacggactaaatagttaagcaaggcttctggcagatagccgtcatcacggtattgcatgacgcctaccgcaccatgtcgcttagacagttttttaccgtcgtcgcccaggatcatagaaacgtgggcataaaccggtacctgtgcaccgatagccttgagaatattgatctggcgcggggtgttgttgatgtgatcttcaccacgcacaacatgggtaatgcccatatcccagtcgtcgaccacgacgcagaagttatacgtcggtgagccatcggtgcgacggatgatcagatcgtcaagctcctgattgctgaactcaatcgggccacgaatctggtcatcaaaaataaccgatccctcttgtggattacggaaacgcaccacatgcggttcatcatcggcatgatgttcatggctgtcgcggcaacggccgtcgtaacgcggtttttcaccgttagccatttgcgtttcacgcagcgcttccagacgctctctggagcagtaacatttataagccgtacccgcttcctgcatttcatcaataacggcgttatagcgatcgaaacgtttagtctggtaatagggaccttcatcccaatccaggctcagccagttcatcccatccataatggcttcaatggcttccggtgttgaacgctcaagatcggtatcttcaatgcgcagcacaaactcgccctgatgatgacgggcaaagagccatgagtagagggcagtacgcgcgccacctacatgtaagaagccggtggggcttggcgcgaagcgagttttgattttcattcagtattgccttaaatgcgcaggttcgttgtctggatgacaaaaaacaggttagacgcgaaaagagtgcgcatattctagcatctgatgatgaatcctcaatgcatgcaaggcagctgagcgccagcaaaccctatatttctgctaagaaaaccagcacattggataaaatcgctacgggatgtttaaaattaaaccgaacgcacaattatgttttaaaaagcgttgactcaaaatcaactatccctataatgcgactccacacagcgggggtgattagctcagttggtagagcatctcccttacaaggagggggtcggcggttcgaacccgtcatcacccaccactcttaacaaggtttaagatggcccgcagtgtgcaagagataagatatgggtgattagctcagttggtagagcatctcccttacaaggagggggtcggcggttcgaacccgtcatcacccaccatatcttagtcagatgacactcttgtgaagcagtaccgaagtgggtgattagctcagttggtagagcatctcccttacaaggagggggtcggcggttcgaacccgtcatcacccaccacttcgggtcgttagctcagttggtagagcagttgacttttaatcaattggtcgcaggttcgaatcctgcacgacccaccaatgttgaaaggcgccctaaaggcgcctttttgctgtgcgcaaaacgtgcgggatgagaacctgccgcaggttcgactgaatcgcaaagcggttcaggctgatgcgccagcatcacccgaagggcgaggcccaccgggccgaggcaatcctgcacgacccaccaatgttgaaaggcgccctaaaggcgcctttttgctatgcgtaaaacgtgcgggatgagaacctgctggcaggttcgactgaatcgcaaagcggttcaggctgatgcgccagcatcacccgaagggtgaggcccggacgggagaaaccctgtccaacttccctctccacataaagcgctggcgccctttttcttttctgtgctcagatgacagtcgggtccatcttacctgtcgtcacctctcatcttccctgcccgccttaacctcacgcaagaatgtaagaatcttttcacatatttaacactcagagacattaagcttttcctgttaacgtccgataacctaaaacgtctaattgtaaggagagcctcatgacaactatattaaccagcacaccgagtatcggaagcggcagttcatcagacacggtcaattcaagtgataccgcatcacaaatcgccagcctgaataagcagatttctcgtctcaacgatcaactgaaaagtttgggcgacgataagacgatgaccacagaggagaaaaagaagcagcaagatacgattaaggcacaaatccaggttttagaagcgcaaatccagcagttacaacgcaaagagcaacagaaagctgaagcaaagcaggcgcaaaaagaaggtaatactacccctgcagatggtgttaatcgccctacgcaaaacaaccaacttgacgtttatatttaaaacgcaggtctggattcgcgttgttgcgtcagcaatcttgcctgctgacgcacttcctgccatatcgcttcggccgctggcgttaaagagcgatttttacgcttaattaatgtcagggtgcgattgatctcaggatagagacgccgtaccgttagtgcgcgccctgccggtagcggtaacgccagggccggtaaaatgctgatcccgatgcccgcatcgaccatgggaaaaagcgtagcgggatggccgatttcctggattacgttaatattcacgttctgctggcgtaaagccgcatcaattaatacccggctgcctgaagcgtaatcctgcagcaccatcgtcctgccgtccaacatagaccactgcgccagtgctacctcggcaagcggatcgtcttcccggcacaacagcagaaaaggttcgtccagaatcgcacagcagtcaaaatccgtgtcattaagcgggccgatgacgatcccaaaatcgacttcagcattgcgtacactttctaacacccattgctgaacgcgatcgtgcaaaatgatcttaatatcaggatagctatgctggctggcggcaagacattgcggcatcaggtgcgcagaaatggtctgactggccgcgattctcaccgtcccactgcgttgttcgccgtagctgcgaatatcaagcagcgtcgtattcatctcttccagcagcctttccatgcgcgatgccagctgctgtccggcctcggtcaggaccacttcgcgcgtcgtacggtccagcaggcgaacgccgatttcattttccaactcttttatactgtggctcaccgctgactggctcaggccaatagcctgcccggcctggctaaagccgccatagtgggcaacggcaacaaaggtgcgtagctgacgcaaagagtaattcatcgatttctcacatagattaatctaataaattaattttatttctaaacccgcatcgcgcacaatcctcacagacttaatttaaccggattgtaacgatgggatttttacgtatagacccaatgatgattaagcttatcatcaccgtgttgttggcctcttttattcctgccagaggcggcttcgttgacgttttccagtacctcactaccgccgcgattgccctgcttttctttatgcatggtgccaagctatcgcgggaaaaaatcattgccggtagcagccactggcgtctccatctctggattatgtgcagtacgtttgtgatgttcccggctatcggcatgctaattgtctggtggcatccggtaaacgtcggcgcagagatttataccggtttcctgtatctgtgtatcttacctgccaccgtgcagtcagcgattgcctttacctcgatggctggcgggaacgttgccgccgcggtatgtagcgcatcggcatccagcctgttgggcgtatttatctccccgctgctggtgaatctggtcatggacgtcaacagtaacgggccgggcgatggtctggagcaggtgggaaaaatcatgctgcagctgttggtgccttttgttctgggccatctgtcgcgtcgctggattagcggctgggtggaaagacatcgtggtctgattgggattaccgatcaaacctccattctgttagtcgtttattccgccttcagtgaagccgtggtcaacggcatctggaaacgcgtgggcgttgatacgctgctgtggattttggcgggatgcgtactgctgctgacgatcgtactgctgattaactactttgcctctcgtctgttcggcttcagccgcccggatgagatcgttgttctgttctgtggttctaaaaagagcctggcaaacggcgtgcccatggcgaacattctgttccccgccagtgcggtcggcatcatcgttttgcccttgatgatctttcatcaggttcagttaatggtgtgttcgtttatagccgggcgctataagaaaaccaacgacatgcaggctaaaaaagtaaaagcggcggcggtggaatcgcagaagtaactcaaacgctgcctcgttggcttgatacccacgaggcagcgtgcttattcaccacgctttaagggcttcaccagcccttccagcccttcaattttaatggtcagcgtcagctgcatcagctcacctaaacgccctgacggaaaatcaccactgcgggcaaaccacagcaaatagggttcaggcaaatcaatcagcatccggcctttatatttgccaaagggcatggctgtattggcaatctcaaccagatactgtttgtccatttcaggcccccaataaccgaatcatttcagcctcgtcaatcacctcaatgcccagttcctgtgccttcaccagctttgaaccggcagcttcgccagcgataagcaaatcggttttcctggatacactcccgctcactttcgcgccgagttcggtaagacgggccttggcatcgtcccggttcatctgtgacagcgagcctgtgagcaccacggttttgcctgcaaatggactgtcaatctcttcggcttttaccactaccacttgcggccagtgaatgccaatatcctcaaccaactgacggatgacttcccgattgctctcttcttccataaagttgcggacatgcttagcgacgacggtgccgacatcctgcaccgcaatcaacgcatcaagatcggcgtccatcaccttctgcaactcaccaaagtggttggccagattagccgccgtggcttctccgacttcacgaatccccagtgcatacaggaagcgcgccagcgtggtggatttggccttctctaacgcatcgaccacgttctgcgctgatttcgcgcccatgcgatccagaccggtcagggtttcacgggttaaacggaacagatccgctggcgttttgacatactctttttccaccagttgatcgatgatcttatcgcccatgccatccacatccatggcacggcgcgacacaaaatgcttcagcgcttctttgcgctgcgcgccacagatcaacccaccagtacagcgcgtcacggcttcgccttcgatgcgctccacatcagacccgcagaccggacagtgggcaggaaacacgatttcacgggcatcctcaggacgttcgctggcgatgacattcaccacctgagggataacgtcaccggcacggcgaataaccaccttatcgccgatacgcagatcaagccgttcaatctcgtccgcattatgcaaggtggcattgctgaccatgacgcctgccacctgcaccggctccagtcgggcgacaggcgtaatcgcccctgtgcggccgacctggaattcgacatcacgcactacggtcatctgctcctgagcggggaacttgaaggccaccgcccaacgcggcgcgcgggccacaaagcccagtttttcctgcaaatcctgagaatcgactttgatcaccacgccatcaatatcaaaccccagcgctgtacgctgggcttcaacgtcgtgataaaacgccagagcctcatcggcattatgagccagacggatacgatcgctgacgggcaaaccccaggctttaaactgttgcagacgcgccatgtggctgcgcggcatctcgcccccttccagcagacctaacccgtagcaaaagaaggtcagtggtcgtttcgcggtgattcgcggatcaagctggcgcagggaacccgctgccgcattgcgcggattggcaaagactttgccctcggtacggcgcgcttcagcgttcagcttttcgaaaccgcgttgggtcataaagacttcaccgcgcacttcgacgcgggcgggaatattatcgcctttgagccgcagcgggatggcgcgaatcgtccgcacattggtggtgatattctcgccggtcgttccgtctccgcgtgtggcggcacgggttaacagtccatcttcatacaagaggctgacggccaggccatccagtttgagttcgcagcagtaaaccagatcatcgctgcttttcagacgatcctgcacgcgtttgttgaacgctctaaagctggcttcatcaaaggcattatccagtgacagcatgggaacttcatgacgtacctgctcaaacaccatcagcggagcagcacccacgcgttgcgtcggtgaatccggggtaatcagatcgggatgttgttcttcaagctcacgcagttcacgcatcaaacggtcgtattccgcatcgggaacgtccggcgcatccattacgtgataaaggtattcatgatggcgcagcgtagtgcgcagttcggtgatgtgttcctggacggatttcatataaccccatcagataaaaaacccccgacaggcgggggtttatcataacaaattggaaaagtgcggatcagtctctggattcaaccacatcgcggatacgcgctttgtaggtttccagtttctgcggcgtcatcatgcggcgctcgtcatcaagtaccacgccaccgacatcgtccgcaatgcgctgtgccgactgcagcatcagtttgaaattctgattcgcatcaccatacgacggcaccatcatgaaaatggacacgccgggcgtagtgaagtcggtcatttcgtctggattaaatgaaccgggtttgaccatgttagccaggctaaacagcaccgggccacttccggccggactgagatggcgatggaagatgttcatttcgccatactggaagccggcctgcaaaatgccctgtaacagcgcttcaccattaagttgaccaccagaatgggcggcaacatgcagaaccaacacggcttctttcggtttgctgctggtcgccggtcgggactcgggctgcttaggctgcggcgggctaaccacttctggctcaggctcaggtgccgcctggtaaaccggattaggctgcaccgtatccagcgggtcggcatccagcaaagggtccgcctgtaccggaggcgcggcaacaaaggtaggctgctggcgcgcgggccgttgctggggcgtaggttcagacgttggcgctggggcaaaaagcggatcgctgtcaggcccggcggtggatgactgacgcgcgcgcgctgctgtgacaggctcgtccggctgcacgcgagtgttgtcgaaatgaggctcctggtgttcgcgcgtgtggcgcacacgaacttcaccgacgccttctgctacgtcatcggtcagggtctcatcatcatgttcatcacgttgtttcaaacgtttgtgcgggcgatcgcggaacactgaagagcgctctttacggctggtccacagtccgtgaataagaagcgctataatggcgatcgcgccaacaacgattaatatcagacgcaaatcctgcatcattgtattctctgttgttccaataccttgccaccgcggcaaactttattctctaactgtatttgccctgccagataagtgcaagtctgtgcagtattttctcacaaataagatagaccacccacgctttttcgctgtttttttacccaaacggcacctggccagcagaaaaagccaggttatagtgggcgcgccttaacatcttcaggagaatgggctctatggctgtaaacaattcggtatcctcatttaacggtgtgcactacttcagccagggctggaagctggtcagattacccggcatcaggcgctttgtgatcatccctttactggtcaatatcgttctgctgggcggcgctttcgtgtggcttttttaccagcttgatacgtggataccacagttaatgtcccatgtgccagactggctgcagtggctgagctatttgctgtggccgctgtctgtgatttccgtcgtgctggtgttcagctacttcttttccaccctagccaatctgattgctgcccccttttgtggcctgctggcagaacaactggaagcgcgcctgaccggcaaaccgctccccgacagcggctgggtcggcatgctcaaagatataccgcgtatcatgaaacgtgaattacagaagctgggctactacctgccccgcgcgcttggcttactgctgctctactttattccgggctttgggcaaactgtcgcgccggtgctgtggtttatgttcagcgcatggatgctgtccattcaatactgcgactatcccttcgataaccataaggtaggttttcagcagatgcgccatgccttgcgtcagcacaagacggcgaatatgcagtttggggcgctggtcagcctgtttaccatgattcctgtggttaaccttgccatcatgccggtggcggtttgtggcgcaacggcgatgtgggtcgatcgctatcgcacgcgccttgcccgcgcaaacccaggctaaactcatcagccagccttatgcgattttttgcaggtcttattgccatgagacatatagatatatgatttctttccttccgccagaaagaagaacaggtatgctctgagggttcccaataattcatacagttaaggacaggctatgagcaagatttatgaagacaactctttaacaattggtcatacgccgctggttcgactgaaccgcatcggtaacggccgcatccttgtcaaggttgagtcccgtaacccaagctttagtgtgaaatgccgtatcggtgccaatatgatttgggacgcagaaaagcgcggtattcttaagcccggcattgagctggttgagccgaccagtggtaacaccgggattgcactggcgtacgtggctgccgcgcgcggttataagctgacgctgaccatgccggataccatgtccgttgaacgtcgtaaactgctgaaagcattgggtgcgaacctggtgctgaccgaaggcgcaaaaggcatgaaaggcgcaatcggcaaagctgaagagattgttgccagcaatccggataaattcttgctgctgcagcagttcagcaacccggccaacccggaaattcatgaaaagaccaccggcccggaaatctgggaagacaccgatggtgaagtggatgtgtttattgccggtgtcggcaccggtggcaccctgacaggtgtgagccgctacatcaaaaacaccaagggtaaaaaatcattgatcacggtagcggtcgagccaaccgattctcccgtgattgctcaggcaatggcaggcgaagagctgaaacctggcccacataaaattcagggcattggtgccggttttattcccggcaacctggatctggcgctgattgacctggctgtcgccatcaccaacgaagacgctatctctacggcacgtcgcctgatggaagaagaaggtattctggcaggtatttcctctggcgctgccgtcgccgccgcgctgaagctgcaggaagacgaagcctatgccgacaagaatattgtggttatcctcccctcttctggtgagcgctatctgagtactgccctgtttgccgatctctttaccgagaaagaactgcagtaagcgggaaggctttcggataaatgcttaaaaagcacccagatgggtgcttttttgtggcgtagatctcacttttaccatgcggcagattgatttcagtaacgtggctctggtatttagactgccaattatttcgaagcctgaaattaatcctcctttgaagtggatcaagctgagtcaatattcagatttagtgaaagggcgaatcacggcataattacccggtgacgtgctcaaaacgctttttgacactcagcgggaaagaaagactcattcaagcgcatttgtcagacagtaagatgtatacccgcgcacctacacaggctaaagttacggctccaggctagactttagatccataacactaatcctgaaaaagttggggaaatagaatgttccagcaagaagttaccattaccgcaccaaacggactgcatactcgccctgctgcgcaatttgtcaaagaagctaaagccttccagtcagaaatcactgtcacctccaatggtaaatctgccagcgctaaaagcctgttcaagctgcagactttgggtctgacccagggcaccgttgtcacactttctgcggaaggtgaagatgagcaaaaagccgtagagcatttggttaagctgatggcggaactggagtaatctcctttctgcaccgctttaaaacgactcttctgcgccattgcgtgcaacatcttgatcgcggacaaactgtccgcgttattgctttcgtagagtacgtgtcccacgactatggcaatgcaacgagtccagtcagccatcgtgataaaaaggtaaggttatgatttcaggcattttagcatcaccaggtatcgctttcggcaaagctctgctgctgaaagaagacgagatcgtcatcaaccgcaaaaagatttcagatgatcaggttgagcaggaaattcagcgttttcttcagggccgtggcaaagcggctgagcagctggaagccattcgcattaaagccagcgaaaccctgggtgaagaaaaagcagcgatcttcgaaggccacattatgttgctggaagacgaagagctggagcaggaaatcaccgacctgatcaaaaaagatcacgctactgccgatgccgctgtgaactcagtgattgacgctcaggctaaagccctggaagagctggacgatgaatacctgaaagagcgcgcggcggacgtgcgcgacatcggcaaacgcctgctacaaaatattttaggtctgcacattgtcgacctgagcgcaatccaggacgaatctattctggtggcgaaagatttaacgccgtcagaaaccgcacagctgaacctgaaaaaggtgctgggctttattaccgatttgggcggtcggacttcgcacacgtcaatcatggctcgctcgttagagatcccggcaatcgtcggtaccggtaacgtgaccgccacgatcaagaacggcgatttcattattctggatggcgtgaacaatgcgattcacatcaacccgtctgaagcggttcaggaagagctgaaagccgttcagcatcagtatcattcagaaaaacatgaactggccaagctgaaagacctgccggcggtgacgctggatggtcatcaggtcgaagtctgcgccaatatcggaaccgtgcgtgatatcgccggagccgagcgtaacggcgctgaaggtgtaggtctgtaccgcaccgagttcctgtttatggatcgcgattcgctgcctaccgaagaagagcagttccaggcctataaagccgttgctgaagcgatgggatcgcaggccgttatcgtgcgtaccatggacatcggcggtgacaaagacctgccttacatgaacctgccaaaagaagagaacccgttcctgggctggcgtgctatccgtatcgcaatggatcgtaaagagatcctgcatgctcagctgcgcgccattctgcgtgcttcgtccttcggtaagctgcgtatcatgttcccgatgattatttcggtcgaagaagtacgcagtctgaaagcggaactggagctgcttaaagcgcagttacgcgaagaaggcaaagcgtttgatgagtcaatcgaagtcggcattatggttgaaacccctgcttctgccgtgattgcccgtcacctggctaaagaagtcgacttctttagcattgggacaaacgatttgacgcagtatactcttgcagtagatcgtggtaatgatttgatttcgcacctgtataacccaatgacaccgtcagtattgaacctcatcaagcaagttattgatgcgtctcatgctgaaggtaaatggactggcatgtgtggtgagctggcaggtgacgaacgtgctacactactgttactgggaatggggctggacgaattcagcatgagtgccatttctatccctggcatcaagaaaattattcgtaatacacatttcgaagatgcgaaggcgttggcagagcaggcactggctcaacctacggcggaagacttgatgaacctggttaacaagttcattaaagaaaaaacgctctgctgatccacgagatgctggccccaaattactgcttaggagaagatcatgggtttgttttctaaactttttggcgaaaaaacagatagcgctgggacaattgatatcgtagcgcctctgtcaggcgaaatcgtgaacattgaagacgtaccagatgtggtgtttgcagaaaaaatcgtgggtgacggtattgcgatcaaacccagcggcaacaaaatggttgcaccggttgacggtactatcggcaagatttttgaaaccaatcacgccttttcaattgaatcagataatggcattgagcttttcgttcatttcggtattgataccgttgagctgaaaggtgaaggctttaaacgtatcgctgaagaaggtcagaaggttaaaaaaggcgacgtggttatcgagttcgatctggcgctgctggaagagaaagcaaaatcaacgttaacaccggttgtcatttccaacatggatgagatcaaagagctgactaagctttctggtcaggtcatcgtgggtgaaacgccggtgattcgtattaagaagtaatccgcactaagacctaaaaagaaaaacggcaccctcaaaggtgccgtttttttatggcctgtgacaacattaatgcggctgccaacgcggtaaacgcagggttaactcaagaccgccttctggccggttaacggcgcggacttcgccatgatgcgccagaaccaccttacgcacgatagcgagccccagcccataacctttccccatcaggggtgaattcacccgcacaaaagggtcgaaaatactggagagcttggtttcatccacgccaggcccctgatcgcgcacgtgaatggccagccactgagattccaccttcaggctcacctcaatccgctgccccggaagcgagaagcgcaacgcattgcgcaacacattctcaatgccacgacgacacagttcagcattgccgcgcacggtatgatcggcctgaccgtcaacgtcaaacgtcacctcaacaccgggaatctgcgcttcataacgcagatctgtcacgaccgcctctaacaatcccgccagatcaaaatagtgatcacccggcatactttcatgctccgcacgcgctagggtcaacagctcgccgatcatcttatcgagccgttgtgcctcttcgtcaatgcgatccagcgaagcattcacgttttccggccgttgccgtgccaggccggttgccagttgcaggcgggcaagcggggaacggagttcatgggagatatcatgaagcagagcttcacgcgccttcaccagcgtatccagccgctccaccatggcatcaaaggcctgtgccacgctggacagctcatcgtgacgtttacgcaacgccgggtaaagccggacgcgcaaatcaccatttgccacccgggaaaatccttcacgcagctgtcgcatcggccgggtcaggttccaggcgagaagcaaactgaacagcagccccaccgagccagcaaagataaacatcggctcgggaatattcaggaaactgtgcggccgcccttcccgactccgttcacgcatgcctctgagatcgtacaggagctcataatccttgccatcggctccttgcacctggcgcaccaactggtcgggaaatagtgatttgtcgggtgtttcggaaacggaggggattgcgctggcgtcagactgaagatcatcaacgggattgatgctgagaaattgccgttcttcaggcgtccattccgctgtcattaccgcaagtgcggcgggcccttcacgttccaacacagatgacgctgacgccattatcacgtcagccagacgctgtgttaccaggagttcaggtggatggtgtcgggtaccggaaagcgaaaaccccaaccagataagctggctgataatgacaaacaccagccagaagcccagcaggatcttccagaacatgcgtccgcgatagctgtgattcatcgaatgcgatagccaatgctgcggacggtttcaatcgtaatgctctccgccgtcagcgcactgagtttctgacggatattactgatgtgcacgtccacgctacgatcgtaagcctcacgcggtcgtcccagccctttttctgacagttcgtctttggtgacgacacggtcgggtgagcgcaacagcaaatcgagcaggttaaattctgaggcggtcaggtcaaaggttttgccacgccattccgtaatgcgcctggccgaattgagggttaactcgccccattgcagtgtctctttcttgtcctgcggcggcgcaagctcctcaacgcggcgcagtacggcgcgcaaacgcgcaaccagctcacggggataacagggcttgggcatatagtcatcagcgcccatctccagcccgatgacccggtcaatgttatcgcctttggcggtcagcataattaccggtaagcggctttgctgacgcacctggcgcagcacatcagtgccgctcatatcgggcagcatgatatccaggatcatggcgctaaactcaccggacagcgccccctgaaccccggccgtgccggttaaaaccagttgcgtgtcaaagccttccgtaatcagatattggcttaacatggtgcctaactctacgtcgtcatctaccagcaagattttcattgttatctctcatgtgtaactggcgctattttgacccgagtcagcgcaatgcgcagccggttttacgcgatccttacagatgcgattaagcatagtgcgaacccaggcaaataaaaaaggcttatgcacccggcggatagcacaagcctttcttaacgcgtcgatattgacgacacgctactgatagatgccggtcgaaagatagcgatcgccacggtcacagacgatagccaccaccacgcttcccggccaggctttggcaatgcgcaacgccccggcaaccgagccaccggagctgacgccacagaaaatgccctcacgacgcgccagcgcgcgcatggtttcttcggcttcctgctggcccatatcaataatctcatccaccaactcaggacgataaatgcccggcatataggcctgtggccagcggcggatgccgggaatactgctgccttcggtcggctgcaggccaatcactttcacgccggtatgatgatcttttaaaaaccgacctacgccggtaatcgtgccggtggtgcccatgctggaaacaaagtgggtcatccgctgtttcgactgctgccacagctccggcccggtggtttggtagtggccaagtggattgtcgggattattaaactgatccagtacggtgccttcaccccgggcagccatctcctgggcccgatcgcgggcgccttccattccctgttcacggctgaccagcaccagctcggcaccataggcacgcatcgcatcctgccgctcctggctcatgttatccggcatcagcagccgtagcttataacctttcattgccgcaatcatcgccagcgcaataccggtgttgccgctggtggcttcaatcagccgatcgcctggagtaatgtcaccgcgccgctccgcctgatggatcatcgaccaggcggcgcgatctttcactgaaccggcgggattattcccttccagtttaagccagacctcactgccgttgtcaggcgtcaggcgttgcaacctgatgagcggcgtattaccgatggtgtcttccagagtggtcacggtgcatttcctggcaaaacgctatccgccatcgttcaggcttcagcctgaatcattgcggtataacggtcattaaaaaggcgggacaccgtcccgccctgcgtgaaaaagaaaatatcaggcgctatgcgcaaaggcaaccgcccgtaacggcgtcgccccctgatacagtcgggcctgctgtagcccgacgaacaggcgttcgccacgcagcggtgcggtttgttcaccatcaaagaccagcgagaatggctcgctctgccatccgcttggctgcaccaccaactgccagaaatgaccgcgagggctcacctctaagacctgaacaggcaatggcgtttccaggctgctcctgcgtgaaacgtcgatttcccacggacgcaggaacagatcgaccgcgccctgatgcgctgaggtatgacctaacggccagtgatgcgcgcccacatggaactgagagccatgaacttcgccgtcaaagcggttaacctcacccaggaactccagcacgaaacgcgtggcaggatcgcgccagacctcgtccggcgtccccacctgttcaatgctgccctggctcatcaccaccacgcgatcggccacttccatcgcctcttcctgatcgtgcgtcacaaagacgctggtaaacttcaattcttcatgcagttggcgtaaccagcgacgcaactctttgcgcacctgcgcatccagcgcgccaaacggctcatccagcagcaggatttgcggttctaccgccagcgcccttgccaacgcgacgcgctgtttctgcccgccagaaagctgggccggaaaacggtttgccagatgggacagttgcaccatctccagcaggcgcatgacgcgctgcttgatctccgcactggacgggcgctcacggcgcggcaacaccgtcagaccaaaggcaatgttgtcgaataccgtcatatggcggaacagcgcatagtgctggaagacaaagcctacctgacgctcgcgcgcatgcagacggctgacatcgtggtcatgaaaacggatctgaccgctgttctgatgctccagcccggcgataatacgcagcagcgttgttttaccggaaccggacggccccagtaatgccaccatctggccagaaggaatatccagtgagatatcgttcagcaccgctgtgcgaccaaaggatttgttgatctggttaatctcaatgctcatgattgtcctccagttgcaggcgtttatgctgttgctctaaacgccattgcacaatgcttttcagaaacagcgtcacgattgccatcacggtcagtaaggccgcagcagtaaaggcgcctaccgtattgtaatcctgatgcagtaattcaacctgaagcggtaaggtataggtttcaccgcgaatagaaccggataccaccgataccgcgccgaattcaccaatggcgcgggcgtttgtcagcacaacgccatacagcatggcccagcgaatattgggcagcgtaacgcgacggaacatctgccagcccgaggcacctaacagcacggcggcttcgtcttcatgactgccctgactcagcatcaccggcaccagttcgcgcaccacaaacggacaggtaacgaagacggtgaccagcaccatgccaggccaggagaacatcacctgaatattatgggcatccagccagccgcccgccgggccattgatgccccagaacaggagatacatcaggcccgccacgacaggcgatacggcaaacggaatgtcgaacagcgttaaaagcagctggcgaccgggaaaggtaaagcgtgtcaccagccaggccagcagcgtgccgaacactaaattcaccggcacggtaatcaacgcgaccagcaccgtcagccatatggcatgcagcatatcgctgtcggtcaggttgctaaacgtcacgcccagccctttgtacaacgcttcccagaagatggagaccatcggcaccaccagcagaagcagcgatatcagtgcgccaataccaataagcagccacttactccagttaaccggctggcgatcggccgcgttgagttgcgaaatctctgccattagtggcctcccagacgacgaccaaatcggctttgtaatgtattaatcgcgaacagcaacagtagcgatgccgtcagaatcaccgaggcgatggcgctggctgccgggtagtcaaattcctgcaggcggacaaaaatcatcagcgaggtcacttcggttttccaggcgatgttgcccgcgataaagatcaccgcaccaaattcacccaggctgcgggtaaacgacagcgcagtgcccgccagaagggctggcgcgacttcaggcaacacgacccggcgaaagctctgccagggcgttgcgcccagtgtctgagcggcttcctcgtattcgggacctaactcttccagcaccggctgcacggttcgcaccacaaagggaatactggtgaacgccatcgccagcgcgataccgatccaggtataggaaatcttgatatcgaaatgggcaaaccactgcccgtaccagccgttaacggaaaacagaccggccagcgtcaagcccgccacggcggtcggcagcgcaaacggcaaatccatcagcccgtcaagcaacgtgcggcccgggaagcgatagcgcgttaaaatccatgccattaacatgccgaatacggcattaaacaatgaggccacaccggccgacagtaacgtcactttgtaggctgcgatcagttgaggattggtgaccacgtcccagtattgctgcagcgtcatctgcgacagctgcataatcagtgcgctgatgggcagcagcagcaccaggcaggtaaacagcaggctggtgccgaggctcagaccgaaaccgggcagaacgcgtttttggctggctgcaaacatgattaccgccccgccgctaacagtttatccagctcgccgccgctggcgaaatgggttttcattacgttatcccagccgccaaacgcctcttccacccgaaacaggttggtggcagggaaacgggctttttgctgcgccattaactgcggattgttcacgcggtaatagaaatccgtgatgattttctgcgcctcgggggaatacagccaggtcaaatacgcttttgccgcatcgcccgttttattctgcgcgacatttttatcaacccaggcgaccggaaactccgccaggatatcggtttttggcaccacgacttcatagtcatctttgccgtattggttgcggatgttattcacttctgactcaaaactgatcagcacatctcccaggccgcgttcggcaaaggtggttgtggcaccgcgaccaccggtatcgaacacttcaacattctttaaaaacttcgtcataaacgcgcgggttttggcctgatcgcccccgtcagcctggctggcagcgccccaggccgcaagataggtatagcgcccgttgccggaggttttgggattaggaaaaatcagcttcacatcgtcacgggttaaatcggaccagtcgtgaatctgctttgggtttcccttgcgcaccaggaacgccatggtggaataaaagggtgaactgttattcggcagacgcgtttgccagtcggccggaatcagcttgcctttatcgtgtaacacctgcacatccgtgacctggttataggtcacgacatcggcacgcagaccttgcaggatcgccagcgcctgtttagatgacccggcatgggacatcttaatggtcagcttgtcgtcaggatggctggcatcccattgactgacaaaaggcgcattcagggcgacgaataattcacgtgcaacatcgtaagagctgtttagcagctcggtcgcgtttgcggcaccggccaggctcagcgacagtgcgagtccgctcacgatttttttcatcgctggtaaggtcatggttcaccctgaagaaatttgatgcagatctcatctgccgatacagcagtttatttataactcagcgtaaacccgtaacggttttatatatcgtttgctgatttcaaagtcgaaaaaggcataaggcggtggcagaagatagcgggaaagtggcattggacgcgcagggctgagggtctgccctgcggtttagcggtacgaaaaggccttagcgctgccagacaattttgctgagcttccagctcttgagtgtgtcatccgacggcatcaacccttctggcccgtgccaggttccgctgtagacatagcgaagatgctgactgttgggcgcgcggcactccacgtcacggttgtccagcccgctcgccagcacacagttattgaaggctttgtcgaatttggcgctgaacgcgtcaccgattttgctgccatcggcgctggcaatgtggctgtccagcacttcaatgcggtcaacctgcgactggccataaaccaccagcattactttgccgtcatccatggcctgccagaacgacaccacctgaccattatgaccgcgcatgccctggcgcagatcgtacttgcctttcagcccctcttttatggcggcttcggtcatggcggtggagccattaatgccacccacgccctgctctgtggccgtcagcgaggacccaaaccagttccagggcagcgccgatgaccagtggtagctcagtggattccaccagcttacctgctggctgctgttagcgtcagtaccggaggaactggcacacccactgaccagtatggccgcagtcagtaacgtgtaacgaacagctttcatgaaaactcctgtgaataaaagaacaataaaggacaataaggcagaactgattggagtcgcaaagcggcaaaaagtttattcgggatactgttgcggtacaaagcaggcgcgaagccggatgctgctgaataaccacagcagcgccagcagatcgaacagcgtcaataacaaggggagcggcgagctgagaaaatcagccagatacagttgagcgccttgccagagcaggttaatcgccatagcgagcattaagacctggcgccagctgcgccacagtcttggcagacgcgaacggtagccggtcaacagcaggccaaacagcgccggtaagcccagcgccaggcctgaccagaaggcctggcggtcaggataaaagagcgccagaagatcgttcccctgctggcgtgacgcgccggccataatcaacagcaaccaggtccgtgactgtagcagcagaatcagccagaaaagaaacggcaggcgcaactggcctttatcatcgtactcttccggtggccagacagaattaatattcacgatcttcgattaaacgtttgcccagtaacaccacatcgaccgtttcgtagtcgagcttttcatagaatgcgaccacctgatcgttctcttcacgcaccatcaaatggatttttggacagccgcgtgcaatcagttttttctcaaggcggttcatcaaggcattggcaaaaccgcgtccctgatagtcaggatgcacagcaaggtaataggccgcgccgcgatgaccgtcgtagccacccatcaccgtgccgacgacttcaccgcccacttctgccaccaggaaaagatcggcgtcgtgatgcattttgcgttcgatatccagctcgggatcgttccacggccgtaacaaatcgcagcgctcccagagcgtgattacttcttcaaagtcttcctggcggaaggtgcggatttccatcttctttacctgctattcaccacaatttgctgattatcacgctttcttcggctggcgcaaccctccctaccgggggcaacgttaaaaaaaagggatttggctgttagtgagctgaaatacaaagtaataacctgaaatggttgaaagatcgccgtggcgctaacgttacgctataacactttgcataattgttgcttatggacctgcacatgcatttgcttaaacgtttaattcaccgccgccagcttctgctgtcaggacttgcactggccgtgttgtctccgcgcgccgtacaggcaaaagaacagcaggcttctctctcttcccgtcacacctcgccaaagccgccagccagtaacggtaaacgcattgtcatgatcgaccctggccacggcgggattgattcgggtgcggtgggcgaagaaggcgcggaagagaagcatattgtcttagaaatcgccaacaacgtccgccgtgagctacagtcacatccgcgcattgaggtgcgcctgacgcgcgacagcgatcactttattcccctttatcagcgcgtggaaattgcccatcagcatggcgcgaatctgtttatgtccatccatgcagatggctataccagcccggatgccaacggtgcctcggtcttcgccctgtccaaccgcggtgccagcagtagcatggcgcgctatctgtcaaacagagagaacgatgccgacaaggtcggtggcgcaaaggtggaagcgcaggatcactatctgcagcagatcctgtttgacctggtgcaaacggacaccatcaaaaacagcctgacgctgggcaaacacgtgctggatcagatccgtcccgtgcatcaccttcacagtcagcacacggaacaggccgcgtttgccgtattaaaatccccgtcgattccctcggtgctggtggaaacctcgtttatcactaacccgcgggaagagcagttactgggcaccagcgcattccgtcaaaaaattgcatcggctatcgccaccggaataatcaattactttgatgagtacgatcgccgaatgtcgtaatgaataagctataatcacgtccaatttttaccaagagaagcccatcacatgcctgatatctcccgtgtaaaaacgttcctgttggatctgcaggatgagatttgtagcaagctgaccgccgaagacggcggtgcacagtttattgaagacagctggcagcgccccggcggcggcggcggacgaagccgcgtgctgcgtgatggcgcggtctttgaacaggccggcgtcaacttttcgcacgttcatggcgaccagatgcccgcgtccgctaccgcgcatcgccctgaactggccggatgcagttttgaagccatgggcgtttcgctggtcattcatcctcataatccgtatgtgccgaccagtcatgccaacgtgcgtttctttattgccgaaaaacctggcgctgaacctatttggtggtttggcggtggcttcgatatgacgccgttttacggtttcgaagaggatgcactgcactggcaccagacggcattcgatatttgtcagccctttggcgaagatgtctatccgcgctttaaaaagtggtgcgatgactatttctatctgaaacaccgcgacgagcagcgcggcatcggtgggttgttctttgatgatatccaccagcccggctttgaaaacagctttgcgttgattcaggcggtgggccggggcttcctggacgcttatcagccaatcgtcgcgcgccgcaaacacgtgccttttggcgagcgggaacgtcagtttcagctctatcgccgtggtcgctatgtggagtttaatctggtgtgggaccgtggcacgctgtttggtctgcaaaccggaggcagaacggagtctatcctgatgtccctgccgccgctggtacgctgggaatataactatcatcctgagcctgactcgccggaagcggcgctctaccgtgattttctgccggtaaagaactggcttaacctgccggcatgaagtctgtccgcctgccccgcatgacaggcaggcaaaccagccctctgcggggcgaaggttaacacggggccgcatcgttgaatgcggccccgtttcattatagcggctgggtttgcgcttccaccacggccagcgccaccatattaacgatgcgccgcacggaggcgatacgggtaaggacgtgcacgggcttcgtcattcccatcagcaccggccccaccgttacgccttcagaactggagacgcgcaacaggttatagctgattcgcgctgcctccacattgggcatgatcaacaggttggcactgccttttagcgggctgtcgggcatgatttcccgacgaatactttccaccagcgccgcatcaccgtgcatctcgccgtcaatttccagctcaggtgcccgctgctgcaccagcgccagtacgtcacgcattttacgtgcgccgggtgcatttgaggtgccaaagctggagtgcgacaacagcgccacgcgcggttcaatcccaaatcgccgcacggtttcggccgccatcagggtgatgtctgcgagctgctcgggcgtgggatcttcattcacataggtgtcagcaataaaggtgttgccgtttggcagcagcaacgcgttcatggctcccgcgactttcacatcggaacgcaggcccagcactttttccacaatctcgtagtgctcgttgtaatccccaatggtgccgcagatgagcgcgtccgcttcaccgcgatagaccatgatggcaccaatcagcgtcggattaccgatcaccgcgcgctgcgcctgctcaggcgttacgccgcgccgcttcatcatctggtaatactcattccagtatgctttgaaacgcggatcggattcattattgacgatttcaaaatccttcccggcttcgattttcagcccctgcttctccagccgcatggcaatcacgttcgggcggcctatcagaatgggttttgccagccccagcgacacgagttcctgcgtcgcatgcagcacccgcacctcttccccttcggccagcaccacacgtttcggcgctttacgggcctgagagaaaatcggcttcataaacagattggttttataaacaaattccgtgagctgttcgcggtaggcgtaaaagtcgctaatcggccgggttgccacgccggaatccatcgccgctttcgccacggcgggagcaatctgcacgattaaacgaggatcgaaaggtttaggaatcagatagtccggcccaaaactcaggtcctgatcgctataggccgatgccaccacatcgctctgttctgcctgcgccagatcggcgatagcgtgaaccgcggccagcttcatcgcttcattgatggcggtcgcgccaacatccagcgcaccgcggaagataaacggaaagcacaggacgttattcacctgattaggaaagtcagaacggccggtacagataatcgcatcaggccgcacggctttggctaacggcggcaggatttctggctgcggattcgccagcgccagaatcagggggtcctttgccatggttttcaccatctcaggcgtgagcacgtccgggccggagcagccaaggaaaatatccgcgccctcaatcacctccgccagcgtacgtttgccctgatcctcaaccgcatagtcagccttggtctcggccatgttgggttcgcgcccgcgataaatcaggcctttggaatcgcacacctgaatattgtgtttctgtaagcccaaggcgaccagcaggttcatacaggcaatcgccgatgcgcccgcgccggacaccaccaaccgcacgtctgagatcgcttttttgataatgcgcagcccgtttaacaccgccgccgtacagataatcgccgtaccgtgctgatcgtcgtgaaacacggggattttcatccgttgccgcagctgctgctcaatgtaaaaacattccggcgctttaatatcttcaagattgatgccgccaaaggtcggctccagcgccgcgataatctcaatcagcttgtccgggtcatgctcatcgacctcaatatcaaagacgtcaatgccggcaaacttcttgaataatacacctttgccttccatcaccggtttaccggccagcgccccgatgttccccaggcccagcaccgccgtgccgttagaaatgaccgccaccagattgccgcgcgcggtgtatttatgggcggccagcggatcggcggcaatttctaaacagggtgcggcaacgccgggtgaataggccagggccagatcgcgctgcgtcgccagcggcttggtcggcgacacctgaatcttgccgggagtgggatactggtgaaaatcaagcgcactttgcttcagttggtcatccatttgacgtccttcttcgccaggtgagtgagcgcccagtatagaaagcagaccaccacaaagcggtgaggcgcttcaaagaacctcatttcttagggcacagattgttacagtctggcctgcgtcatttgtcatggctgctattcttaatagccgggcagtcgttatccgcagaaatgctctctcgggtggtgacgcgctaccctcatcgcacaacattcagagaaaacgcattttcactgcaccccgtctgttgcaatgtggtgagtcggcgttactgcgacccgtaatgtctgcacggattagggcacgaggccagaggtgttccctttcgttacaatgtattttcaaggagtgtagaaatgaaccagcttgaagcccttaaacagttcaccaccgtggtggctgacagtggcgatattgaatcgattcgaaattatcacccacaagatgcgaccaccaatccctcgcttattctgaaagcatctgctctccagccttacaaacatctgattgatgacgccatcgactatgcgaaaaaacagggcggcagcaaagagacgcagatcatcaacgccagcgacaaagtggctattaacctcggtatggaaattctgaaaagcataccgggccgtgtttcgaccgaagtggatgcgcgcctctccttcgatcgtggcatgtgcgtcacgaaagctgaaaagctggttcgcatgtatgaagagcacggtattgaccgctcacgtattctgatcaaactggcgtcaacgtgggaaggcatcaaggcagcggaagaactggaaaaaaatggtatccagtgcaacctgacgttgctgttctcgtttgcgcaggcgcgcgcctgcgccgaagccggtgtttacctgatttcaccgtttgtcggtcgtatctatgactggtacaactcacgcaaaccgatggacccgtacagcgctgatgaagatcctggcgtgaaatccgtgcgccgtatttacgattactacaagaagcaccgttatgacaccatcatcatgggtgccagcttccgtaaagttgaacaggtacttgcgctggccggttgtgaccgcctgacgctttcaccgaatctgctggaagagctgcaaaacagtgatgagccaattgaacgtaagctggagccgtcaaccgagtgtttccatcagccgtcgccgctgtctgaagctgaattccgttgggagcataatcaggaccccatggcggtagaaaaactggcagacggtatccgtcagttcgccgttgaccagcaaaaactcgaagatgtgctggcggcacgcctctagttttcccctcttttaccgggcgggagcactcccgccctgatgcttaacaagggagaccctttatgtcctcacgcagagagttggctaatgccattcgcgcattaagtatggatgcggtacaaaaagcaaaatctggtcaccctggtgcgccaatgggcatggcagatatcgccgaagtattatggcgtgatttcctccagcacaatccaactaatcccgcctggctggatcgcgaccgctttatcctttcgaacggccacggctccatgctgctttacagcctgttgcacctgagcggttacgatctgcctatcgaagaactgaaaaacttccgccagctgcattccaaaacgccggggcacccggaaattggctacacgccgggcgttgaaaccaccaccggcccactgggccagggcctggcgaatgccgtcggtctggcgattgctgaacgtacgctggcggcccagtttaaccgtcccaatcacgatatcgtcgaccactttacctatgtgttcatgggcgacggctgcctgatggaaggtatttcccatgaagtctgctcgctggccggtacgttaggtctgggtaaactgattggcttctacgatcacaacggtatttctatcgatggcgaaaccgaaggctggtttactgacgatacgcacaaacgcttcgaagcctataactggcatgtggtgggtgagattgacggccatgacgccgatgccgtgaaagcggccatccaggaagcgcagagcgtcaccgataaaccgtcactgatcatctgccgtacggtcattggcttcggctcaccgaataaagccggtaaagaagaagcccacggcgctgcgttaggcgaagaagaagtggcgctgacccgtaagcaactgggctggaactatccggcgtttgagatccccaaagagatttaccagcagtgggatgccaaacaggcaggcgctgagcgcgaaaaagcctggaacaacaaactggctgcctataagcaggcttatccagagctggccgcagaatacgagcgccgcatgaacggtggaatgccggcaaactgggaagcggaaaccgcgaagtttgttgccgagctgcaggcgaatccgcaaaagattgccagccgtaaagcctcgcagaacgcactggaggcttatggcaaactgctgcccgagtttctgggcggttccgccgaccttgcgccgagtaacctcaccatctggtcaggctcaaaatccattaaagacgatccggccgggaactatatccattatggtgtccgcgaattcggcatgacggcgatcggtaacgggattgcccatcacggcggctttgtgccttataccgcaaccttcctgatgttcgttgagtacgcccgtaacgcggtccgtatggcggcactcatgaaggctcgccagattatggtgtatacccacgattccattggcctgggcgaagacggtccgacccaccagccggttgagcaaattgccagcctgcgcgtgacgccaaatatgagcgtatggcgtccctgtgaccaggtagagacagccgtggcctggcaggcggcgattgaacgtcatcacggcccgactgcgctgatcctgtcgcgtcagaacctggcacagcctgagcgtactccagagcaggtggctaacatcaagcgcgggggttatgtgctgaaggattgcgatggcacgccagacatcatccttattgccaccgggtccgaaatggaaattaccctgggtgcggcggcgaagctgacgaccggcggtcataaggtccgggtggtttcgctgccatcaactgacctgtttgacgcacaggatgcggcttaccgtgagtcggtactgccttccaccgtgaaagcgcgcgtcgcggtagaagcgggcattgcagactactggtacaagtacgtcggactggacggtgccatcgtgggcatgaccaccttcggtgagtcggctccggcggaaaaactctttgctgaatttggctttacggtggaaaacatcgtcagccatgctgaagccctgctgaaaccggcgtaatccctacccgcctgagcgtcctgccgctatccggcaaggtcgctcgttcagcgtaccaccgcgcgccagccctgtgctggcgcgcggctttctgaaatccgcttcctgtcgcagatcgcctcccgccaggtcttcgttatccgtcctgaacaggctatccagtgagcatggcatcccgcgcgttatcacacgtattttcctgctcgacagccggccgttgccgccctgctttacgctcccttcagtgggaaccccagcggaacagaagaggaaaacgcgcgtatgggttgcgatgacgttaagtggcgcgggttgtgccactcgctattgccgagcgatgacgtgggtttaccctgattgaatcctgtttccctctgtgaatatcagccaggccaacgcttttatcaggacgccaggtcagactgccgtttacgcagcctgacctggcgttatttatggaacaggtttatttcaaaaaatggctcagcaataacaacgaaagcgaaacgttaatggccccgccgatgcgcgtggcgatctgcgcaaacggcatcaggcccatgcgattaccggccgtcagaatggccacatcgccggtgccgccctgaccactctggcagcaggagacaatcgcgacatcaatcggatgcataccaatctttttgccgacgaaaaagcccgtggcgaccagcgcgctgaccgtgctgataatcaccagcaggttggtgagcgtaaacgcggtgaccagaatatgccagggcgtaatggcgacaccgacggcaaacagcaccggataggtgacagcagtgcgaaagaaccggtaaacgacctgagaacccgccagaatacggggagaaacgccattgaccagcttcaccagcacagccagaaacagcatcccaaccggcgcaggcagaccggtaaatttctgacccaacatgcccaccatatacagcaacaccgcaagcagcgccccggaagcaatcgcggtgacgtcaactttccccgaaaaaacggattgcagcggctcaggttcaacattggcgatgttcggcatcaactggccttcccccgtcaggtgcggataacgtttccccagttggttcaggcagcccgagataataatggcggttacgccacccaacatgaccatgggcagaatacggcccagcgcgacgccctgatccatatgcagtaacgccgcatagccaatggagagcggaatcgcgccttcaccgacaccacccgccataatcggcagaataataaaaaagaagatctggaaaggttccaaccccagcgccagcccgacgcccatgccaacaatcatgcccaccacttctccgcacaacatagggaaaaagatgcgcagaaagccctggataagcaccgtgcggttcatgctcataatgctgccgacgataatgcagcagatgtagagataaagaatattggtcgatttatagaattgcgtcgtggacgtcaccacgatgtcgggaagcaaaccgtagtaaaccaacgcagaggggataaaggtggcgcaaatcgcggcggcccccagcctgccgaccacgggcagacgtttaccaaactccccacaggcaaaaccaaaaaaagccagcgtggcgaccatgaccacgatatcgcttttcagcgtcccactcaggcagtctaccgcgataagcaagcccgccagtacgaagagcggcagaggaataatcccgactttccagttatccataatatgccaccactgatctttcagggttttacggcgcgatgtactggacagtttctcagacaagaaagaatcatcaggtgtgctcattattatcctctttgcatcattatttttttcaggatgccgttaaaagaggatgaattacgtgaaggggaaggtgtctggcataaagttttaatggtcttttttaaattgagtgatcgtcgtcctggttcgcgccgtggtttttatggtttttattgcggttccgtctgctttcccacgttaaggggcgtcaacgcggcccaaaaaacagtcagcgttttttttatgctgcttatcatgcggttatactgggttggcccatattgttaaaaagatgatacagtaatgttattaattcaaagcacgtgtaatcgtcatgaaattgtcatttcaaacgaagctgtttctttcgctcgttgtttttacgtctgccctgttcgtgctactgggtagctattattacgtcagcatcaaccaacagatctaccaggcgatgagcatgcgtgccaaagttcaggccgaggagattgcgcagatacctgaccttaaaaaagagatagcggaccacaacattcaggccattcagtcattgatgcagacgattgccagcaagagcgatgccagttttatcgttattggtgaccaccagggcctgcatctttttcattccgtgagtgaagataaagtcggcaagccgttagtcggcggggacaacgctgcggtactctcgggccaaagtatcaccaccatccggactggcggtctggggatttcgctgcgaagcaaagcaccgattgttaacgctcaaggccaggtcattggcattgtctccgtgggttatctcacccgctatcttgaggcgattaccttcagcaatatggtcaatattctgatcgtggctgccctgctgcttattgccctgttcatcttctcctggttttttacctgcaatattaaaaagcagatttgctcgctggaaccgcgtgagattggcctgatggtgcgtcagcaaaaagcgatgatggagtccatctatgaaggggttatcgtcattgatgaacatctgcgaatcgaagtgatcaaccaggcggcgcgaaaactgcttggactggcgcagtccgccgaacaactgcgtgggcaatctgtcagccaggtgatctcacccgttccatttttgtcgcagccggtcatgctggaaaaagatacccatgatgagattagccgcttcaattcgctgaccgttatcgccagccgggtccgtatcatgctggaatcgtccctgatgggatgggtgatatcctttcgcgacctcaatgatatcgactcactcagcgcccaactcagccaggtaaaacgttacgtcgataatctgcgcattatgcgtcatgaacagcttaaccgcatgaacaccctttctggcctgttgcacatgggccgctttgaagaggcaatcgattatattgaggcacagtcagagcacgaacaggagctgctggactttgtctccacccgcttccagtcgcccttgctctgcggtttactgctgggcaaagcggtacgtgcccgcgagaaaggcgtagatatccactttgatcccgcgtgtctgatggatcgcccctttcttccgctcacggatgctgaactgatctcggtgactggcaatcttctggacaatgccattgaagccacccaacgcgcgccactgccgcacgatcctgtcgaagtgctgattaagctcaacgcgcgtgaactgatcattgaagtcgccgatcgcggtgtgggcatccgtcctgaaatccgtgagcatatgttcgaacgcggggtgacgaccaaaacccgaggcgatcacggcatcgggctgtatttaatcgaaagctatattgcccgcaccggcggaacgattgaggtgagcgataacctgccgcgcggtgctattttctcgctgtttattccctgtgtggaaataaatcagtatcccaccacggaaacggagaaggtcagcaatgcaacatgatcctattgatgtcctgatcgttgaggatgagcatgaactggctcaacttcatgcagaactgattaacaaccatcctcagctgcggctggttggaatagcgcactcgctgtcagaggcgaagcagcagcttgaaacaagattgccgcagcttgtgctgctggacaattatctgccggatggcaaaggcatcacgctgattggcgatcctctcctggcaaacgctaactgttccattatttttattacggccgccagcgatatggatacctgtagccaggccattcgtaatggggcctttgattacgtccttaaaccagtctcatggaagcggcttaaccgttcgcttgccaattttatcgcctttgcggaacagcaacgcacatggaaaatcgtcgatcagaagaatgtggacgtgctgtatcagttacaggcaaaaaactatccgcacgacaacggcagcaaaggcattgaagaaaataccttagcacgggtacaaacgctttttgcggcagccacgacgcgtcttttttcggtggatgatgtgatggccgagaccggagtgagtaagacgaccgcccgccgctatctggagcactgcgttgaaacagggtttctgacggtggaaatgctgtatggcaaggtaggacatcccagacgaatgtataaacgcgtatgatgttatcccgggattgacgctgtcggcgctaagcggcccaggcatcacggcacaagggaaacctgtccgacaggtgatcgccacattgggccaggatgcgctatcagcccggcagcgtgctgtaatccgaaacaaaaaaaactgcccttccctcttcccgtcattcgcaaacgcattactataggctttctcccgatttctatagcgaagccgtccccgttgaaaatgcgcactccttatttactggccttaatggtttctttgcttccccttaaaagcatggcgcaggttgcgcccgatccgttgctggcatcgcaaattgtcgatcgctatgccgagcacatcttctatgccagcggtgccaccggtatggcattggtcgcgatagacggtaatcagcgggttttcgccagttttggtgatacgcggccgggcagcaatattcgtccgcaaaaagattcattgattcgcatcgcctcactcagcaagctgatgaccagtgaagtgatggtgaagatggccgagcgcggtgagatccgtcttgacgatcccctgagtaaatatgcaccgcccggaaaacgggttcccagttttgacggtcagcccattcgcttgattaacctgtcgacccataccagcggcctgccgcgtgaacagcccggcggcaaaccgcatcgtccggtgttcgtgtggcccacgcagagtgaacgctggagctggttaaacaaggccaacctcaaagccgcgccaggcaccaacgcggcctattccaaccttggttatgatctgctcggtgatgcgctgtcacgtgcagcaggtaaaccttatccggcactgctacagcagttgattacccgcccgctgggcatgaaagacaccacctttacgccgtcacctgaacagtgcgcccgtctgatggtcgcggaaaaaggggccagcccctgtaacaacacactggcagcgattggcagcggcggcgtctattcgacacctgatgatatggggcgctggatgcagcagttcctgaactcatcggtgaatcatcgtacgccgcaaatcgaccgcctgcagaccttgatctaccgtcgcgaccagctacataaagtcgatggcatggatgtgccgggcaaagccgacgcgctgggcatgggatgggtttatatgggcccggcaaacggtcgtcctggcattatccagaaaaccggtggtggcggtggttttatcacctatatcgcgatgattccgcagcaaaacgttggggttttcgtggtcgtcactcgttcgccactgacgcgttttaccccgatgagcgacggcgtcaacaacctgctcgcggagctggtgggcaatcagaacggctcaccaatgatggtgcaggcgattccttaaccgcggctatccgccgtgactgactggctcacccagagcgtgggccagtcgtcactgctgtgccaggcatcgcaggtcgactcctgcgcgtattcggctaaaacaaagcgctcgccatcaaactgccaacgggtggccgtgccgcagtcgcccaatccacgtcccttgccaaaggtatagagctgcccggttgccgcatcataatccgcattaatcagctcaagctggcgatctgtgtcacccggcggcgtaaaaggcagagtcagggtcagaccgcgcgccacgtagggcggcgcacgcgtcacttcaaaggccagatcgataacgttgtacgcgcccatctcacagctcaccagcagcagcgcttttttatcggtcaggggagatacgctcacttcccggcgcagcggatcgagcgaacagctgtccgaattcacgcgccaggtgccgtaatcgataaggccactggtctcttcacgcgtcagtggcgcaggcgcagccacggcaggctgcagctgtggcaccgcaggggcggccggcacgctgtttcgttccccgcgcctgacccaggcactgatgtcattaacccgtccctgcacgtcatccatatataacagcgccgccttcataccgcgcaacgaaatctgcggaccggcattgaacgtcagctgcaggcttttggcatccatggtcagttcaaggaactcattaatagcgatgggattactggtggcaagatggtgcggttcgaccgtccagtgcttgaaatcgggccggagtcggcgttgatcgactaacagattatcttttagtgccgggccgggaagcgctccgctgtaggcgctgccgtaatcgatgcgcagtaaaggctggtcatccgttcccgcgtggcgggaaagggtcatcaccaggcctttgtcgccaggtatgcttcgcgcaacgcaatgcgctgcattattgcaggttaattgccagtcagaaaacagcttctgtaccggctcagcctgaacagctgcaaccataaaaaaaggcaacgcaaacagcgatttcatcccataccacattaagaaaaaccagccccaacttctttgagtggaagatgatagcgcaatcgcgcacgtcacgaaggccgcattctgtgaagtgctcagcaagcgcagctaaccgtctaaaaaacatccgctttatgacaagagaagtgcaataaagtctgcagaatatttatcatgctgattcaccccgcgccgctcaatcggattcgtcggacattcccgccagcgcaatcggtcaaatacacataaacggtcaaaaacaggcatgatatagtcgtcacaagattaaacataaaaggttatcaacagattcttctcaggttaaaaagccctttaaaggtgatcagcatcactttttaataataaagattacatcccgtttcataaaaacccaacaaatatctctttatgtgcgccgtgaaaatagcgtcctgcgtacccacgctcaggccacatttttgccgcgcgccttccagtactttataaccctcggaggccagcatgttgccgattgaacgccagcagagaattattgatgaattaatgcgtaatggacgtgtcattgtcgcggaacttaccgcattgtgtcaggtttcgcaggaaacgattcgtcgggacttagcgcaactggaaaagaaaggcatattacagcgaagtcatggcggtgcagtcccggttaaacaatataatgcggccatacaaataaataatcgtggcattaatgaatatgaattatcttttcgccagcgaattaatgaacatgtcgatgccaaaatggccattgctaaacgggcactgggatttattagcgtgggtgactgtgtattactcgacagcagtaccacctgtttttatctggcccgacagttacccgatatagaattaacggtattaaccaattctctgcgcattgtgcagacgctggcggcgcgcagcagtattcgcacgatttgcctgggcggagaatattccgatcgctatgaagattttcacggcatcgtgactgaacaacccttaaaagagtttcaaataaataaaatctttttttcctgtagcagtctgggcaatgacggttatttacgcgaagggaatgaacgtaatgcacatttaaaacaacagctcattctggcagcagaacgaaaacatttattaatggacagctctaagtttcttcggccctcattcgcgcgtgtttgccattaccgtgatgtggattttctcatcactgaccaattaaaagataaagaactggaacaggaactggcgtggaacggggtaaatattatcgactgttcgcaacgccctcagtccgtacagcttatgaataattaaatggagtcgctatgaaaaaacagcttatcgcctgcaccctgatcgcgttatttgcattccaggcccaggcagcagaaaaaatacgtatggggatcgtggtgaaaattggcggcattccgtggtttaacgccatggaggccgggataaaaagtgaagcggcgaaaagtgggatcgatgcgtggatggtcgggcccaccgcagccgaccccgccttacaggtgcgggccattgaggatttgattgcgcagaaagtggacatcattggcgtggtgccgaacgatcccaaggtgctggaacccgttttacagcgcgcccgtgatgcgggcatcaaagtgattacccacgagtcgccgggccagaagtttgccaactgggactttgagttggtggatgcaactacccatggcatcaaccatatgaaagcgctggcagcctgtatgcacgatgaaggccaatacgcgatgtacgttggcagcctgacggtgccgctccaccagcagtggaccgacgccgcgctggaatatcaaaagcagcattacccaaaaatgcaattagtcactgacaaatttggcgtgggggaatcgctggatgattccatccgcacaaccaatgagctgatgtccaggtatccggatctcaaagggattctggcctttggttctcagggccctatcggcgcaggccgggcggtgatgaaccgcaacaagagtaaccaggtctgcgtcattggctcattcagtccgggccagggcgcgcagctcgtcaaccggggtgccattaaaggtggttatatctggaatccgcataccgccggagaagtgtttgtccgtcttgccgagatgatggagaagaacacgccaattaaagatggcatgaccattgaaggattaggcaaggtgcgggtggatgaaaccacgcacaccattctgggcaacaacaccgaaagcctggataaagccaacctgccgaaactgattaagctggggctgtagtgatggaacctgtcgcaccacaaacgctcgtcaccctgaacaggttgtcgaaaacctttggcggtcatcgcgcactgagcgatatgtcgctgacgctgctggccggtgaagtgcactgccttgccgggacgaatggctgtggcaaaagcacgctgatcaaggtgatgtccggcgtacatgcgccggacagcggcagcgagatccgcctgggcgacggggaaattgtgcctcgcctctcgacacagcaggccagagactttggcatacaggtgatctatcaggacctgtccctgttccccaacctgagcgtggctgaaaatatcgcgtttgaacacaacctgcgtggcctgttcggctggcaccagcgtaaaacgctgtttgacagcgcccggcgcgttgtcgaggagctgcaattcacgctcgatcttaacgaaaaagtggcgcatctctctatcgcccagcggcaacaggtagctatctgtcgtgccctggttgccgatgcccggctggtgatcatggatgaacccaccgcctcacttacccgcacggaagtgaatcagctgttgcgcacggtgcgctatctcaagcagaaaaacatctgtgtggtgtttgtcagccatcgtctggatgaagtgctggagatctcggatcgggtcacggtcattcgcgatggtcgcaagattggcagctttccagcgcaggagatgacgccgcaccgcctgacggagctgatgaccggacagaagctggaatatccgttaaaaaatccaacgcgcaagcgcgatcgggtgctgctggaggtggaggatctcagccgtaacggacagtaccacgacgtgaattttcgtttgtatgaaggcgaagtgctggggctctgtggcctgctgggttcaggccgtaccgagctggccctgtcgctgtttggtatgacccggcctgacagcggcaagatctggctggacacgaaaccggtgcgctttcgcagccatgaagacgcgatcaaagccggtattggctatgtgtcagaggaccgcctgacgctggggctggttcagcaacagtcggtggccgataacatggttttacccattctcgacaaactgcaaaaccgctttcacctgattgatgaataccgcaagaacaggctgatcctgcagtggattcagcagctgggcgtccgggttgccgaccccgagcaggcgatcgccacgctttccggcggcaatcagcaaaagatcgttttagccaagtgggtgctcactcagcctcgtctgttaattcttgattcgcccactgtcggtgtggatgtcggggcgaaagccagtatttaccagttgatccacgagctggcgcgtgaaggcttgtcgattatgttgatttccgacgaggtccctgaggtctggcacaactgtgaccgcattttgcatttccgcgacggcacgatccatgccgaataccagcccgacagcgttgagcaacagcaacttgcagaggtgatcaatgcctgacttatcccgcttacgtcctcactccagtcagggctggctgacctgggttttactgctgtttattgtggttttctcactgaccagcgaccagttcctcagcgtgcaaaacctgctggatttagccgaaagctatgcggtaaccggcatctttgcgctggggctgtttgtggtgctggtcaccggcggcatcgatatctcctttgctgccgtcgcctcggtggtgcagtactttatcgccgccctgtttgtgcactatcagtttgataacgcactgctgagcattatcctggccattgcctgcggcaccctgttcggggtgatcaatgcctggctcatcacctggctgcgggtcgtttccatcattatcaccatcagtatgcagtcgctgttgtttggcctgctgatgtggttaaccggcggacgcagcctctatcagttacccgactggtggatcaccttacgcaacgtgctgccgtttacgtggcaaggccagacgtttcagcttggcctgccgctgctcatcctgctgatcatcgccaccctgaccgccgtgttactcaacaaaacccacttaggccgccagctttatgccgttggcggtgacgcagagtcggctcggcgcatcgggattcgcgtcggcctgatccacctgtttgcctatggctggttgggtgcgatggcagcgattggcgggttggtacaggtttaccgcatgggtgaagtggtgccgaacgcgctggtgggcggtgaactggatgtgctggctgccaccgtgctgggtggtgccagcctgatggggggaaaaggcacggtcagcggcaccttaatgggggttttcctgatcgccattttgaagaacggtctcaacctgcttggtgtctccaactacttcatgaacatcgtggtcggcggggtcatcatgatcgccatcgccgttactcactataaaaaacgcaaagagactgacgtcagctttgtctgatgggagaacccctatgaaacctttattggcgttaaaacctgacggcaccaataccggcctgctgctgctcatcgcgtttgcactggcgctgttcagcatcctgttgcccggtcgtttctttaccgattccacctttctcagcatggcctttcaactgcctgagctgggcttgcttactctggcgatgtttattgccattctgagcgggggattaaacctggccattattacgaccgccaacctgaccagcttattcatcgcctgggtgctactgagcatgttgccggacggcgcgggaaccggccagcaagtgggctggttactgctggcgatgctgggcgcgatggtcattgcggcactcatcggtctgattaccggcgtgatggtcacgcgcatcggcgcgcatcctattctggtgacgctcgcgaccatgatcacgctcaacggcatcggcatctggctgacaaaaggggcggcggtgagcggcatgccgccggtcgtgcgcgccctgggctccgatacgttgctgggtgttccgctgccgctgtgggtatttttactggccgccgccctactggcgctgttcctgggaaaaacccgcgccggtaaatgcatctatatgggcggcagtaacatcaatgccacctggtttagcggtatcaacacacaccgcatgatcatccttgtctatgtcatctccagcctgctgtgtgtgctggcggggctggtaatgatggcgcgctttaactccgcgcgcatgggttatggcgatgcctatctgctactgaccgtgctggccattattcttggcggcaccgatcccaacggcggctttggccgcgttaccggtgtcgttctggcgctgattgcactgcagatcctctccaccggcttcaacctgatgaatatcagccagcacgtgagcctggcgatgtggggcgcggtactgattgtggtgctcgccgtgaaacagggcaaagcccgactgaatgcacgccgtgacgtgaagcgcagcaagcgcctgagcgcggcactgaatcctctgactgagaaaaaggaagtatgatgcgtattcaaatctccccatcattgatgtgtatgaacctgatggagatcaaacagcagttggctgtgctgaactcccgcgccgacttcctgcatgtcgatatcatggacggtcactacgttaaaaatatcaccctctcgccgttctttatcgagcaaatccgtccgcatacgccggtggctatcgatgtgcatttgatggttgagcagcctactgattttattgaagcggtggccaaagcgggggctgactttatttgcccgcacgcagagacgatcaaccgtgatgccttccgggtcatcaaccagatccgcagcctggggaaaaaaccgggcgtggtattaaaccctgccacgccggtgtcctttattcaccactatattcatctgctggagaagatcacggtgatgacggtggacccgggttatgccgggcagccgtttattccggaaatggtcgagaagattcagacactcaaggcgttaaaacaggctcacgggtaccgttatctgattgagattgatggttcctgtaatcagcgcacttaccgcaccctgctggaggccggggcggaagtgctgattgtgggcacctcgggtctgttcaatatacatgaggatctcaccaccgcctggacgatgatgcgcagcagtattgatgcggcgcaggaactggtgcaggagtcggcatgaaacgacgctggcttggcattgacattggcggtaccagtacgcgcctgcagttgatggaagaaggccggaactggtgtggctttcgtaaagtgccgaccgccagctggtcacaacaaccggatgcgctgaccgcgctgggcgatgtgatcggcgaaactctggagacacagccggtaaacggcgtgatgctcggcttgcccggtattctcagccgtgaccgtcagcaggtgatctctttgccctttattcaggcgctggatcagcaacccgtggtggcgcaactcagtgcgcggcttggcgtgccggttgcgatggataaagatgtgaaccacctgatgttatgggatctgctgcagcttgagaggctacccgcgaatgccgtgggcttgtatcccggaacaggtctggggaacagcctgtggctggaaggccggttttatcatggtcatcatgggggttcaggcgagttaggccatattccgctggcgggcaacgatctgccctgcccgtgcggaaaccggggttgcgccgaaaccctgatatccggtcactggctgagcggctgggcagcatcacagcagcccgataccgccatttcgcagctctttaccctgcacggcgatcaccccgatctgctggcgttcgtcgagcgcctggcccagctgatcgccagcgaaatgaatattctcgatcccgaatacctgattctgggcggtggcgtgctggcgatggctgattttccgctggcgcggctgcgcagtgccatacagcaatacctgcgtccacccgtgacgcgccagggtttgaaaatcgtcttcagtcacgcgaccgatcacaccggctgtcgcggtgcctgtctggccgctgagcgctattttggaggggaaaaatgaaaggcaaagtgtgtgtgtttggctccttcaacctggatatcgtggcaggcatgacgcgctttccgttaccgggcgaatccttaattgcacagcacagcatgatggggccaggaggcaaaggggctaatcaggccaccgccgcgctgcgcgccggtgcccgggtgcactatattggcaaagtaggacacgacgactttggtctctttgcccggcgacatctggaaaaaaccggttttgatgcgattacgctgttcacctgcaaagacaaacccaccggaaatgcgttgatttacgtagccggtaatgacgccgagaacatgatttccgtctatccgggtgccaatctcaccgtgacagccgcagaggttacgcgctgtaaaccgaccgttgcggcggcggacattatgctggtgcagttggaaaataatctgagcgccattcagcgcatgattgatcacgcacgcgcagcaaatacctttgtgatcctcaatccggccccgtttcaaaaaatcagtgatgccctgctggcgaaggtcgatctgctgacgccaaacagcaccgaagccatgctgctgacgggcgtgaaggtcacggacatggccagtgcccggcaggccgccgaggcgcttcaccgtaaaggcgcacgtcaggtgattattacccttggcacagccggtgccttactgtctgacgggcaacagctgcttcacattcctgtttttcccgccacaccactggatacaactggcgcgggcgatgcctttaacggtgcgctggctgcccggttggccgcaggggtttctctggagcaggccgcgctctttgcggcggcgtttgcctctctgtgtgtcgaacaacccggcgccgcccacgctatgccctcctacgccgatgcactggcgcgcctgcaggcgcatcccgaatgcgtggccgggaacgtcatggcctgcgcgtaacccggcagcagatgtgccgccaggcacatctgctctgcacatcatcagagcgtcagccagcccgcgataagcgcatgctgcaacaacataatggttttgccgtcgcgaatccgcccttctttcacccactgcatggcatcaggaaaagccatttccagcacgtcgatcgcttcatcgtcgacaccgccgcccgcattctcacgcagcgactcgtgatattcagccgcaaagaaatgcaccagctcggtcacgccacccggcgacatgtaaaccgcgtagagtttttccacctctcccacggcataaccggtctcttcgatggcctctttgcgaatgcaatcttcaggggaatcatcatccagtaagcccgcgcaggcctcaatcaacataccgtcctgattaccgttaacataggtggcgatgcggaactggcgcgtcagcaccacactgtttttttcacggttatacagcaggatggtggcaccattgccgcgatcgtaaacttcgcgtttgtgacgcacgatttcgccctggttgtcggtaatctcataggtgatattacgcagaacaaaccagttctctgacagcagcttatctttgatgatgttgatcttgaacgacatggacgctccgcagccatatgaagggagccagagataataggacgtgcagcctaagaaaactatctgaattgcgcaccgcccgcacgctatcatcaataacggcgtgccgaaagcgcagatgcaacgcaaaaaaactgccagcacgctggctggcattttatgcagcaaatagggtcatgtttatgacgatttgccgtcgtgctcatggtggtcatgttcggtagcggcgatggcattaacacgcttgcgcacgccaaaccagcccagtaccagaatcaccgcgatcaacggaatggacgcgatagtgtaggttccatttggatagtcgaacgccatcaagaccagcacgctaaacaggaacagcagcgtcagccacgaggtaaaaggtgcacccggcagcttgaagctgacatcgtccgctttgccttctttgatcgctttacgcaggcgtaactggcaaagcacgataaagccccacgacgagataatgccgagcgacgccacgtttaatacgatctcaaacacctgtgacggcacgtagtagttaagcaccacaccgagaatgtatacgccaacggtgaccagaattccggcatacggaacctgctggctgctcatttttgacatgaacttaggtgcagatccgcccatcgacatggaacgcaggatacgaccggtggagtagagaccggagttcaggctggataatgccgcactgagcaccacgatattcatgatgctgccaatataaggcacgcctaacttagagaagaaggtcacaaacggactttgtccggcctgataggcattccacggcagcagcatcaccaacagcaccacggaaccgacatagaacaaaccaatacgccagatgacgctgttgatcgctttcggcaacatggtttcaggatctttacactcgccggcggccgtgccgaccagttctatcgaggcgaaggcaaacacgacgccttgcaccagcaccagcgccggtaacaggccatgcgggaataagccgccgttatccgtgatcagatggaaacccgttgcgttaccatccagcggtttgcccgtgccaagaaacaccacgccgaccaccaggaacaccacaatcgccagcactttcactaaggcgaaccaaaactccatttcggcaaaccactttacgccgatcatgttcatggtgccgacaatcgccagtgcgcccagggcgaacacccactgcggcacatcgccaaacgcgccccagtagtgcatataaagcgcaacggcagtgatatcaacaatcccggtcatggcccagttaacaaagtacatccagcccgccacataagaggctttctcgcccatgaactcacgagcataggagacaaagcttccgctactgggacggtgtaaaaccagttcgcccagtgcacgcaggatgaagaaagagaagataccgcagaccagataaatgatggctaaggccggacccgctgcctgtaaacgggcgcctgcgcccagaaacagacccgtaccaatggcaccaccgatagcaatcatctgtacgtgacgattgcccatggctttcttatagccggagtcgtgggaattgagccagcgtcgtttcgcagcgcgcatgtccgctgctgatttcttagtagatttcatagccttcctgtttgtcctgaccataagtcatagcgcatccaaacgattgcgtttagcagtgcgaaatgggttgtcttcctctgtgcgcccgcctgtgagttgactaaaagcggcgcgggaatttacggcgatgaatcctaaccgttatgtaacatcgaagcaaaatataccgaggggatcagtcggacgatttgtaaaaaatttttctgagatcacaaaaaaaccggcctttggctggccggtaaacactacagggatggaaaaagagagggtttagcggtaaatctctgcggtgccggtccaaagactggaatcgccgggtgtgtccacgccgataacacggaaatggcgggcgccttcggctttcgcctgctgcgaaagctggcgggtgacatcatcaagtgagccattcacgctggagacagagacgctgccaatcttttgcaggttctgggcttcacgttgatccaccgccgtggcggcgaaggtcgggaatgacgcagtggccaacagggcggcggcggtgaggtaagcaggtaaatgtttcatcaatactcctgtactcgcgttggtcgctgtggttaaacacggtagtgattattgccgagataatgaaaggcaacctttgtgaggtgtaaagctgtgcgagtaatgttcgctctgacgtcgggattcctgggaaacgtcaactgcggttattgagtgactgaacggcgcgcgttgggcgatgccatgacaagccgcttgcgtatcccgccacctcttttataattccctgccattaaaggggttattaccgtgattgttaaacgctctgttaccagaagtattgcgcagtctttaaccttgattgtgttgctggctttactgactaccggtctggcgctgctcacgctgtccagcagcctgcgtgacgcggaagccattaacctggcgggctcactgcggatgcagagttaccggctggcctgggatgccagactggagccacagctgctggcgaatcatctggtgcagttccagcaaacccttgatgcctccgtattacagcagctcgaccgtccctgggtgccacgcaaagtgattgaccactatcagcgtttgcgtgcgggctggcccgttttggctcagcatcttcatgacaacgcggcacaggcctggcggcaacaaatgcctgcttacgtcggggaaattgaccgctttgttctggaactgcagcgttatgcagaactgaaaatgcgggtggtggcggtcagtagtctgacaggcgtggtggcgattgtggccctggcgctgatgacaatccgctttacccgccagcaggtggttaagccgctgaatgcgctggtcacggccagccggtatgtggaaagcggtaattttgcctttccgccactgcatgtccagcagcagaatgaactcaaggtgctgtcacatacgttcagcagtatggccgcacagttacagtctcactatcagatactggagcagcgggtacgcgacaaaacccgggatctcacccaggcaaaccatacgctgtcgttgctctatgagagttcacagattttgacccgcggccccttgcaccctgcccttttcgacaacgtgttagccaacgtgcgcgccagggaaaaccttgcgtttatccggctggaaggcgagtcgtttatgtttgcgtcgggccagatcgatgcttcgtacgcctggcatcatttacccttgcagcaggacggtcaacctattggcacgctgcgctggcaaacgaccgtcacaacgccgccggaggcattaatgcgaagcctggccgccatgctggggcggtcactctggatctggcagacccaaaaacagcatcagcaaatgctgctgcttgaagagcgcgctacgattgcacgcgagctgcatgattcgctggcccaggcgttaacctacctgcgaattcaactgacactgctgcggcgcaccgtcgatgctggcgatcgtgccgcacacgacatcattgctgaatttgatcgggcgctggcagaggcttaccgccagctgcgcgagctgcttgccaccttccgcttaaccattgaaaaatcagatctggtggcggccctgcaagccatgatcgcctccttacaggaacagtcagcggccgagatccagttcacctgccagccaggccttcaggacctggatgcccagcaacaggtccacgtcttacagatcgcccgagaggcgctgttaaatgcgattcgccatgccagtgctcaggtgattattatcgactaccagcacacggagaaaggtgaacatgtcctgaccgtgacggatgacggcatcggtatcggcagcacggaagagccgcccggccattatggtttaaccacgatgaccgaacgtgctgaacggctggcagggtctttgcagattacagcactgcaacggggcacgcgcgtcgcactgcgctttccgccgcgcctggctcagcagattgaataacgccacaaccgcaccgttttgcattttacccacgccgcaataatcatgcaggatgtggcagatcaacagacgaagacgggattgccccgtacaatgaacatcctgcgcctgaacgttcaggcgcagtctggaaaaccgatcatacgtactgcccataccgcaagccagtaatgccaggggacagggagataacatggaacaacctgctttaaccatcatgatagtggacgaccatccactcatgcgccgtggcattcgccagttactggcgctggaaccgcagctacaggtcgtcgcggaggccagtaacggcaccgaagcgctggcggaagcccgccgcctgacaccagatgtcatcctgctcgatctgaatatgaaaggcatgtcgggccttgatacgttgaaagcgctgcgccacgaaggcattagctcacgtattctggtcctgaccgtctctgatgcgcgcagtgatatttatgctctggtggatgcgggcgcagacggatatttactcaaagacagcgaacccgaaatcttgctcggccagattatgcaggcctcgcagggcgagaaagtgtttagcgacgcggtgaagcactatcttgctacgcggcataacagcgacgatcctttccgtttgctgaccgaacgcgaacgcggcgtgatgcaggaagtggcgcgaggactgtcaaataaagaagtcgcgaatgcgctgcatatttcggaagaaacggtgaaggtgcatattcgtaacgtcctgcgcaaactggatgtgcgttcacgcgttgctgcaacaattatgtggattgaacgtcgaaacagttgataaaaaacgcgcaaatttacacattctctataatttctccacttttcaacccggcctcgcacgtaaagtagacttctacccgtgcgtggtttgcgtggattttttgtgcatcatgcgctgtatcgctcatattaataataaaagcagtgaggagtgtcgattcaatgtcgaatttctttatcgaccgccctatttttgcctgggttttggcaattttgctgtgcctgtgcggcacgctttccattatttcgcttcctgttgaacagtatcctgacctggctcccccaaacgtgcgtatcaccgccacctatcctggcgcgtcggcacaaacgctggagaataccgtaactcaggttatcgaacaaaacatgaccggcatcgataacctgatgtatatgtcctccaacagtagcaataccggacaggcacaaattaccctgaccttcaccgccgggaccaatccagatgaagcgcgccagcaggtgcagaatcagttgcaggcagcgctacgcaagctgcctcaggccgtgcagtcgcaaggcgtcacggtaaacaaaaccggcgacagcaatattctgatggtggcctttgtctcgaccgatggcagcatggacaagcaggatattgccgattacgtcgccagtaatattcaggacccgctgagtcgtattgacggcgtgggcgaagtggacgcctacggcacgcaatatgcgatgcgtatctggctcgatcccttcaaactgaccgcctattctctgaccacagatgatgtggttaccgccattaaatctcagaacgcccaggtcgccgtcggccaggtcggtggcctgcccgccgtcaaaaaacaggcgctaaacgccacggtaaatgcgcagtcgatgttgcaaacacccgagcagtttaaggcgattactctgaagaacaatcctgacgggtcggtcgtcaccctgggtgatgtggctgatgtggcgctgggtgcagaaaaatatgattatctcagccgctacaacggccaggcggcgtccggactgggtgtaaaactggcgtccggcgcgaacgagatgaacaccgataaactggtgcgtgctcgtctggatgagctgtcacagtattttccacatgggctggaggccaaaatcgcctatgaaaccacgccttttgttaaagcctctattacggatgtcgtgaaaacgctgctggaggccatcctgttggtgtttggcgtgatgtacctgtttatgcagaacttccgtgccacgttaatccccactatcgccgtgccggtggtgctgtttggcaccttctgcgttatctatgccttcggatacagtattaacactctgaccatgtttgccatggtgctggctatcggtttgctggtggatgatgccatcgtggtggtcgagaacgttgagcgaatcatgagcgaggaagggctgtcgcctcgcgcggccacccgcaaatccatgggccagattcagggcgcactggtgggcattgcgctggtgctgtcagccgtgttcatccccatggccttttttggcggcaccgtgggggcgatctatcgtcagttctccatcaccatcgtctccgccatgatcctgtcagtgctggtggcgatgatcctgacgcccgcgctctgtgccacgctgctcaagcccatcgccaaaggggagcatcacggtcagcgtgggtttttccgttggtttaactaccattttaaccgcaacgccgaccgctatgaacgcggtgtcgccagtatcctgcgcaccggcgggcgctggctgctgctgtatctggcgattattggcattatggcgtacctgtttcttcatctgccctcctcttttttgccgcaggaagatcgcggcatgatcatgacccaggtacagcttcctgccggttcgagcatggatcaaacctcagcggtggtggcaaaagttgaaaaatattacctgaccaaagagaaagacaatgttctgtcggtcttctcaacgatcggttccgggccgggcggtaacgggcagaacgtggcgcgtctgtttatccgtttgaaagactgggacgacaggccaggtgccgatcgcacctcatttgccattattgaacgcgccggtaaagcgtttaaacacatcaatgaagccgtcgtgattgccagcagtccaccggcaatcaccgggctgggcagctcatccggctttgacctggaattacaggatcatgccggtattggtcatgacaagttaatggcgatgcgtgacacgctgctggacagggccagcaaagacaaactcctgtctcgcgtgcgccacaatggtctggacgacagcccgcagttgcaaatcgatattgatgagcgcaaagcacaggcacttggcgtgtcactggataccattaacgacaccctgaccaccgcctggggttccaactacgttaacgacttcctggatcgcggccgggtgaaaaaggtttacgttcaggcggaagccccgtaccgcatgctgccggatgatgtcaataaatggtacgtgcgcaacagcagcggcacgatggtgcctttctccgcgtttgccaccagccgctgggaaacgggttcaccgcgtctggaacgttacaacggctactcctcactggaaatcgtcggggaagccgcacagggcgtgagtagcggcaccgcgatggacgagatggaaaaactggtcaacgccctgccgctgggcgtcggtttccagtggacgggtgcgtcgtatcaggagcggttatccggctctcaggctcccgcactctatgccgtttctctgctggtcgtgtttctctgcctggcggcactgtatgagagctggtcgattcctttctcggtgatgcttgtcgtcccgcttggcgttcttggtgctctgattgccacctggacgcgaggactggagaacgatgtctatttccaggtcggtctgctgaccgtcgtggggttatcggctaagaacgcaatactgatcgtagaatttgccaacgagcttaacagcaaaggcggagaactgattgaatcgacgctggcggcctcacgtcaacgcctgcggccgatcctgatgacctccctggcctttatcttcggtgtgatgccgatggcgatcagcagcggtgcgggatcgggcagccagcactcggtgggaacgggcgtcatgggcggtatgatttccgccaccctgttagccatcctgttcgtcccgctgttctttgttctggtgcgtcgccgcttcccactcaaagagaaacatcaggactgagctgccgcctgttttcacaatgaacaggcaaaaaaaaacggcctctgaaaacagcggccgttttatttctgtgtgtggtaagaattacagcagaggggaaattgccctgcttttctcctcgcgtgttacttattgcgtaacatcgcttcgatgaattctttccagttccccatttcggtgtcaatcatagaaccctctcttattgtagtggcaatattacgccttttttttcgcctggtgaatacgtttacacctgttattactatcggcaaaggcgccaaaaggctgagtcttttctgatttgctggctgacgcacatttcagcaaaggcttaacctgacaggttttaatgcggttttgaccaggacgtagcctaaaaagcgtaattaaggaaattcttaattcagaattgataaaccacgtaattattagaggcaaaactgaaaccgtttacctacaggcggaaaacctctgtattggcgcaatttattccacccagacgccatcgggcggatgatgcatcagatcacactatggtaaactgccgagctgattttaatgacaggagcagacgatgagcgcgcagtgggtcatgtttgggattaagaattgcgacacgattaaaaaagcgcgtcgctttttagaggcggcgggcgtggactatcgtttccacgattaccgtgctgacggcctgaccggtgaccagttgcagcagtttatcgacgtgcttggctatcaggacctgctcaacacgcgcggcacaacctggcgtaagctgcccgaggcagagcgtgaggccataacggatgccgggagtgccaaagcgctgatgctggaccagcccgccatcatcaagcgccctgtcctgcgcgcgcccgacggcgctttgctgctcggcttcagtgaatccctttaccagaacctgcttcaggagaagtcataatatgttttgtccggtcattgagctgacgcagcagcttattcgtcgtccttctctcagccccgatgacgccggatgtcaggcgctgctgattgcgcgtctggaagcgattggtttccatatcgaaaccatgaacatcaacgataccctcaatttctgggccacgcgcggtgaaggcgaaaccctggcgtttgccggccacaccgatatcgtgccgcctggcgatgccagccgctggatcaatccgccgtttgaacccaccatccgtgacggcatgctgtttggtcgcggtgccgccgatatgaaagggtcgctggccgccatggtcgttgccgccgagcgcttcgtcgcggttcatcctcatcataaaggacgcctggcctttttgattacgtctgacgaagaagccagtggcgcaaacggtacggtaaaagtcgttgagcgcctgatggcacgtaacgagcgtctggattactgtctggtcggggaaccttccagcagcgaagtcgtgggtgacgtcgtgaaaaatggccgtcgtggctcgattaccgctaaccttactgtgcatggcgtacagggccatgtggcctatcctcagcttgctgataacccggtgcaccgtgctctgcctgcgctcaatgagctggtcgccaccgaatgggatcagggcaatgccttcttccctgccaccagcatgcagatcgccaacgttcaggctggcaccggcagcaacaacgtgattcccggcgagctgtttgtccagttcaacttccgtttcagtaccgaactcactgacagcatgattcagcagcgcgtggcagaactgctggaccgccatcagttgcgctataccatcgagtggaaactttccggtcagcccttcctgacatcacgcggcaaactggttgatgccgtaataaacgccgtaacgcactataatgaaattaagccgcagttacagacttctggtggaacctctgacggacgttttattgctcgaatgggctcgcaggtggtggaactgggcccggtgaatgccacaattcacaaaatcaacgaatgcgttaaagcatccgatttacaaatgctgagccgaatgtaccaacgcatcatggaacaattgatcgcctgacagcgagggaaggagcgggcctatggagtttattaaagattattggtggatactggtgatcctgctgatggtaggtgtgttaatgaacgtttataaagatctgaaacgcatcgaccacaaaaagtttatggataacaagcctaatctcccgccacaccgtgattttaacgataagtgggacgacgacgactggccgaaaaagaaataaccgcttcgcgccctcgcctctgtgagggcgcacgattacatcgtcataatgacatcatcactgccgggttttccgccgcccagcgcctcatcaaaatagcgtttcggcaccgtgtactgcagatgatgcagggcaaaatgcatactgcgctgatcgatggcatgcgccagatcttccacaatatttagcgtcacgtcaccgccgagcagccttaaacgctgttcagcctgctgcgcctgtgccagcggaatattctcatcctcatcgccgtgaatcagatgcacagtcgtacgcgtgctggctttttccggtagcgtgacaaagcggccactaaagacaatcgcccgaccagccagatcgtcgttggctttgatgccttccagcaccatactggcaccctgtgaaaagcccaccagcgcggtggcttcgggattcacgccgctttgctgctgccagtggcgaaccgacgccacaaattgcggcatgctggtgtcaacgcaggcctgctcgcttttatcatgcagtccggcttccttaaaccactgaccgccagggccaggcgatcccaccgacaccaccagcgccgcaggaaaggttttagcaaaccagctgccaatttcggccatggcgtcgggattatcaccaatgccgtgataaagcagaaacagctgggcagcccttgcaggctgctgaacaattacgtatctcagtgtcatatcgacctcctgctactactctacgctcccgggcgcaggatgatattgggaatatttgaacgacttggtggatttattgcaattgcctgcgcaacgcgtcaccatccctgtcgggtaacgccagcagtgccccagcggcttcagcgcgtaacgccataatcagcgccttgcgtccgttgagccgtgccgcctgcgccagttcagccagactgatgttggcgctgaccgcctgccggagtaacggcaaaggctgctggctgatatcgaccagccgctggagaaccgccaggcttgcctccagtgggcgctgcgcccaggcaaaaccggctgccagccaggcatcgtgcggggtaaaatcctgatcacaagcctcaggtaatggcaggtccaactgaatatgtgatctcagcagtggccagtcgcgtgccagttgcccgctcgccttctgctgcagctgttttccggcgggcgtcagcccccgtaaggccatcgcggcgtagcagccgctgctggcttcgcgctgactgccgatccgtgccagcgtaaaaccgcaggcttgccagaacgcccagagatcgtcagtgtagccaaagctgacggagaggtagtcgtatccggcggcatcggcactggcggacgcaaccagttgctttccggttccctgacggcgggaagacgcggcgacagcaatccggctgatgcgtaaggcgcgaagcgtggcggcgtcggtgaaacccgcgtgcgccgccagcgactgcgcaactaagttaccgcgaggccgcctgtggcccgcccagacggcctgcgctaattcatttgtcagtccgccctcttccaccaaccatagcgccccctgcagcgccggaacatcgctcgccagccagagatgcattcccggtgcatccagcaggcgacgcagatccagcggtgaggtgcggtaatgcgcacgggtgagcagttgataagccgcctgctgggcagcaatatcagagccttcgactcgccggggcgatagctcacccgttcccgctgtttcgggcgcatcctcgaacagcagcgcctggttaagccagtgttccagcgggtcatggcgcgcccagcgcagcggttcgtccagcgtaaaatggcgtacctgctcaagcgccgcacagaatttcagcataaagccccgaccgctgccttcataaccctgaatcgtcgttaccagcaacacgcgcggaaaccgcgccaccagcgcatggagtagcggtgccggaatggcggcggcttcatccacgatgagccagtcaacgtcaggcaatgtgcgcagagccagaatcgcatcaggtgccataaaccggtaatgatccccggcgaaggacgctaacactgtcgtggtgatttttgcgggtgcggtgatcaggcaacgcgtgctctgccgggccagcatgcctgccagcgccgactttcctctgccacgtgccgctgtgatcaccgccacgcccgcagagaaacaagccagctcgcgcaaaatcgcctgctgctgaaaagccgcctgacaatgccaggcgggccgtggcgtccagttgggcaaccggagcggctgcggcggctggtgtaacagcacctgctcatcattttcaatcaggtattgcagatgatggacaaagtttggtgtggcaatcggctcgctgacatccgcccaacgcaggctgtcagcatcgggctgctgcgcccaacgcgtccattcgggcactaacagcagcagccagctaccggccgtcagcgttcccgccagcgccgccagcgcctcggcatgaaagccatatcgggcatcgaaaacggcatgatggaactcgcgccccagcagcgtacgaaaggcggcagtcggacagtgcgtgcccacatctggcgcgttatcgctcagccacagcccgtcgccttccagcgtctggcaccaggcgatcgccgtctcctggcaccagcgggcttccccgctgatgacggccaatcgccgtataccggcggcctgcatggcacaggtcactgctttcaggttcatcctttattagcaaaggtatcgcactggccggggttaccgctgtcaaatccgcgtttgaaccaggtataacgctgctccgaggtgccgtgcgtaaagctgtccgggacgacccgaccctgacttttctgctgcaggcgatcgtcaccaatggcttcggcggcgtttaacgcttcctgtaagtccccaacgtcgaggattttttcctgctccatatagtggccccagacgccggcaaagcagtcggcctgtagctccatttttacggacagctggtttatctgggcctggctggccccctgctgcatctgacggacccggggttcaatgcccagtaacttctgcacgtggtggccgacttcatgtgcaatcacatagccctgcgcaaagtctccgcctgcccccagtttggttttcatatcgtcatagaaggacaggtcgatatagacagtctggtctgccgggcaataaaaaggccccataacagactgcccggtcccacagccggtgcgcgtggctccgcgatacatcaccagcttcggcggcgtatactgtttgttcatctgtttgaacaacttatcccaggtatcttcggtcgtcgccagcatcaccgaggtgaacttcgctgcctcgtcctgattcgggttagtagtgcgctgttgctggctcaccgacgcgccctcgcctccagtgaacagtggcgtcaggtcataaccgtaataccccgctaccgcgaccagaatcagcatgataatgcccgctttgccgcgcggcagaggaatacggcctccccggttgcccgatgactgattacggcgatcttctacattgtcgctttcgcgacgtccttgccagcgcatgttttgctccctgtggcaggttaactctgatggcatgattttagatgcgtgacggagcaatcaccagctttacgccaaaatgaaaaaaggagagccggggctctcctttcattgattcactgagttttattcagtcgagtttgacacccagacgccgggctaccgcttcatacgcttcaatcaggccacccaggctctgacggaagcggtctttatccattttatccagggtttctttgtcccacagacgcgcgccatcgggtgaaaattcgtcacccagcacaacttcaccgttgaacaggccaaactccagcttgaagtccaccaggatcagacccgcatcatcaaacattttgctcagtacgtcgttcgctttgtaggtcagctcacgcatacgtgccagattctctttactgacccagccaaaggtttcacagtaggattcgttgaccataggatcgtgtttagcatcgtccttcaggaacaggtcgaacagcggcgggttcagcaccatgccctcttcaacaccaagacgcttgaccagcgaacctgccgcacggttacggaccacacactcaaccggtaccatgtccagctttttcaccagcgcttcgttatctgacagcagggcttccatctgcgtcggaatgcccgcttcctgcagcttcgtcatgatgaaatggttgaacttgttgttcaccatgcctttgcgatcaaactgctcaatgcgggcgccgtcaccggctgatgtatcgttgcggaattcaagtatcagcagatccgggttatcggtgctgtatacggttttcgctttaccgcgatacaactcagctcgcttttgcatcttatttaactccaaacatgaaagatccggttctgaggcagactatttgcgttgattgccgtgacgcaatcgattacctcgtctggcgctattatgccaaaaaacgaaataaaaaggccggagaatctccggcctggggtaattttttatttattcagtgcggcctggaacaccgccactaacgcatcgttttgcgcctgtgtcagtacatggcctttaggatcaataaattgcaggctggtccggttgtcgaggtcgccaacctgaaccttgtaatcgccgtttggcaattcaggatctttggcacctacgctgtcccaggtgctgctgcctggcgacttgtaggtcactttcatgctgccagttgaacgcgtgctgtcggtcacttccatgccaacacggttcatggctgctggtaaacgctgccaggcaacgttgaacggcgtacgcagcaccagcattggcagaccggtatcatcggcaccgctttgcacgtcaatcgcaccgctgacgcggcccgctgcggcgttttcatttatggtggcgatcttatccattccggcggcaatttcattcaacatttgtgcagtataacgctgaacctgtaccggcgacgtcacgctattgccttcctgttgcagttcaagcagacgcacggtcaggacctgctgataactctgcgactgaacgctgatttggtaacggccacgatactgcttatcttcgtccgcccggttccactgtacccagtcggtcgtcagctgctgtccggcgtcattacgggaagcgatcgggaagttattcgactgtacaacgcctacaacctgagaccaaatcgagccgcggctgttatcaaacatcagcacgccggtgttattgctgaactgcgcacgtgagccgttcatcagcgccagaggctgagccggtgggcgaatatcgagctgcttgcctactggtgccttactggttgacggtggaatatcgtattcgccgttctggacaggcagaatcatgcccgacggcgctttcagttcgcgcagcccgctggcctgtaagtaagactcatcaccgctgacctgacgtttataacgctgatcgttcgaacaggccgacaacagcatcagggtggaaagccccaccaccgttgcaaccgttgaccgctttactgagtaattcattcaaactccctaaattatcgcaaacccgctttcaccagcgcctgctccactttcggctgtgcaaccgcagtcagtggcgtcataggcagacgcagcgtgtcattagcgattaatcctagctgttttgccgcccatttaaccgggattggattaggttcacagaaaagcgtctggtgcaggtgcatcagacgctgattcagacggcgagcttccacgaaattaccctgctgtgcgagcctgcacagctcggccatttcgcgtgctgctatgtttgccgtcaccgaaatgacgcccttgccgcccagttgcataaagtccagtgcgctggcatcgtcgccgctcaccaggatgaactcatcattaaccagctcttggatctggctgacacgcgataagttccccgttgcctctttgattccgataatatttttgatttcagcgaggcgggcaacggtttccggcaacatatcacagccggtgcgcgaaggtacgttatacagcatttgcggcaggctggtactgtcagcaatcgctttaaagtgctgaaacaggccttcctgcgtcgggcgattgtaataaggcgtaacggtaaggcaaccgacaacacccgaattctcaaagcgtttggtcagagagataccttccgctgtggcgttagcaccggttccggcaatcacgggaatacgcccatccgccagttccagggtttgcagcaccacatcaccgtgctcgtcatggctcagcgtggctgactcgccggtggtgccgacggaaacgatcgccgctgtaccgctggcgacatggtaatcaatcagttttttcaaactcgcacggcagacattacctttgtcatccattggcgtaacgagtgcaacaatacttcccgtaaacattggcgatcccctcgacaaacaagtgcttcatggtacgttttacacttagggaaaagcaagcaagctccgccattcccgcgcttgtcagcagttttttttatgtttaccttatggttattagcaaatgcacagggaatcctattttgccgcaatctcaaccccaccacctggtgatcaccgctctgggtgttgaccgcccgggtatcgtcaatacgatcacccgccacgtcagcagttgcggttgcaacatcgaagacagtcgccttgccatgcttggggatgaatttacgttcatcatgctgctttccggtagctggaacgcgattacgctgattgagtcgacgctgccgctgaaaggcgctgagctggagctgctgatcgtcatgaaacgtacccatgccacagcccggccgccgatggcggataccgcgtttattcaggtcgaagtggctgactcgccgcatatcattgagcgctttacggatttgacggataagcaccaaatgaacattgcggaactggtgtcacgtatccagcccgcccagcaggatcggcccgccacgctgtatattcagatgacggcgcacagcccaacgcgtagcgatggtccggcatttgaacaggcatttaatgaactgtgtcaggaacttaatgccgagggcgcgttacgtctttatagcctgaacgatgccgataaccgtgaactggtgatacccggcaggtaaagacgagcgccgccttgactgttctgctacgttaaaagtacggtcaggtgaggaaatcgtctgaaattgattattttccatttggcagtttctcgcctcttggtgtattaaccacagcatgaactcaaaatggagagatgtgatgaatccactgaaagccggtgataccgcaccgaaatttagcttgcccgatcaggatggcgaacaagtgaatttagccgacttccaggggcagcgcgttctggtctatttctatccaaaagcgatgacgccgggttgtaccgtgcaggcatgtggtctgcgtgacaacatggatgagctgaagaaagctggcgtcgaggtgctgggaatcagcacagataaacctgaaaagctgtcacgttttgcagaaaaagagctgcttaacttcactctgctgtcggaccaggagcatcaggtttgtgagcagtttggcgtctggggtgaaaaaacctttatgggtaaaacctatgacggcatccatcgcatcagcttcctggtggatgcgaatggcaaaatcgaaaaggtgttcgacgacttcaaaacgtcaaatcaccacgacatcgtgatggactatctgaaatcagcctgatgtcttcagggcgcggcatctaccgcgccctgaacgtttaacgattcagcgtttcatccagcgtggcctcaggccaggcgtgcaccaccgccttgaccagggttgcgagcggaatcgcaaaaaacacgccccagaatccccacatcccgccaaagatcaccaccgataagatgataaccagcggatgaagattgaccgcctctgagaacaaaatgggcaccagcacattgccgtccagcgcctgaatcaccagatagacggtaagcagcgtccagaactcgctatccagcccccattgaaataagcccacaccaataaccgggatggtcaccagcatcgcgccaatgtaaggaatcagaactgaaacgcccaccagcacggccaacagaagcgaatagttgaggccgaggaacataaatgccagccaactggcgatgcccaccaccaccatctccaacactttgccacgaatgtagttggtgatttgctgattcatctcctgccatacttcacccgccagcccacggttacgcggcaggacgcgtcgcacggcactcagcatctgctctttatccttcagcagaaagaacaccatcagcggcaccagcaccaggtaaatcatcagggtcattaatcccaccagcgatgccagggaatacttgaccagagaatcgcccacgccgctgagacgaccgcgcaggttctcgacgatgacatcaatgatgccggcatcgaccagggcgggaaaacgtcgcggtaaccccgccgcatactgatagagtttgttcagcatgttaggcagatctcgcgtcaggttgatgccctgttgccaggccacgggcgcgacgatcaacaccagaaccagcagaattccggcaaacagcaccaacacaatgctggtcgcccagctacgcgtacagccaatgcgttgtagccgtaccgttggccattcaagcagataagccagtaccaccgccaccagtaagggggccagcaacccgctcaggaagaaaagaatgcagaaccccgccagcagaatcaccagcaggccaatcgcctggggatcgctaaaacggcgtttgtaccattgaatcaataaagccagcatgccgtcaggtccataaggtcagaaagggccatgattgtaccggatattctggtgctggaaagacgtgaaaatcagtccgtgacctgacaggcgctagcggatgatgaaaaacggcacgcggtgaaggtgcgtgccgtaccattctccccagcctcaggcttcccgccgttgcgcactggcaggcgaatcgtcgccgacggggtcattatcttcaccgcaggccagcaacacgcccggcctgctgtgggtcattttcaggcgtcaggcttcattcacccaaatacgcatctccccttctccccggttcgcccaacagaaccagggaataaaggtcagcgtctgggtttgctgcgcggcaggggcgtgatcgaagtgccacagcggctggcgttcaggatcgctggcggtttttttcaccccttcagcctgtattaacaccttatgcgcaaaaacaccgcgtccctgaatggtggtgaacgatgccgacgcgggcagccacagattgtgtaactgctcgccgttatcggcctgctccaggcagtacaccagcgggccgcgctgaaccgccaccttgcccgccacgtgacgtactaacggattaccataaacccggcgcaccggcatcgggagcgtcagagtgagcgtatcgccctcttgccactgtcgctcaatgtagagataacccttgcgggcgcgatcggtcacagcgtcgccgttacagcttacctgcggcgcctcacaccagtcaggcagacgtaacgccagcgtatgttgcacgggctgcgcgacatcgacgctgatggtgaccttttcatcccaggggaaattaccgcttatgctaatgcccaaagtatgctcaccgaccggtatttcaacccggttgccgacatagagattgatataaagcgcatcctcgcgtggcgtataaatatagtggccgagtgaggtcagcacacgggcaatattcggtggacagcaggcacagccgaaccagcgctgacgcacaggtttcacatgatcgtagatatgattaaaactgagggttttcggatgcacctccagcggattgacgtagaagaagtgtttcccgtccagcgccatgccgcccagtaccgtattatacagcgcgcgttccatcacgtcggcgtactggctgtcggcttccatttccagcatacgtctggcaaacatcatcaggccaatggacgcgcagctttcggcataaaccgtgtcattcggtaaatcgtaatcgctgctgaatgcttcaccgctgccctgggagccgatgccaccggtaatatacagctgccgctgcgccatgttgtgccatagccgcaggcagtcctgacgtttttcttcgtcctggctcagacgcgcaaggtgcgccacgccggtcatcagataaacgaaccgcacagcatgccccaccgcatgctgctgttctgcaaggggttgatgtgcctggctgtaagccttgtccttcaccatccaggccgggccataggtattccagtaggaggtctgcccgcgcttctcgtactcaatatcatagaagtgaggctgcgttccccgctgcgcgacaaaataatctaccagcgccatatagcgtgggtcctgggtcacttcatacagccgcatcaatgccagctcgatctccggatggcctgggtagccgtgcagctgattttcgccggggccaaacacgctgtcgatgtgatcggcaagcttgcacaccacctcgagtaaacggcgtttacctgtcgcctggtaaaacgccacgcccgcctcaatcatgtgtccggcgcaatacagttcatggcattcggcaagattcgtccagcgatcttccggcgctttcaccgtgaagtaggtattgagataaccatcctcgcactgcgccgccgccaccagttcaatcacctcatccgccgtcttttccagttctgcatcaggcttctggcaaagtgaccaggctacggcttccagccatttcgcgacatcgctgtcctggaagaccatgccataaaattccccttcctgctggccagccgcgatacgaaagttttcgatggcatggctgggatcggcttcgtcgatccgatcgttaagcgcctcccattgataaggaatgaccacctcccgcaccagtcgttgatactgaccgagaaagggatcgtgaatcgtcagcttatgcagatcgacttcattgacagacattttactctcctcaggacgggacatggcgaattcgcaggtcgctggaaatctgcgccatcatcgggttattgagcttgcaggcgcggatggcgaatagcagcagcagatgaaacagggcaggcaacaacgtttccattgcggtaatgccctgcaaggatgccggtgtctgatgcgtgattcctggcttgtaagccaccaggatgaacagcaggctgataatgacgccgctggaggcccaggcaagcttaataaagaacaggttaaacgcgaaattcatgcccgatgagcggacgccgtttttccattcaccatagtcatcggcaaaggccatcagggcaaagtgcagcgggagcgtgaaccccaggatgacgccgttggcgaggatcaccaccagccataatacctgccatgacggccccaccggcaggaaccacatcatgaccgccagcacggcaagcacacaattggtccagtagtagagccggacggtgtcgatgtgttttgccagcgggttaacgatgaccgcgcctaaaatagaggctaaggtcaccatggtaaaaaacagcgaagtgtaagcggtgctaccctgtaacacataggtgatgaagtacatgtagccgccgccacggatattgaacacgttaatcagcaaaaacgacatcaccagcatcagtaacagctgatcgtttttacgcagcccggccatatgttcgcgcagggtaaacttgcccaggctgtccagcggtacgcgctcgcgaacccagaagaagcagcacaggaacatcacgaccgccagagcgcacaaaatgccgacgccagactgatagccgagtgccgcattccccttacctaagacagaaaccagccacggcagccctaccgagaccagaaatccggccacgccgcacagcacaaaccgccatgactggcacgccagcacttctgtgtggcgggtggtcatggtgttaatcagcgcgcaatagggcacattaatggcggtatagctgacggaaagcagcaggtaggtggcaaacgcccagacgattttcatgtccatgctgacggcgggcaccgtgaacgtcaggacaccaatgatgccaatgggcacagcgacccacagctgccagggacggaaacgtccccatcggctatgcgtatggtcggcaatcacgcccatcaccggatcggatatcgcatcaaacacgcgcagcgccataaacagggtgccgaccagcgcaggtgttaagccaaagacatcggtgtagaaaaacgtcagaaagttcatgatcaggcaggtgatcaccgtgccgccggcgtctcccagcccgtaacctattttttcacgcagggacagcgcactctgcgtcgccgactggctaagatcggcctgagcgatggtggtagaagtcataaaaacgcctcatgcaggacagagaggatgacccgctttctggcgggcttattggtgttttagcgccttacccgatttattctgtcaggaatccgttaaccaacaagagcacaaaaaagtataaaaacggggtaattccgacctgtgaagcaaactgtgaagtggatcagatacattcgtggttttttgttaataatcagatacaaaggtgattatcagggttgtcgcagcgggaaaatgaataatgatgttcgaattatccatagcgtttccggttcgggtgcaaaatggcgggctgtttatttcacgcggtgtcgggacacatccggcacgcaggctgacctcgtgggagatcatcttcgttgagcgcggtcagttaaccattcgcgaggatgacgtgctgtatagcgtgcaggcgggcgaaagcctgctgctcaggcccgggcatttgcatgtgggtgaagggatttttccggcggatctgaaattttactggctgcattttgactggttgaaacagccgaagcttcaacatggattacaccaggcactgctgcatcttccccagcatacccgcgttggcgatccggcctatatcatcgccctgttcaggcagttcctcagcgagcaggaaaacattcaccggagcgtcgcactggaatgtattttactgctgatcctccagcagctcgccgctcccgccctgcatgaggacgtcgttgacagtcccggcgttgacctggcctggaaagcgaaccagctcattcgtacccagtatcacctgccgctttcgacctccgcactggcaaaaatgctgcattgcaatgcggattatctgggacgcgtttaccggcgcgtatttcgcctgacgctgacggaagccatccaccggcagcgcgtcttaatggcagaaaaattgctgatcggcgacaagctgccgctaaccgaggtggcgcgccagtgtgggttcaatgatgtaggctattttcgccagatattccgcaagcacaccggcttaacgcccgccagctggaagcggcgctactgccgggaacatatcaattcctgatgattcgccccggcccgccgcgggatttccccgcacgggcggagcgccaggtctgccgacgcggttaacgattaagacgctttaacgcgtttcgcgaccacggtgcagttgcgtccggtgtttttagcctgatacagagcatcatcggcccgcttcaggctgctttccagtggcaaccggcgcgcgtcccattcggccacaccgatggatatggtgatatgaccgacttcctcaatctctttttccgcgatgctgttccgaatccgctcggccgtagcctctgcttcttttagagaggtattcggcagcagcattaaaaactcttcgccaccgttacggctgaccacgtccgactgccgggcgctctgccgtagcgcctgcgccacctgctgaatcacccgatcgccaacatcgtgtccccagttatcattcacgcttttaaaatggtcgatatccagagccaggacggcgaaaggctggcgtatgctctggtaataatcgagtaccgcattcagcccgcgccggttcagtaacagggtcagtgaatcggtctgtgcttcggagctcaggcgaccgattttatcctgcaccagaccaatgccggtgagtagcgcccgttttacctgcgcggcctcaaagtaccatgcgcgaatgccgccaatttcataagtggcgcttgaggcatcaattttgctggccttgcgggccaactgccagagcggcatggcgatcatccgcgccagaatgaccgccaccagcaaggtcagcagcgcaaagggcacagaacgtttcaggactttcaggagcaggcccgacagcggttgcagcgtgacgtcgacaggcttcagtgccaccaccatccagccggtcgtcgggacgatggcgtaacccgccagccgggtcggtttgtcggtctcggttaagaccagcgagccgttatctttttcctggcgctcacgttcgctcatcaacggcggcataattttgccgaccatttgacgattctggtgatacagcacctggttattactgtcgagaacaaacacgctggtgccgtcacgataaaactgttcacccagcagcgcgttcagaatacttttctttttaaggtaaatcgtgccgccaatataacccagatagcgtccctgattattccagatcggccatgagacaaaaataagcaggttattcgcagcggaaaccgtcggtttgctaattaacggctgtcgggtttgcagcgcttcgcgggccgcatcgctggtcagatgcatccccgttaaggtcagggattcaggtgatatcgcctgaacgttgccgttttcatccaccacggcgacagagttgaaactgtcggtctgttcacgtaaacggttaacttccgctttgagcagtgacgcattattgaaatcttttcccagtacattggcactaaagtgcagttgagactgcgccagacggaaaaaaacctcactggtggaggccagcttggccgcatacgcgcggttggcttccagcgtgctgtcaatcagcaccatgcgttgcacgcgccaggtcgcatataaattattggcaagcgtgatgacaatactggtaattaccagcagcgcaataagcgtgcgtaagtccgcccggggacggaaattaattagcatggcgtggacgccacagtgcaaagattcattttgctgtgcctggctctgttgtttttatggtaatagcggtcctactgcgtgtaagtctacacgcagtaggacaatttgagcaggtttaagcgcggcattcaccaaaaagtcagcctgtacggcctttaatcgattaaaccgttttggtcataaaaaggccatggcccgtcatagtcaccaatggcacattgatgcgtcgtcattccctgctgtggatgccagcgatggagcaaaaatccagccggttccagcacaaaatttgcgggcccatccggttgcagatccagcgcaacctgatgggagacgccaggcgcaatacaggccagcgtaccggcaaagcgcgtctgaatggcgcgatgcacatgaccgcacagcacgcgttctgtctgcggatggcgggcaataatcgccgccagtgcgtcgggatcgcgtaatcgctggcgatccatatgatcgatcccgcaggcaaacggcggatgatgcagcatcaccagcgtgggcacgctcggtgacgcggtcagtgctgcatccagccagctaagctgctgctcatcaagctggccccacggttgctgcggcacgctggagtcgagcgccagcagttgaatgcccttcacctcctgccgccagttaagcgttggcccctgctgcaaataggggtgatcgggaaacgctgccctcaatgcctggcgatcgtcatgattgcccgccatcagataaaacggcagatccagcgttgccagcgcctgccgtaacgtctgatactctgccgccgtgccaaaatccaccaggtcaccggttatcaccacggcatcgggccgtggcctaagcccattcagggtgttaatcgcccgtagcagggcgttataggtatcgacctttttatacgacagacgaccgtgggctttaatatgcaagtcgctgatttgcgcaatcagcgtaggttcaacagacaaacgttgtctccttaaacagtaaattcaagcgcggcctgctcagccagcgaccagctgacgcgctgcccggcgtgccaggtttcccgtgcgtgtcgctctacctgaatcggcttgtccagcccgatatcgatcatcaaacgttgggatgctccgagaaaggtgctggcaacgatataaccgtgctgtgtatagcggccttcgtctgccagcagcacatcctctgggcgacaaaaacgcagcggatggccctgctcatcacgtgcgatacagttaatcgcgccaacgaaatccgccacaaagcgagaggccggacgctgatagatggcctgcggcgtgtcgatctgcaccaggcgcccctgttccatgacggcaatacgatcgcccagcgccatggcttcctgctgatcgtgggtcacgtacacggcggtgatagccagtttttttaacaggctcccgatttccagacgcagccgctcgcgcagtttggcatccagcgccgccagcggctcgtcaaacagcagcactttaggccgcgccgccagcgctcttgccagcgccacgcgctgtttctgtccgccggagagcttgtcgatatgacgttgggccagggaagtgagatcgaccagttccagcatttcctcaacacgcgcctctcgctcgtggcgcgggatgccctgcactttcaagccataagccacgttctgtgccacgttcagcgtggggaacagggcgtagttttgaaagaccattcccacgttacgtttctcgacaggcaggtcggtcacgttgcgatcgtcaaaccagacttcacccggcgcatcggtgctctccaggccgctgataatgcgcaacgtggtcgttttgccgcagccggatgggcccagcaacaccagggtttcgcctgaccgtacgctcagatcgagcggatggagcgcctggtgatgattaaagcggcgtgcgcagccgcgcagcgtcacgtttacagcttcaaggatcatgctttctcctccctgtgttgctgacgagactggcgttcaagccagtgattacaggcgttgagcatcagcaacagtggtaaaatcattaaaataaagatcaaggtgtaggccgaccccacttccagccgcattgaggcatagctgtcggccaggcccacgggcagagttttggtgagtggcgtatgtaacatccaggtaatgttaaattcacctaccgatagcgtgattaccataaaggccccggcgagaatgccgttgcggcagttaggcaccaccacggtgaaaaagcgacgccagaagcccgcgcccaggctggcggcagcctcttcaaggcgcggtagctgaatagcctgcatcaccgccagcaccgggcgaatcataaacggcagcgtaaaaaggacgtggccgatcaagataaaaacccagctgtcacgcaggctgctgaactgaccgtacagcaggataatgcccagtgcggtggccaggcccggtagcgctaccggcaacatcaggcactcttcaatgcgcgatgaccagcgcgacgacgatttcagtaagccccaggcggctggcacgccgatcaccagggtcaccgccagacagctgacggcgattaacagtgacagccaaaaggtgtcgctgtacatctcccaaacctgttccacccatttcagcgtcagtccgctgcgcagaccaacaaagtagttctgcgtcacgcccgccagcatcgacaggatgaccggaacaatcatgaacagagcagtcagcgtggtaatggcgatttgcaggtaaaataaaccacgacgtttcatgacgacgtctcctggcgggattgggtgagcacccgcaccagcattaagcctgcccaggcgacggcccccatgaccaccgacagcgccgcagcggtggcaaagttcgcgtagttggtaaattcgccatagatggtgagcggaaggacactcaggtcagttcccagagtaaatgcggtgccgaatgcgcccatgctggtggcaaagcagagtgcaccgctggagagcagtgccggtttaagccccggcacaatcacatcccagacaatgcgccactggctggcacctaacgaacgggccgcctcttccagcgagcgatccagtttttcgctggcggccactaatgtcactatggcgcgcggcagtgaaaagtagagataaccaatgaacagcccggtcagtgaataggccagcgtccagcgctcgtcaaacaggcgcaggctgatctgggccagaacgccctgccgtcccgccagcatcaccactaaaaaccccaccaccacgccaggaaaagccaggggaaaggtcagcagtgccagcaacgttccgcgcccggtgaagcgctggcgggccagaaagcagcccaccacagtggcaatgaccaacgtcaatagcgtgaccgacagcgacaacagtacggtattcaccaggctttgcagatattgcggctgggtaagcaccgtccagtaaccactgtgctgggtgctgcgatctggcgtcatgcccatctgtaataaacgggcgaaaggcaacagccagaacgcggcaaaaaacagtaacgcaggcagcagcatccatggccagtttgccccctgctcgcgtcggcgtgaccggcggcgcgaagccaccggtaaatcgcggcgggcgtcagacggtgccattaccgaatctcactcaggtaacgggcagagaaggctttctgtgcatcggccatctgctggtagtccacagtgtgcgcacgggcgtaatcactgtctggcagaaagtgcgttttagcctcagcagacatggccgaaggacgcaccggacgcagataggcattggcccaaatcgcctgacctttatcagacagcacatagtccatgacttttttgccgttggcggtatggggcgcgtttttcaccaggctgatgacgtaaggcaccgtgaccgttccttcctgcgggatcacaaatgccacattggcatggtctttatatttggcgcgataggcattgaagtcgtaatccagcagaatcgggatctcaccggagataagacgcgcgtaggcggtctgcttaggcacgataggcttgttcgcctgtaactttttgaaccaggtcagggctggggtgaaatcctgcatgctgccccctttcgcctggtttaccgccacggcggcaacataaccgacaaacgcactggccggatcgagatagcccaccatgcctttgtattctggtttcagcagatcgtcccaggatttgggaatgggcgcgccgcccagggcatccacattcaccataaagcccatcgtgccggagtgcagtgcaacccatttcccctccggatctttcatgcctgtcggcacccgatcccagttggctggcttgtagtcagcaatcacgcctgcctgcgccgcctggataccgaagctgacgccgtagtacaccacgtcggcaaccggattacctttctcggcaaccaactgcgccagagcctgtcctgagttcttgttatcctgcggcaccacgataccggtgtcttttttgatggcctgcagctcggtggcccagtccgcccattcgggtggacagttgtagcagatcgcattttcagccgcctgcaccagcgggctggaaaatgcgcaggcggtaaagaatgccgccctggcaagcagcgtgattttattgtgtgtagacatgatggttccctgatgttgacgagtgaaatacggtcgcgatgctctcgcctgtacgcagccggtggtccagcaggcgcgagtcatcgtgagaaggttggagaagcatatcgattgcgcaggcacccaactgatcgctgggttgcactacgctggcgagtgatggcgaaagctgttcgccaatggcaatgccatcaaaccccatgaccgacagctgttgcggcacctgaatgcctgcacgtgccgccgcgccaatcaggctgatcgccagcaaatcgttactgcaaatcacggcggtcagcgggtcagcgccgttgatcagcggtaaaagcggatcgaatcgggattggatatgacttggcatgtcaatcagcccgcgagggacgaatcccgcctgctgcatggcatcgcaatagcccagataacgctggcgtgcacggtcagactgcaacatcggccctgccgccatggcgatatgctgatggcccagcgcaatcagatgtgccgtggcttccgccatcgcgcggcggttatccacgtacacacagcgccagttttggttttgcgggacgttatgcgccagcacaaagggcatgtgcgccgctgccagcgtcggtaatacgctgctgctgtccgcgtcggacacggtcagcaccaggcccgcgacgcgctgacgcaacatatgttcgacaatggccgcttcgcgttctggctggtaatccgtcgttgccaccagcaggccataacccgccagccgcgcctgttgctccatggcctcaagctgtaaggcaaataccgggttactgagtgaaggaagtaaaacccccagcgtggtggagtgttgcgtgcgaagctggcgcgcaatatggttcggtctgaaccccagctgttccgacgcatccagcacttttttcagggtgccaggcttgagcagatggggatcggaaaaggcacgggccgcggttgctcgcgaaacgcctgccagtaccgccacactgattaaatcactcatctcaccctcgtttatccgtaatgagatcgatctcattgctgcgtaaactaacggcgttgtgtgacacgaacatcacggcaagatgacgttgtggtgacagcagcccaaaatgccgccaacacgtcgcagccaaaggcagcgttctgattttgctgtaatgcgcggtggccttgctgaagagagccggcatgaagccgggagggaaacgttcggcgcgcaagaaccgtgcgtcattgccgggtcacggaatagagatgctgcccgagctttgccccttcgtcgcctcagctgagagggatgatcatcgccacgtcggtgtctttactcagcccgctgacaggccagcgttgtgcatccgtatgacgttctgtcgcccaccgtggcctgacaggtcgcgttttacgcacaatcccctgcacctgctgccactgcgccatttcattcttccccaccagtggttaagatacgaagaaggcaccaatattgacgtaaaaaaagaacatttccgctgcttacctggccaaatcagggattcattacaggataaaggcatgttgaaccggttaaaaaagacgctgattgcgacgctgctccctgcactgacattatcctgcccgttaacctcgcacgcagatatcagtgactcattgccggatatggggacaacggcagcctcgaccttgtcgattaatcaggaactgcagatgggcgacttctacgtccgccagctccgcgccagcgccccgctgattaacgatcccttactgaatcagtacatcaaccaactcgggcagcgcctggtttcacatgcggacggggttaaaacgcctttccactttttcctgattcagaacgatgagctcaacgcgttcgccttttttggcggtaatgtggtgctgcacgcggccctgttccgttttacggataatgagagccagctggcgtcggtgatggcccatgaaatttctcacgtcacgcaacgccatctggcgcgcgcgatggaagatcaaaaacgcaatgcgccgctgacctgggtgggcgctcttggctccattttactggcaatggccagcccgcagatggggatggcggcactcagcggcacgctggcaggcacgcagcagggaattattagctttacccagaacaatgagcaggaagcagatcgcatcggtattcaggtgttgcagcgatcggggtttgatccccaagccatgcctaacttcctgcaaaaactggctgatcagagccgtttctcttcaaaaccgcctgaaatactgttaacgcacccgctgcctgacagccgccttgccgatgcgcgcaaccgtgccaaccagatgcgtccggtggtcgtgcagtcgtcacaagacttctatctggccaaagtgcggtcattaggcatgtattcgacgggccgcaaccagttgacggacgatttgctcacgcaatatgccaacggtaattctcgcgaacagctcgcctcacagtacggtaaagccgtgcagtttcttcaggccaaacgctatgacgaggcgaaaaagatcgtggcacccctgctggctaaacagcctgaaaatgtctggctgctggatctgatgacggacattgatatcggcctgaaccagccgcagcaggcaatagccatgctgaccgccacgcaggcggcaaaaaccagcccggtcgtgcagctaaacctcgctaacgcttatgtggaggcgaaacagcccgcgaatgccagccgcatcctgaaccgctatacctggacacataaagatgataccaacgggtgggatctgctggctcaggcctcagcacagcagggacagacagatgaagaactctttgcccgcgccgaaagtctggcgttgaacggccagctcgatcaggccattagtgccctgagccgtgccagtgcacaggtgccgctcggcagtctgaaacaggcccgatacgatgcccgcatcgatcagttacgtcagcttcagcaacgctttaagcagtatcaaaaaggataatagtatggtgacgctttatcataatccgcgctgcagcaagagccgggaaaccctggcgctactggagcaacaggatattcacccgacaatcgtgcgttatctggacacaccgcccgatcgccagaccctgcaaatcctgctgcagaaactgggcatgcaaagcgcgcgtgagttgatgcgccataaagagccattatatgcggcgctggggctggatcggccagaaatcggggaaagcgcgttgctggacgccctgctggaacatcccaaattgatcgagcgacccattgtggttaacggcgatcgcgcccgactgggacgtccgcccgaagcggtgctggagattatttagagaccgagggtttctttcacgaagggaatcgtcagcttacgctgggcgctgatcgacgcactgtccaggcgatccagcgtatcaaacagggtacgcatttcacgatcgagccgcttcagcaaaaaccgaccaacgtcttcgggcagttcaaatccccgcaatccggcacgcagttgtaaagcctgtaacttatcttcatcagaaagcggctgtagacgataaatttgcccccagtcgaggcgggatgccaggtcgggcaaatgcaaattaagctgacgcggtgggcgatcgccggtaataaataaccgggtattgccggtttccaggatgcggttatagagatcgaaaatcgccatttcccatgcttcgtctcccgcaatgcattgaatattgtcgatgcaaaccagcggcagttgctccatgccttccagcacttccgggacaaaccaggtgcgtttatcaagcggcacatagcccacggcttcgccgcgtgcggacatttcagcgcaggcggcgtgcagcagatggctgcgaccgcccccttcacgagaccagaaatagagatagctgccatgctgctggctaagcgcacccttaatcgcggcaatgagcgacgggttttcacccggccagaagctggcgaaggtttcgtcgtcaggcaaatagagtggcaatgacaattgtgccggcgtgttcagaagcacctcagcaagagaacaagcaaaaatcggggcaagtctatcatagtttttaaccagagatgaatcgggcatccctgcccgcgtattgacgtctagctgcgcgatgacgactcggggttatcttctgcatccagaatcacttcttccggacgcagtacggaaatcacccgaaagattaaggccagcgcaacgccgacgagtgttgccagcgccatgccttttagctcggcagcaccgatatgcactttcgccccgctaacgccaataatcaggataaccgaggtcaggatcaggttttgcgccttgttgtaatccactttagattcaatcaatacgcgaataccggacgcaccgataaccccatacagcagcaaggacacgccgcccataacgggcaccggaatcgcctgaatcgcggccgccagtttgcccacgcaggaaagtaaaatggcgaaaatggccgcaccgccaatcacccaggtactgtaaacacgggtaatcgccatcacgccgatgttttcgccgtaggttgtgttgggcgttgatccaaagaaacctgaaataaccgtcgataagccgttggcgaacatcgaacgatgcagtccgggatcgcgcaccagatctcttttcacgatattcgccgtgaccaccaggtggcctacatgctcggcgatgaccaccagagcagcaggcagaatggtcagcatggcaatccactcaaagcgcggcgtataaaaggttggtaaggcaaaccagggcgcatgttcaacgccgctccagtccacgatgcccatgaacgcggaaagtgcgtaacccaccagcacaccgatcagaatcggaatgatggccataaaaccacgaaacaagaccgaaccaaacacggtgacggccagggtgacgacggaaatcaagacggttgtgccgtccggcgactggccttcggcaggaagcagtccggccatattcgcggctacgccagccagttccagaccaatgacggccacgatggcgcccatcgccgcaggcgggaacatcacatccagccagcctgtcccggcttttttaacgatcagcgcaaccaggcagaacaacacgccacacataataaaaccgcccagcgccacttcatagcccagcggcagcagcagcaagacgggcgaaataaaggcaaagctcgatcccagataagccgggatttttcctttacaaataaacagatacaacaaggtgccaataccgttaaacagcaataccgtcgccggattgatgtggaacagaatcggtactaataccgtagcgccaaacatggcaaacagatgttgcaggctgagcggaatggtttgcagtaatggcggccgttcgctaacgccgatagcgcgacgagtcattaaaagtccccttgagttaatcgtctgtttttagataaaaaaaagccgactctgtggtcggctaattcatttgatggtctgttacgacagaaaaaagcggcccggcctgctgctgcaggctgaaaacaccgtgatgcgtggagccgcgcattttcgtcattacttggtgccgaagattttatcgccagcatcgcccaggcccgggatgatatagcctttgtcgttgagtccctgatccacagaagcggtgtaaagctcaacatccggatgcgctttttccagcgcggcaatgccttcaggcgcagcgaccagcaccagcacttttatgctgctacagcccgctttctttaacagatcgatcgtggcgatcatcgagccgcctgtggccagcatcgggtcaaccactaacgccaggcgctcttcaatatttgaaaccagcttctggaaataaggtactggttccagggtttcttcgtcacggtaaacgcctacaacgctgatgcgcgcgctgggaacgtgttcgagcaccccttccatcatgcccagaccggcacgcagaataggcaccacggtgatttttttacctttgatttgatcaacctgaaccgggccattccagccctcaatcgtcaccttttcggtttccaggtcggcggtggcttcataggtcagcagactgccgacttcagaggccagctcgcggaaacgctttgtactgatatcatgctcacgcatcagtcccagtttatgtttgaccagcgggtgtttaacttccacgatcttcattgttgttctcccggagtgagttgagctaaaaaaaaatcgccggattataccgccttttcgcccctgcgccacatgtgcttgcgcaatcaaatgcattttgtcaggacaaagtaaggattaatgaaaatcgccagggacgcaatctgagactcgcaaacgtttgcctgcgctggtagaattgccgcgctttatattaaaccaccaaccgcaactcgcgtggggacctcgcagtgaccgataagacctctctcagttacaaagacgccggtgttgatattgatgctggtaacgctctggttgaccgtattaaaggcgtagtgaaaaagacgcgtcgcccggaagtaatgggtggactgggcggtttcggtgcgctttgtgcgctgccgcaaaaataccgtgaacccgtgctggtctccggcactgacggcgtaggtaccaaactgcgtctggcgatggatctcaagcgccacgatgccatcggcattgacctggtagcgatgtgtgtcaacgacctggtggtacaaggcgctgaaccgctcttcttcctggattattacgccaccggcaaactggatgtggataccgcttccgccgttatcaccggtatcgccgagggttgcctgcagtcaggctgtgcactggtgggcggtgaaaccgctgaaatgccaggcatgtatcatggcgaagactacgacgtggctggcttttgcgtgggcgtggttgagaagtcagaaatcattgatggcagcaaagtgcaggatggtgatgtcctgatcgcactaggttccagcggcccgcactccaatggttattcactggtgcgcaaaatcctggaagtcagcggtaccgatccgctggtggaacagctggaaggcaaaccgcttgccgatcatctgcttgagccaacccgtatctacgtcaagaacatcctgagcctgatcgaacaggtcgatgttcacgctatcgctcaccttaccggtggcggtttctgggaaaatatcccacgcgtgctgcccgataacacccaggccgtgattgacgagaacagctggcagtggcccgccgtgtttagctggatgcagcaggccggtaatgtcagccgtcatgaaatgtatcgcacgttcaactgtggcgtcggtatggtgattgcactgagccctgccgatgcggataacgccgttgaactgatgcgcgccgctggtgaaaatgcctggaaaattggcgtgattaacgcatcagaagcggaagagcgtgtggtcatcacgtcatgaaaaagctggttgtgctgatttccggcaacggaagtaatcttcagtccatccttgacgcctgtgcaaacgggcgtattcacggcagcgttgctgccgtattcagtaataatgcttccgcctacggcttagtgcgcgcctcgctcgccgggattccggcgaccgcgctgaatccccgtgatttcagcgatcgtgaacgttttgatcggcagcttatgcatgagatcgatgcctatgccccggacgtcgtcgtgctggccggttatatgcgcattttaagccatgcttttgtggcgcattacgctgaccgcctgctgaatattcacccgtcgcttctgcccaaatatcccggtctgcatactcaccgccaggcgctggaaaacggcgatgctgaacacggcacgtctgtgcatttcgtgacggatgagctggacggtgggccggtgattctacaggcaaaggtaccggtttttgcggaagacagtgaagcggacattaccgagcgcgtacaacatcaggaacatgccatttatccactggtgattagctggtttgttgaaggccgcctggctatgcatgatggtaaggcctggctggatggtaaaccattgccccctcagggttatgcacacgagtaactcacagggagcctggctccctgcacctgtcagccataccgcccggtaatataatcttccgttcgccgcaccttcggcgcagtgaaaatgcggtcggtgtcatcaaattcgaccaacgcgccattgtgcataaaggcggtgtagtccgacacccgtgaagcctgctgcatattgtgggtgaccagcaccagcgtgaagtgctgtttcagggtgctcatcagttcctcaatcaccagcgttgaaatcgggtccagcgcggatgtcggctcatccagcaacagcacgtccggctcaatcgcgatagcacgcgcaatcactaacctttgctgctgaccggtggagagcgtcagggcattctgtgccagttgatctttcacttccccccataacgctgccgcccgcagtgctcgttcacaggcctcgttcagcacccgcttatcgcgcacgccctgtaagcgcaggccataaaccacgttttcgtaaaccgacttcggaaaaggattgggccgctgaaacaccattccaacacgacggcgtagcgcggaacgatcctgagtgggccgcataatcgactgctgctcaagcaaaatgtccccgtcgacacgacaattgtcgatcacatcattcatgcggttaaaacaccgcagcagcgttgatttgccacagccggagggaccgattaatgcggtaatccggtttttaggcagttgtagcgagatatcatgaagcacctggcgctcaccgtaccagagtgaaagatgatcaacggttagcgcaatatcagtttcgggcattgtagtcatcgtcagttattgagtcatcaggcgatagcgttcacgtagacggtgacgcaggcccatggctaacaggttcagcaacagaataattaacaccagcagcagcgccgtggcaaaaaccaacggacggtcggcctctgtattagggctttgaaaggctaaatcataaatctgaaagcccagatgcatgaatttcctgtcaaggtgcagataggggaagacggcatcaacgggcaattccggtaccatttttactacgccaaccaacatcaggggggcggtttctcccgccgcgcgggccaccgccagaatcagcccggttaacatggccggaaccgccatcggtaacaccacattccacaaggtttcggcctgggtcgccccgagcgccagcgatccctgcctcagactatccggaatacgtgataacccctcttccgttgccacaatcaccaccggcagggtcagcaaggccagcgtcagcgatgcccaaagtaagcccggcgtaccgaacgtgggattcggcagtgcgctgctgtaaaacagccgatcgaccgttccgcccaccagccagacaaaaaagcccagaccaaacacaccatagacaatagagggcacgcccgccagattcaccaccgcgatgcgcaccagccgagtcaacgcattacgtccggcatattcatgcagccagactgccgcgatgacccccagcggcatgaccaccaccgacatcagcagcaccatcagcaccgtgccgaacagggcggggaaaacgccaaaatcgctttcgccctccgcaggtgaatcgctgacaaagcgccacaactgctgtaagaagtgccctgttttttctgttagcgtcatggcgttgggctgccaggcggccacaatctgcgacagtgggatgctgtgctcaatgccattaacgtcacgcagaatcaacacgtcacgctcgctttcttcttgcaggttgttgagtctttcattgagctggataagccggcgttccagggctgcctggttagcgtcgtattctgactgcgcctgtaaatcgaactgcttttcctcacgctgctgttcagcctgatcgtctaactgatccagttgttgattcagctgagccatatcaatacgacggatctcgctggcctggcgcacagtgagctgtacctgttcgagtcgctgctgcagtagcgcatggatgttctttgccgtcagcgcctcattgtcttcgcgcaagccgacaagccagccgtaagcattgccgtggctgcggcgctgtaacaccatgatatcgtccggctgactgaccgccggtgcggctttgctgagcgcaatacgaaaatcgggcgcggcccagtcgcgattgccggtcttgatcaggtagcggtgcagaaaggctcgctggccgtctgtcccttcagcgggtgccggatacgtcgactgccgctcaagggtttcacccagcaggcgggtttgactgccgtcgggctgcgtaaacgtatagagttctactctgtggggccaaaacgtccgtagcccctgccatcccagcaacccaatcagtaaggtaaacgccagcagacacaccgtcacggccccggccgttaaccagcgccagcggtcgttttgtcgcatcaccttcatgcctgctccttatactgactgaagcgcaggcgcaggcgctggcggatgagttctgcaaaggtattaatgatcatcgtaaaaatcagcagcaatagcgcacttaagaacagaatccgataatgggcgctgcccaccgcggcttcgggcatctcaatcgcgatattggcggaaagtgtacgcaggccgctgaacaagccgccttcactttgcggcgtgttaccggtcgccatgagtaaaatcatggtttcgccgaccgccctgccaaagccaatcatcagggcggcaaagatgcccgccgaggcgcccggcagcaccacgcgcgtcagggtttgccagggcgtggcacccagcgccagtgaaccttgtcccaacgaggccggtacgctaaacagcgcatcctctgcaagggtgaaaattaagggcaccagcgcaaaccccatcgccagcgctgccaccagcaggttacgttgctcgtaatgcggtagccagtcgccggcatccggtacgatcagcgtcggcagccacaacgttagcagagtgacaacaagcagcacaggcagtaataacagcacctcgcgccccggctgccgccagcgttcaggcaggcgatggctcactacgccgcacccgagcaggctgccggcaagcgtgacgggcagcaacagcacgccaattaacgcctgacctacatggggcgctaaccataatccggctatcagtccgatcaccacgctgggcagtgcgcccatcatctcaatcgcgggcttaacccaacggcgcaagcccggcgccataaaccacgcagtatacatggcagccgccagcgccagtggtgtcgcaaacaacagtgccatgctggccgctttcagtgtgcccacaaccatgggaattaagctgaattttgcctgatagctgtcgccagcattcgtggattgccagacccagtcgggtttagggtagttttcataccagattttttgccagaaattacgccaggtcacatccggccaggcattcgtcagcttcagcgtttcccagcctgactgccgttccagcaacaggctgtcgccatggggtgagaattgcgcctgaagaatgccgggggccagctgacgttgcaggatcggcccattctgtttactggcaaagactttcagcatgccggcgtgatcaaaagtggcgaaaacccgtcgctgtggctcgctgatgatcgtggcctgtccggtgctgtgttcaaaagtacgcacagggtgtaagcgcagaccgtgctcacctgcgatggaaaaccactgggtaatgccgctgtcatcctggatcagcagggtttgccctccagccagtaactgcagctgttgaggcacctgaggcagcgtctgcgtttcgcgcagccatgctcgcccgtcatcaatttgccagacccgcagcaggtgaccttcggtggtatacagcaggtcaccttttggcgacagtaacagatgttggggctgctgggctggcagcgtaatcagcgatgcctgctggttagtgcccagcgtcagtatgcttaatcctgcgtcacctgaggcggcaatgcgccactgttccggggtaatcgtggcgagcgccatcttttttatgccaccctgcggcagccgaaacacgttatcacctagcggaaaatgccactcgccctcgccctggcttatcaccggttgcagcagcgttaagttgccctgggcattaagcagtaatgtcctgtcgtctgcgctggtcacgatttgctgtggaacggatgacagtgctaaagccggagccgccggttggccattcagcggaataaatcgcgccttaccatcactgctgatgcgccagcccagggttccctggttgccaatcgccagggccggggccgagtcccacagtcgttggctgctgatgctttgcacgcccggcgcgctgaacagcggcaggaccacccaaagcaaccagaagaacagcagcatcatcagtagcagaatagccaccccgcaagacgtgacgaggcgccgcgtaaagcggtcaatcgcacgtcgtcggcgatcgctaaactgcacaggaatatggtttacgctcatgcggccctgattatccggcggaaatgagtcgctatgttgcccgtagctggttgataagacaacttttgccgttggacaaccttgccatactctcgccataatgcagttggatactgtatcgtcgtcagtcctgcaaccgtcatacggagtgagaatgggtcaggtaaagctttatatcgaaaaagaaatgagctggttgtgctttaacgaacgtgttttgcaggaagcggcagataaaagtaatccgctgattgaacgtatgcgtttcttaggtatttactcgaacaacctcgacgaattttacaaggtacgttttgccgatttgaaacgacgtatcctgattggcgaagagcaaggctctgccagtacgccacgtcatttattaaagaagattcaacagcgcgtcctgaaatcagatcaggaatttgatgccctgtataacgacctgctgctggagatggcgcgcaatcaaatcttcctgattaatgagcgtcagctttcccccaatcagcaaagctggctgcgccactatttcaagcatgaactgcgtcagcacatcacgccgattctgattacccatgaaaccgacctgaccgagtttcttaaagacgattacacgtacctggccgttgaaattattcgcggtcaggatattcagtacgccctgctggagatcccctccgacaaggtgccgcgctttattaatctgccagctgaaccgccacgtcgccgtaaacccatgatcctgttagataacatcctgcgctattgcctggatgatatcttcaaggggttttatgactacgacacgctcaacgcttattcgatgaaaatgacgcgtgacgcagagtacgatctggtaacggaaatggaatccagcctgctggaactgatgtcctccagtctgaaacaacgtctgacggctgaacctgtgcggtttgtttaccagcgcgacatgccggactcgatggtggcgctgctgtgcgacaaattgtcgatttcaaattatgactccgtcctggcgggcggccgttaccacaactttaaagattttatcggcttccctaatgtcgggaaaaacaacctgattaaccggccgatgccgcaaatccgtcatattggctttgatggtttccgcaacggttttgatgctatccgtaatcgcgacgtgctgctttactatccgtatcacaccttcgagcatgtgctggaattgttacgtcaggcgtcattcgacccgagcgtgctggcgattaaaatcaatatttaccgcgtcgccaagcattcccgcatcatggatgcgatgattcatgccgcctataacggcaagaaagtcacggttgtggtagaacttcaggcccgctttgatgaagaggccaatatttactgggcgaaacgtctgactgaagccggtgtacacgttattttctcggcacccggcctgaagattcacgccaaactgtttttaatttcccgacgtgaaggcgaagagatcgtgcgctacgcccacattggcaccggtaacttcaacgaaaaaacggcaaggctctacacggactattccctgttaaccgccgatgctcgtatcaccaatgaagtgcgccgggtgttcaactttatcgaaaacccttaccgtccggtgacctttgaccatttaatggtttctccgcaaaactcacgtcggatgctgtatgatttgatcgataacgagatagccaatgcccagcaaaaacgccccagtgggattacgctgaaaattaacaacctggtggacaaagggctggtagacaggctttataccgcatccagcgtgggcgtaaatgttaatttactggtgcgcggaatgtgctcattgattccagacttgcccgggatcagtgaaaatattcgcgtaatcagtatcgttgaccgcttcctggaacacgaccgtgtttatatttttgaaaacggtggtgataagaaagtgtttctttcatccgctgactggatgacgcgtaacattgattatcgcatcgaagttgccgtagcgatccttgatccacaaataaagcagcgcattctggacattattgctattcagctcagcgacaccgttaaagcccgggttgtcgataaagagctgactaaccagtacgttcagcgcggcaatcgtcgtaaagtgcggtcgcagatggctatttacgattacattaagaagctggaacaacctgaataacgcctatgccaatctcccaaaaaagtacgccgaaacctcaagagtttgcggcaattgaccttggttccaatagtttccacatggtaattgcccgcgtggtggatggtgctttgcaggttctggggcgtctgaagcaacgggtacatctggccgatggtctggatgccaaaaattacctgagcgaagaggcaatggaacgcgggctgaactgcctggcgctgtttgctgaacgcctgcagggctttaacgccagcaacgtgacgattgtgggcacccatacgttacgccaggcggtgaacgccgaaacctttttgcagcgtgcagcagaggtcattccctatccgattgaggtgatttccggccacgaagaagctcgcctgatttttatgggcgtcgagcatactcagccagaaaaaggccgcaagctggtgatcgacatcggcggcgggtcaacggaattggttatcggcgaggattttgagccgcaactggtggaaagccgtcgtatgggctgcgtcagttttgcccagctttatttccctggcggtgaaatcagcgtagagaactttcgtcgcgctcgcctggccgccactcaaaagctggaaacgctggcgtggcaatatcgtctgcacggctggcagtatgcgctgggcgcatcgggcaccatcaaagcggcctgcgaagtgctgctggccatgggcgagaaagagaagctgattacgcccgagcgcctgaccatgctttacgatgaagtgattaagcacaaatcctttgcggcgctgagtctgccgggtctgtctgaagagcgtaaaagcgtatttgttcccggcttagccattctctgtggcgtgtttgatgcactcgccatccgtgagctgacgctgagtgatggcgcactacgggaaggcgtgctgtatgaaatggaaggccgtttccgtcatcaggatattcgcagccgtacagcccagagcctggctaatcactatgccatcgacagcgatcaggcccggcgcgtactggaaacgactgaacagctttatctgcagtggcgcgatcaaaatcccaaactggcgaatccccagttggctgcgctgttgaaatgggcagccatgttgcatgaggtcgggctgaccattaaccacagtggtttacagcgccattctgcctatattttgcagaacactaacctgccgggcttcaatcaggatcagcaaatgctgttggcggcgctggtcagatttcaccgtaaagcggtgaaggtggatgagctgccacgcgtgacgctgttcaagaagaagcagtttttacccctgatctttctgcttcgtctgggcaccttactgaacaaccagcgccaggccacgacgcgcccggattcgttaaaactgacctgcgatgacggtcactggacgctcaccttcccggcaggctatttcaatcagaataacctggtgcaactcgatcttgagcgtgagcaaacctactgggatgaagtaaccggctggaaactgattctcgcagaagcctgacaatgcgggcattgactgcccgcatcactgaaccgacgacgatgacattacgaaccgataattattttgccgagacctatggcttaacaccgacccattctgaagtggtcgaagccttacctcagttgacgcccggaaaagcgcttgatctgggatgcggaagcgggcgtaacacgctgttcctgaatcaacatggttttgaagtcacggcctgggaccataatcccgccagcctggatcgcctgaattacattattgccaccgaaggcctgaccggcattcatacggcccaacaggatctgaaccaggtgcgttttaatggagcctaccaagtggtgctctccacggtggtaatgatgtttttacaaccgggaacgatcccgcagcttattgccgatatgcaggcctgtacggtgaaaaacggctttaacctgattgttgcggccatgaataccgaggacgcgccctgcccgtctgacttcccgtttgcctttaaatcgggtgagttaagtcattactaccgcaactggcatattgtgaagtacaacgaaaactggggacagctacatcgcaaagatgaaaacggcaaccggattaactgccgctttgccacgctgttggcgcagaaagccagttattaacacagttgtgttttttttaaacaacggttgatttcactgggcgactgtgactaaatattgctgtcgcccggtttgggttattacaggaattaccctgcgtgaacagcgccctttctccacgaagacgtaaaaaaagcgtcagcatgacgcggattgttttactgatcagttttatcattctgtttagtcgcctcgtttttatcctgcctgcggccttcgagcatcaccagcaaaaacaaactgaatcaccgccggtgatcacgacgctttctgacagtcgttaatcgaaaggtgtcattaacctgattaaacgacgcgcaatcccgctgcttgcgccattttttacatcccttttccagtcaaaacgctacacttcgtgcaggtgctttcagactaaagggatgcaatgtgtctgcctcacactctcaacgtttaagtgaaattcgtcatcgtattctgacgctgctgctcaatgagcacgaccttgtggatgaattactggataaagccagtcatctctcccctgagcagcaacgtgaaaatgtgatacatcgggaaatactccagcaagacatcagccagcttcacgccgctgaccttgccgatattcttgaagccttgcctgaagaagcccgactggcgctctggagcctggttccgggtgaaaaacgcggccgcgtactggtggaagcctcagaaaccgtctgggacagcctgactgaagagatgagcgatcgcgccatcctgcaggcgatggaaccgctggatattgacgatcaggcctggctggtgcgttatctgccgcgcgaccttacaggacgcctgctgacctctctggagccgaacctgcgcgcccgcatcctgagcgtgatgcagtttgaccgtgatcgcgtgggtcgggttatggactttaacatcctcacggtacgcgaggatgtcacattagccactgtgcagcgctttttgcgtaaaggcaaaagcatgccggatggcacagacaaaatcttcatcaccaatgaaaacaatcagctgctgggcgagctactgctaaccgatatcctgctgaacaaacctaagactatggtgagcgacgtgatgaattcgcatcccaccacctttcagctcgacgacaaagccgaagacgcggccagtgcctttgaacgttataacctgatctcagcggcggtgaccgatgcgcagggtaaacttattggccgtattaccattgaagacgttgttgacctggtcaacaaagagaacgaaagcaatatccgtaaaatgggcgggattagccaggaagaggatgttttcgccccggtgcgtaaatccgtgcgtaatcgctgggcctggctggcgatcaatttatgtacggcgtttgttgcatcccgcgtcattggcctgtttgaaaacactatctcgcaaattgtcgcccttgccacgttaatgccgattattgccggtattggcggtaataccggcaatcaaaccatcacgatgattgttcgcgcccttgcgctgcatcaggttgaaccgggcaacttctcgttcctgtttatgcgcgaactcggcgtagccttgatcaacggcctgttctggggcgcgattatgggcggtatcacctggcttatgtacgacaacatggcgctgggcggcgtcatgatgctagccatggtgctgaatcttctgctggcagccataatgggtgtgatggtgccgctggtcatgaccaaaatgaaacgcgatcccgccgtgggctccagcgtattaattaccgccatcaccgataccggtggtttttttattttcctgggcctggcgacgatcttcctgataccgcattgattactggttttgataaccgtagcgctgcagcgatcctatgacattcagtcgacgtgtcacctgtgccagttcgcaggtgaccgcgggcagctggtagtgattgcgctgccccagccactccagcacatcagctaaatgccagatagccgttttgccatcgtgtaccggtaacggaaactgtttgctgtgcgtcagcatcagtttgcgcatgttctgacgtgatacgccaatcaggtctgcaacatcggttaagccgacaaaatcaggcgcggcttcaaccatcaatgcgccaggaatagcagactgcacatctgctatcgcactgctgagtgcgtggctcgccgagtcggcgtggcgcgtaaattccagcgccagcttgcctgccacaccggcaccgaccaatgcatcatcgcatcctgcctccgccagtttttccagtaacgcatcaattgaccccgctgattcaggcaattcaaaccgcaagatgaaatgatattccgtcatattaattccctctttttaacgtatcagtaacggtacagttatctaccacgcgccgcagcgctctggcatggttatgggcattttttggggtgcgccagatacaggtcagacagtattccccacagcggcacgtcgccagatttgccgggcagtacattttgccccatgcgtgatgacccgtagccaccacgagccacccctgtgattctgcataacataaggcggcttcaatctctttgctgggatgtcgctttctgtccaccatggcgcctatcattccttgtttttatagggttgtcaactgacaactaaagtgtcattcgtgcggtacaggggcagcatgcgggctgtctggcggcaggtaaaacaggttgcggctaaaatggaaaggattacgcaaaaaagtgtcagcctgacgtgatggacgacaatcgaagataacgacggaggaaatatgtttaaaactgatgacctggtacaagcgaaaacgggcgggcccaaaatggtcgtactgcgtgccgatggtgaaacactgtggtgcgctcgcgtggacgatgccagcaaaaaggaaattgaagttaacgcagaaagcgtcaatctctaccatgaagagggcgattttggcgtctgttaaaaggggtgacgtgactcacaccgaccgcaacggataaggcaaccggccgttcggttacccgggagcctggcttccgggtaacctttactgattgccttattccgggctattcggccgtcagattttattttcctgcaggttattgctgcctaaaccaccgataaagggcagccgcaagcgaaacggggaaaagcctattcccgcgcttaaccccaaaagattgaattcaatcccctcttccgcccctaaggtgatgcctgctacgccgagtatcgacacctgaaccccacgaccagaaggtggtaaccccaccggacgccataatggccggtagtcttttcccagcgcgttggcgggcaagtcaagctgcaaggcgggcacgttacgaccgatgtgcgccataaaggtattactgttgggtccaggccaggcatgataggtggtaggccagggataggattttatggcggcttcaatttgcgggatcattttttgcgcatcggggccgtgatgctcaaccagcagccgcggttttgctccgtaccagtagccatcaggcagggatgaattgcgcctgactttatcgccactgccccagctaatcacttcgtaacgtgtatagcgggtttcacctgcacgtttaaagataatccacggatgcactgcgattgcgcctttccagccgtatgtcggtgcggcatagacctgaacaatagcctgaccggcatgagcatggggatcgggcgcaacgccagccgaatcccggcgagccgtcgcccagccaccctggccggtagcgttgttgccatgagtggcttgcgccaggctggccgcaagcgacagcaaaatcacggtgagaaaacagagactgaagattttcagaggcagcatcgcggttcctgcaggtaaaagataagggatgattttgcaatgaaatatagggtttgtattcactaactatgctgcgatgtcatcgcaatattcactcccgctggttagtggctgctgacgtaatgcccgccatcacgcaacgttaaaaggccgtgatggctttcaccaccagcatgctcagaggcgggctatacgcagaatcagccagcctgaaacccgcccaggctcaggaagtaaacagggatactcgccgcccgcattcagcgggcgaccggtctgggctgccctttgctttgcggtcagtacggaaggcgtcagatccaatcccgaaggcacgcgaagcctgcacttcacccatgcacgaagcagataacagattccaggtgcatttcatgcctggcgatttcaacaacagcataggttatcttgaacccgccgtctgaaaactagcctgttatcgccttttccgctacacgctgcaaccacgcttcatagcgccgctgcgcctccggcgcggcaggttggctgcgtgagtttatctcaccttcgatgccaaatattttccacatcagcggcgagagtccttcgatcacgctgtgttgactgctctccgttctcagccattccagactggatgtctggtagcccggcagggcctcggagtggtaatcgaaagctttgcccaacccggaaagatacatgattttagcggcagtcagggatggccagtgacgggcaatatctagcggccagtccaacatggcgcgctcattccagacctccgaatacggaacctgttggttagccagcaacgtcagcattaacgattgccccagcccggtcagatagacaggcaacgcgtcagccggaggacgttgataaaaggcatccagtggatgttcgcgcttcaggccggcctgcatcagtaattttcgctccagctcctgcatcacgttgcctaacccggcatccgttgcctcttcagtttcagtcaactgtttactgcgcgtggtacagttccacagcgacaacgcaatctgccaacgacgctgttcgccctcgccagtgcagccaatttcccccgtcaccacatacttcatgtcaggaggcaggatctcataaatatcctcacccaccatcggttggccagtgagaacaggaccatggccctccgccatcagaaaataggtgcacgccgcataatcactccagtaatgtacggcttcagccagatagagcggaatcgcgcgcgacaggcggccaagctcgtcttcacgctgtatgccctgggctgctaatccatcaggtatttttgataacgcaaagaaaccgatcttcgctgtctcttcgggtttttggttaaacagccagtcggctttgcataagccgtaatgccaaatgggctgcgtgacggataacgttgtgattttcacatcatcaggcgccacctgctgaacgggttccgtttggcgacgtttctcttcaaacgcttgtctgtaataatcaagatgctgcttgatcggggcaaaattgagtgcatacagctggttaagaagcttgagtccctgctccgtctggtcctgctcaagataagcctgcaataaatttataccggccataggatcgtgcttttgaacatcgtaatgaggcgcaaccagcgaaatcagaagaggaatctcgccatttcgtcccaggtcaccagagatcatatacagcgcgtcagaatcgtaccgtccacccgacagtacctcgtcataaagtccgcgagccttgtcggtttcgttatgctccagataaaaacgggccatccagagctgtgcccgccagcttcccggcatcgcggcaatgctgcgtaagccctcgatataggcctcatcaccaccccgctcgcgctggatgctcgcccaccagagtaagccattgtcgaggttggggtccgtttgaatggcctgccagagcgtgtcatctgcctgtttatcctcaccgcgctcggaaaagacttttgccagattggtgagtaaggttcctgtcgcgcctgatttatcgattccctggcgcagggtttgttctgccgcatccagttggccggttttcatcagtacgatgccgtgaagggtatgacttcgctcgggattgctgtcaatgtccaccaggcgctccgctgccgcaaccagatcggaagcaaaggcgtctttcaaccccatcagaatcgcggtgtacaacgcgtccgcatcatcccacttcttttccagatccggcagaaagaccttctcacgccattcattgcgtgcaatgtacatttcctgtccatgagcatcgtaagcaacaatcatctcccgttcttgagcgggctcgtctggtgcggtatcggcgggttggtttttattgcgcagagaagagagaagacgcttaaacatggttaattcaatccttgagtagtgagacatcagacagcctgattgccagccttcatcatgccgccagtgttcgcgccctgaggcggttttaccgactgacagcgtagcggcacagatatgagtgtagcgctcaaaaaaacagctggcacgaaattgattaagcaacgggtaaatcgttaaaaaaggccgtgcaatagcgatgccgcgcctcttccctttgcctttcgtcattcacattcttatcgcatcagagagaaaaaattaagtagctcgctatttaatagtttacaacacgataaaatcctgccatcttagccaaactgaatagcacactacttaatcgcaaacacaaggaaatcaaaatgaacgtgaaactcaccgcaggtgctttattgttagccagccagatcacatcagcatgggccaaccctgtggagaatgcgcctgaacctaccgttggtgtcgccgcctttcttaaagcccttaacagcggcggcggcaagcccatcgaaaccttaacgccgaaagaagcacgcgcagtgctgacaggcgcgcagcaaggcgccgcgctgccgccagcacagatttctgaaaaaaccatcacagcattgggcaaaccactcaaactgacgattgttaaacccgaacacgccagcggagtgctcccggtattcatgtttttccacggtggcggctgggtgctgggtgacttcccgacgcacgaacgtctggtgcgagaccttgtgaacgaatccggcgctgcggcggtatttgtgaactacgagccatcaccggaagcccattatccggtcgcgattacccaggcttatgaagcgacaaaatgggtagcagaacacggtgcggaaattggcgttgacggtaagcgcctggcgctggtcggtaacagcgtcggaggcaacatggtggccgccgtcgcgctgcaggccaaacaacataaaaccccggcgattcgttacgatgtgatgctgtggcccgttaccgatgcccgctttgatgatgcttcttatcagcaattcgccaacggctatttcctgacccgaaacatgatgaagtggttctgggataactacaccacgtcagataaagatcggaataacattctggcttctccgctgcgtgccactgaggcacaactggcaggtttaccgccaacgctgattcagactgccgaactcgacgtgctgcgcgatgaaggtgaagcctttggtcgtaagctggatgccgccggtgtaccggtgacggttacccgctataacggcatgattcacgactttggtttgctgaatgccttgagtaaagagccaaccgtgcgcacggcgattggccaggcgtcagcggagctgaaggaacaccttaagtaaacatcgcccgacagcggattcgtattcttttgttcgtgcggacatgcggtaaataaaatcagccggatagcaccggctgattttttctggcttaaatgctgacaggcatcagggcgtgatcatcccgaccaccgccagccacagaaccctgaccttatcaaattcccggttgctggcaccttgtactgaccccttctatcccactacttcgcctcatcaacagttgagatttcggatagccgccgcaggaacaacgttaaggattgccaggaggtttttactgaattatcgtaagccgctttgggtaccgctgacatacaattctgggccaggcattcggtataaatgcctgccgaagggacaactatgtcatatcgcatcctttggtcaatcgcgcttttagccgtcacggcggtgtggggctggagcttcgttgcgaagcacgacacgctgggcgtcatggccgcatccaccctgaacgcgtggatgtttaccctggcggcttttgcgcttctccccttttcaatccgttcttttcgccacctgaagccacgtgactgggcgcgtgcggtattggcaggcatcgtgctcttcgctgcattttccctgcagacatccggcacagcttatacaacgccctccaatgccgggttcatcacaggcttgtgcaccgttttcacgccgttgtgtatctatcttatcggcagaggacgccccagtgctaaacaggcagcaggaaccgccattgccgtgtttgggcttggcttgctcagccttgacgggttcagggtgcactatggtgatttacttattctgggttgtgcggtgtgcttcgccgtacacatcgtcatcgtgtcgactttcacaacgcctgacatttccctggcctcaacatcgatacaactgggcatcgttggcgtgctttctttgttatggagcgtcgcccgtgaccagtttgctgtacctcactcgctgccgacagcattaacaatcctgtcactggccctgttcgcaacagccctggcgtacgccattcagaatcgtgctcaggctgtgctggccccggaaaaagtcgccctgatactgatttgcgaacctgtgtttagtgggatttttggttattttctcgcgggcgatcgtctgccgccggaaagacttgcaggggcggcgttaatcctggtggggattgtcgtcacagagcttcgcgtcgtacgtctcctgcctgccgcctggcgtagatcctgagttcgcttcagcgccgtgcactgttcaacgcgaacccattttgcaggcgaaattcagtgatatccctcgccgttccggcgaagcgactatcggccagacaatgcgggatctaaaatgcaaaaagcccgcataacgcgggcttcgtttttatactgcttactgttggtctaagccggacgcgaaatcattcccactcaatcgtcgccggtggtttgcccgaaatatcataaaccacccgggaaatgccgttaacttcgtttataatgcggttggacacgcggcccaggaagtcatatggcaggtgcgcccagtgggcggtcatgaagtcgatggtttcgaccgcacgcagtgagacaacccagtcatatttacggccatcgcccatcacgccaacagaacgcacaggcaggaagacggtaaaggcctggctgactttgttgtagaggtcggctttgtgcagctcttcaataaagatggcatctgcacgacgcagcaggtcacaatactctttcttcacttcacccagcacgcgtacgccaaggccaggccccgggaacggatggcgatagagcatatcgtaaggcaaacctaactccagaccgatcttacgcacttcgtctttaaacagctcgcgcagcggctcgaccaggcccatcttcatctcttttggcaggccacccacgttgtggtgcgacttgatcacgtgcgctttaccggtagccgaggcagcggattcaatcacgtcaggataaatagtgccctgcgccagccacttcacgtcctgcaggcgcagtgcctgttcgtcaaacacttcgacgaaaacgcggccaatgattttgcgcttcgcttccggatcgttttcccctgccagggcatccaggaaacgtgcttcgccgtcaacgtgaacaatattcagaccaaaatggtcgccgaacatgtccagcacctgctcagcttcattcaggcgcagcagcccgttatccacgaatacgcaggtcaggtttttaccgatggcgcgatgcagcagcatggcagtcactgacgaatccacaccgccggataagcccaggatcactttgtcgttgccgacctgcacacgcagacgctcgacggcatcctcaatgattttcgccggtgtccagagcgcttcacattcacaaatatccatcacgaaacgttccagcatgcgcagtccctgacgcgtgtgcgtgacttccgggtggaactgcacgccatagaagcgtttctcttcgttagccatgatggcaaacggacaggtttctgtgctggcgaccgtaacaaaaccatcagggatagcagtcactttatcgccgtggctcatccagacatccagcagcggtttaccggccgcgctgatggcatcttcgatatcgcgaatcagcgcgcttgcggtgttgacttcaacctgcgcatagccaaactcgcgctcgttggacccttccaccttgccacccaactgcatcgccatggtttgcatgccgtaacacacacccagaaccggtacacccgcagtaaacacatagtcaggtgcgcgcgggctgtcgttttcggtggtactttccgggccgccagacaggatgatgccgcttggattgaactggcgaatctgcgcttcggtgacatcccacgcccagagttcacagtacacgccaagctcacgtacgcggcgcgcgaccaactgagtatattgagaaccaaaatcgagaatcagaatgcggtgcttatggatattttccgtcgtcattgaggggtttccagaacggtgactttaagtaaagcgcccggctgttgccgggcgagaaatcttacggggttatgaacccatgcggtagtttggtgactctttggtgatggtcacatcatgcacgtggctttcattgatgcccgcaccgctgatacgcacgaattcggctttggtgcgcaggtcatcaatggtctggcagccggtcaggcccatacaggagcgcaggccgcccatttgctgatgcacgatctctttcaggcggcctttataggccacgcggccttcgataccttctggcaccagcttgtcagcagcgttatcggtctggaagtagcggtctgatgatcctttagacatcgcgcccagcgagcccattccacggtaggatttaaaagaacggccctggtaaagttcgatttcacccggtgattcttcagtacctgccagcatcgatcccaccatcacacaggacgcgcccgccgcaatcgccttagcgatatcaccagagaaacgaatcccgccgtccgcgataaccggaatgcccgtgccttccagcgcggcaacggcgtcagaaacggcggtaatctgaggtacacctacaccggtaacaatacgggtggtacaaattgagccagggccgataccgactttgaccgcgctcacgccagcttcaaccagcgccagcgcacctgcacccgtcgccacgttgccgccgacgatttcaagctcaggatatttagcgcgggtttcgcgaatacgttgcagcacgccttcggagtggccatgagatgaatcaataagcagtacgtccacacccgctgcaaccagggcatccacgcgctcttcattgcccgcacctgcccccacggcggcaccgacacgcagacgaccctgcgcatctttacaggcgttaggtttacgttcggctttctggaagtctttaacggtgatcatgcccagcaggtggaaactgtcatccacgaccagcgctttttctacacgcttttcatgcattctgtgcagcacgacatcacgggcttcgccctctttcactgtaaccagacgttctttcggcgtcataacggcagtgacgggctgggtaagatcggtgacgaagcgcacatcgcgaccggtgataatgcccaccagttcgttgtccgcgttcaccaccggatagccggcaaagccgttacgttcggtcagctctttgacttctgccagcgtggtggttggcaacacggtctgcggttcggtgaccacgccgctttcatgctttttaaccttacgcacttcatctgcctggcgctcaatcgacatatttttgtgaatgaagcccagaccgccctcttgcgccagcgcaatagccagacccgcttcggtcacggtatccatcgcagcagaaagcattggaatgttcagacgaatgtttttggtcagttgagtgctgagatcggccgtattgggcaggacggtggagtgtgcaggaacgagcaggacgtcgtcaaaagtgagtgcttctttagcgattcttaacatggcaatactccaccttgggtgcgtgagaatagataaaatattgccgcggcattatacaggccgtaatcgattgcctccactattatttaataaaaagtcttgatccgcacaatcagcaatgtagtatcgactgattaacctactgatttggaatttgatcttcgtcacatgtcgctgccgccaaacgccaatatttttaccgtcagccgtctcaataccacagtgcgtcagctgctggaaaatgagatgggtttggtttggctcagtgccgagatctccaattttacccagcctgcctccggtcactggtacttcaccctaaaagatgatggcgcacaggtacgctgtgccatgttccgcaatggcaatcgtcgcgtcacgtttcgtcctcagcacggtcagcaggtcctggtgcgcgcgaacatcactttgtatgaaccgcgcggcgattatcagctgattattgaaagcatgcatcccgctggtgaaggcctgttgcagcagcagtttgagcagttgaaagctaagctggcacaggaaggcttatttgagcccgggcacaaaaaacccttaccccaaccggctaaacaggttggcgttattacctccgcgaccggtgcagccctgcacgatgtgctgcgtgtgctgcatcgtcgcgatccgtcattgcctgtggtgatttaccccaccgccgtacagggcgtggatgcgcctgccgctatcgtgcgcgccattgagcttgcgaaccagcgtgcagagtgcgatgtgctcatcgtggggcgcggcggcggttcgctggaagatctgtggagttttaacgacgagcgagtcgcgcgtgcgatttttgccagtcgcattcccgtggtcagcgcggtgggccatgaaaccgacgtgactattgccgattttgttgccgacctgcgcgcgccaacgccttctgccgcggcagagattgtcagccgtaatcagcttgaacttctgcgtcagctgcagtcacaacagcagcggctggaaatggcgatggattattatctggcacgccagcagcggagctttagccgtttagatcaccgcctgcaacagcagcatccgcagttgcgcctggcccgccaacagactgcactgtttcgcttacagcagcgcctgagcgaagcgatggaagtgcggctgcgcaacgccagccgccagcaggatcgcctgtcacagaggctggcacagcagcaaccacagcagcgcctgtatctggcgcaacaaagcctgcaaagctggcattatcgcctgcaacaaagcatggagaaattgcttaaccgcgacaaaaaccgcttcggtcagcttgcggcccagttggaaggcgtcagcccgttagccaccctggcgcgtggcttcagcgtcaccaccgacaacgcaggtcaggtggtgaaaaaaacacgccagttaagcaacggcgatttactgcgtacccgccttgatgatggctgggtagaaagtcaggtcactcagctgattcctgaaaaaccgaaacgaaagaaaagcatttcttaactatacttcctggtacatccctcgtgccaaggagtctacaatggctttcagcgttatacctccctacattcttcgtaagattattgctcacggttccggctatcagcaggagcaggcgcgccgtacgctcacccacgttcagcacctgatggcggagcactggcaaaagaccgctgcacccaagaccacgcaggccgggaagattgagcgtgaaatctatgacgccaaaaatcaggaaacgttgccaggcaccctggtgcgtaaagaaggccagtcctcaaatggtgacattgccgccgacgaggcctggaactatcttggcgtaactcatgactttttctggcaaatatataaacgcaattctctggataataacggtttgaaattagctggcaccgtgcattatggcgagaaatatcagaatgccttctggaatggtcagcagatggtattcggagacggcgatggtgaaatctttaaccgctttaccatcgctatcgacgttgttgcgcatgagttatcgcacggtgtcacagaaaccgaggccggtttgatctattttgaacaggctggcgcactgaatgagtcgatgtccgacgtatttggctctctggtgaagcagttcagtaagaaacagacggcggagaaagccgactggattattggtgaaggcttgctggcgaaaggtattcacggtaaaggcttgcgatcgatgtcgcaccccggcaccgcttatgacgatcccatgttgggtaaagacccgcaaccgggccatatggacgattatattaaaacgcgtgaagataacggcggtgtgcatctgaattctggcattcctaaccgtgccttttatctggcagcaaaagcattaggtggatttgcctgggaacaggcagggcaagcctggtatgacaccttatgtgatgataatttgcatcaggatgctgactttaaagcctttgcacagttgaccgtgcaacacggtgaaaagcgctttgatcgttctgttggtagcaaaattgaacaggcgtggaaagaggtaggcgtattatgagtcaactccccgaacttaccgatgacgcaaccattgtggttacgcgtgaaggtggctttgcttttattcccggcttacgtagcgagcgtcgttttcctttgggtgaacttcctgcgccagagaaacagcgcgtctgtaaagtgctggaacaggcgatgccgctgtgcgaaccagaggaaaaagcggctaaggtaggcggcggggaccagcgctattttcgtatccagatccagtacgccacgcgccgtgaagcaggcactgtagtgctcctgataccggagcagtcggcaccgccggagctggcgtcgctcttccgcgacggaaaataagcagaaaaaagggccgctagcggcccttttcttttatccgttacgacgtgctgttacttgctgtcaggcagcgcataagcaatcacgtaatcaccgcgatccggtgactgacgtgcaccgcctgccgagatcagaatgtactgcttaccggtttttggtgagacatagctcatcgggccgccctgacttcccacaggcagacgcgctttccacacctctttaccggttgcgctatcgaatgcccgcagatagtaatcctgggtgccggcaataaagaccagaccgccctgagttgccagcgtgccgcccagcgttggcataccgattggcattttggcgcgcattttaatcccaaacggaccggtatcctgtacggtaccaaccgggacctgccagacgattttctgggttttcatatcgatagctgacaaggtaccaaacggcggtgcctggcagggaatgcccagcggtgacataaagcggttcttgttcaccgcataaggtgtgcctttcagaggaacggcgcccataccggtattaatcgcttcaccgccgttgctgccacgggaaaccttgctggtatccaccggaatcatctgtacccacaatcctaaacgcatgtcgttgacaaacaacaggttgttatttggatcggtggacatgctgccccagttcatcccgcccagcgagccagggaagctcagcgacttatcggtgcccggcacggtaaacaggccgtcatagcgcatggatttaaacgcgatacggcaggcaagctgatcgaacggcgtggcgccccacatatcagactctttcagtttctgattgccaatcattggcataccggtcgaatgcggctgggttttcgtatattgctcgttcgggatatgcccctgcggcatcggcagctcttccactttagtgagaggcttgccggtcagacgatccagcacaaagatcatgccggtcttgccgccgataaccaccgcaggtttggtgctgccgtccttcatcgggaagtcgatcaggctgggctgcatcggcagatcgaagtcccagagatcgttatgtacggtctgataaacccacttctctttgccggttgtggcatcaagcgccagtaccgaggcaccgtatttatggtccagtgcgttgcggttcgcaccccacagatcgactgaggagcttcccattggaataaacacggtgttcatggccggatcataggacatgggtgcccatgagttcggcgtactccgcgtgtagtccttacctggcatcagaatggcatttggatcggtattgcccgggtcaaaggcccaacgcatctggccggtgatcacgtcaaatccgcgcaacacaccgccaggcatgtctgttttaacgttgtcagccacgcgcccgcctacaacaaccgttgtaccggcaatcgtgggtgcagacgtgagctgataaaggggatcgggcgcatcacccaggcccgctttgagatcgacgatgccgtggttaccgaagtcctcacagaattcaccgttgtcggcattgatagcaataagacgtgcatcaatggtattcatcagaatacggcgctggcagctgtctccggcagccagggtcacgcctgggaccggcgttgatcccggttgagttggctgggtaagcggtttggtggcatcaaaataggccagtccacggcagcgcggccagacttctgcctgggcattaatttcacgcttccaaatctgcttgccgctgtcggcttcaaccgcaatcacattgttgtgcggggtgcaaagatagacggtatttcccacctgcagcggggtttgctgatcttcagcaccattgccggttgggctttctggaatatcgccagtgtggtaagtccaggcgacctgcagatccttcacgttatcgcgggtgatctggtccagcgcaacaaaacggcttccccctgcggtattcccatagtggtcccagttttgctgttgctttgacttatccaccgggatcagcggcagctcctgtccggttgaagcaacggtaggatgaggctggaacatctgcactaatgtggcaaccatgcctacggcaatgacggcagaaaaggcatacgagacttttgccagagaaggcttattttcacgcttacgcagcgcgggccatgtgatgaatgccaggatcattaaacccgcaggcaccatcagacgggaaaccagtggccagaaatccagcccggcatcgataacggcccagattaacgtcccgacaaacaccagcaggaacaggaccactgccgatgatttggcacggacaaactgaatggcggacagcaccatcacgatgcctgcaatcagaaaataccaactgccgcccagcgtcgcgagttttcccccgccaacagcaaagaacaggccggttgccagtagcaccagcccgagcagcacggaccatattctcaaccctttaccggatcgagatgatgtttcagccataacacttactctcctgataaacaaagccgctcctgtcctgtgcgacccggctcatcgccggtcacggtgcaggtaaaagaaacagcgttgttttattccaattaaagcggacccgcgttcatgaaatgaatgatgtgttccggaggcagcccatgctggcgtgactccgtcatgacgcggcaaaaattgtaccacctggtacgttatcccgtgaaggtttaaacgtgttcgttacgaagcaatagcattttcgctacaaatttttacgccgttaccgttacggctcgcagcgtttggatcgttatgtgttgcaggttgaagcacccaagcgtcaggcaggaacaatcctgtaagtcagacgatgttttgaaactaagccgtgaccatgattacaaaagtagtcagtcgcgccgcagcttctgagttgctcaaggggctgatggcagtcggggcagacaggctgatagtgataacggacaccacaacctgtacagataagatcggtggcgtccggggctaagggttgctgacatttttcacaggttgcgctcattttttttcatccggccaggcaaataagcgcaattctaggacaaaaaaaagagggccatttggccctcgatcagttaacgcttatttttcttcatatgcgccatcaaacgcttgcgctttcgctgttgcgtcggcgtcagcagattgcgtttgccttcataagggttttcaccctctttaaactgaatgcggattggcgtccccatcacgttcagtgaacgacggaagtagttcatcaaataacgtttgtaggagtccggcaggtctttaacctgattaccgtgtatcaccacaatcggtgggttataaccgcccgcatgggcatatttcagtttaacgcgacgaccgcgaaccagcggtggctgatggtcttccgctgccatgttcataatgcgcgtcagcagtgacgtgtttactcgcttcgtggagcaatcgtatgcttccgtgacggactcaaacaggttgcctacgccgctgccatgcaacgccgagatgaagtgcacgcgcgcaaaatcgataaagcccagacggaagtcgagcgtttctttgacttcgtcacggacttcctgcgacaagccatcccatttgttcaccacgatcaccagtgaacgtccgctgttcaggataaagcccaacagggacagatcctgatcggaaatgccggcacgcgcatcgatcaccagcatcactacgttagcgtcttcaatcgcctgcaacgttttgattaccgagaatttctcgaccgtatccgtgatttttccgcgcttacgtacgccagcggtgtcgatcaacacatactcgcgaccgtcacgttccatgggaatgtagatactgtcacgggtggtgcctggcatgtcgtaaacgaccacgcgatcttcaccgagaatacggttagtcaacgtagacttaccgacgttaggacggccaacaatcgccagcttaattggcaaggttgtaggatcgaaatcatcctcttcttcctcttcctcaccgttttcttctgccgctaaggctgcccagtaagcttcgttttcgtcttcttcggtcatctcgaccggatcgaccttctccatccacggcagcagggccgtttcaatcaggctggtgacaccgcggccatgagaagcggcgatggcgtgaatctcacccagccccagagaatagaagtctacgaccgcctgatccggatccagtccgtcagttttattcgcgaccagaaacgtcgctttttggcgagagcgaagatgttttgcaatttgctgatcggcggccatcatgcctgcgcgcgcgtccaccataaacagcacaacgtctgcttcttcaatcgccagcagcgactgctctgccatacgcgtttcaacaccgtcttcggtgccatcaataccgccggtatcgataacaataaattcgcgcccttccacttcggcgcgaccatatttgcgatcgcgagtcagtccaggaaaatccgctaccagcgcatctcgtgtgcgggttaaacggttaaacagcgtagattttcccacattgggacgcccaaccagcgcgaccacaggtaccataacaatgcctcaataatgtattaaatcgcccgaatggcgtgattataacggctttagccgctcagttcaggcttaaggcgctaaggataccatgcctgactaaaaacgaaacggcccctgatgaaatcaggagccgttgtgccggaaggataaccctgcctgacaacttacccgttagcgggtaatggcgtaaacttcaccgtcttttgactgaatcagcaacttgtcgctggcgacgactggctcagtctggaagcctgaactgtccagcttttgctgggcaacaaaacggccgtcggtggtgttcagccagtgcagatagccttcgctgtcaccgaccacaaggtagccgttatacaggaccggtgaagtcagattgcgatgcagcagatcactttgacgccagatagccacaccgccatccgcgttgagggcaatcacgcgatcgtcctgatctaccaggtagatgcgacccgcatccacaatcagatctttcacaccgccgatttcacgtttccacaaaatctgaccagaacgtaaatccagtgcagtcaggttaccgttgtaggccaacgcatacacaacgccgttaacaatgaccggcgtggtatccacatcgctcagacggtcgatttctgtcgcaccgctcggctgtgaaatacgctgctgccaaatcagctggccctggttcagaataacggcgctcacgcggccgttatcgccacccacgattgcgccaccaaaggcaacagacggggcagattcaccgcgcagtgacagcgcaggcatatccaggttaacggtccattttactgcaccgctggtttgatcaagtccctgcagcataccgttgctggtgtgaaccagtaccaggccatcgctgaccaccggacgcgacagcgcttcgcccgcggctttggcttgccatgcaatcgcaccatcgctggtgttcagtgcatagacctggccacgttcgctgccgatgtagaggcggtcgccactcacggtgataccgccagacagcatggcagagcggtttttcgagaagaagccggttttctcagagagatcgactttccatttttctttaccatccgccgcgtctagcgcttttacgataccaaagcggtcagcagcataaacggtgccgtcttgccaggtcgggtgcaggttagagtagaaatcaccgattccatcacccacgccagtgctccacacggtctgaggcgtgaactgattttccaccttcggcaatggggccattttcactacatcttcttcgccgctgaacagcgagcaaccactgagcaaggtgactgagatcagccccggcagcaggtatttacgtaattccatgcgctctctcttgactggcttagcttaagttattcatcttcatctgcatcatttgcttcagtgcaggagacgcatcagattcgacgcctttactccatgcatcgcgcgcgccctgcttatcgcctttgctcagcagcgcttcgccgcggatgtcagcgacaatggctgtccagccatcacccttcacaccgtcaagggttttaagtgctgcatcagcctgattttgttgcagttgaatgcgtgccagacgcaggttaatgaccgcctgcaggttggcatctttcgtgtctttcaatccgttttgcagcagggttgcggctttgtccagctgattgctgtcgacatactgcttcgccagatccagtgccgccagggcaccgtaggtattactgttttcgctggcgaaagtgtttaccgcttccagcgtttctggcttaccggcctgcatggcactggtgactttctggtattcagctgacacggttttagctgaatcctgctgatggctggaccagtaacgccagccgcccagcgcagcgatcccgatgacgacaccgacagctaaggctttaccgttgttggcgaaaaagcgacgcagcgcatcaacctgttcgttctcattgctataaacttccacgcaatccttctcctttcaatggttgtgctgtgacacgcttactgcaagagcgtgcgcagtgcagcagccgcatccgcctgcgccagcgtttgctgttcgccattgcgcagatctttaatcacgacctgaccggccttctgttcatcttcacccagcaccagagcaacgcgagcgccccacttatccgcacgggcaaactgcttcttgaagttaccgccaccaaagttggtcatcagtttcatgtcgggcagttggtcacgcagcttttcagccaactgcatcgccgctgactgaaccccctggccggaagcgataacatagacatcgacattgcgcgcgggttcaaattccggattaaccgcctgcactaacaacaccaggcgctccattcccatggcaaaaccaacagcaggcgttgcccgaccgcccagttgttcgaccaggccatcataacgaccaccaccgcaaacggtgccctgcgatcccaggctgtcggtaacccattcaatcaccgtgcggttgtaataatccagcccgcgcaccaggcgctgattgaccgtataggcaataccggcgtcgtccagcagcgcacgcagaccgtcaaaatgctcgcgtgactccgcatccagataatcgcccaactggggcgcatcatttaacaacgtctgaatatcggggtttttgctgtcgagtacacgcattgggttgctgtacatgcggcgcttgcagtcttcgtccagcgcgtctttgtgctgttccagaaatgccaccagcgcgtcgcgatagctggcacgggcttcaagcgaaccaatggagttcagttccagacgaacatgatcggcgatgcccagcgctttccaccagcgcgcattcagcataatcagttcggcatcaatatccggcccctgcaggccaaacacttcaacgcctatctgatgaaactggcgatagcgccctttctgaggtcgctcgtagcggaacatcgggcccatgtaccacaggcgctgttcctgattataaagcagaccgtgttcgatacctgcacgcacgcagcctgccgtcccttccggacgaagcgtcaggctttcgccattgcgatcgtcaaaggtatacatttctttttcaaccacatcggtaacttcaccaatggcgcgtttgaacagaggagtctgctctacgataggtaagcgaatttcgctgtaaccatagttcgccagcactgacttcagtaccgcttcaatccgttgccagatggccgtatccgcaggcagaaaatcgttcatcccgcgaatcgcttgaatattcttcgccacgttaaaatctcttaatacaaaaaaacctgtccggcatcatacctcatgaggatgaaaccgcacaggctcagctaaaaaagtcatgcatgccgaacaggaaccggattatttttccagttgctgcacgtcaatacgacgggattcatccagcatggccgctttggcacgaatgcgcgcttccagttgatcgatcatatcgtcattatccagacgcacgcgctgacgcacgccatcttcatagaagccgcttttcttgttgctgccggtcacgccaagcgtggataccgtggcttcgcccggaccattcaccacacagccgataatggagacgtccatcggggtgatgatgtcttccagtcgctgctccagagcgttaaccgtaccaataacgtcaaattcctgacgtgagcaggtcgggcaggcaatgaagttgataccgcgagaacgaatgcgcagcgacttcagaatatcaaagccgactttcacctcttcaaccggatcggcggccagagaaatacgcaacgtgtcaccaatcccttcggccagcaacagccccaggccgatagcggacttcaccgcacctgcgcgcgcgccgcccgcttcggtaatcccaagatgcagaggctgctcgatttgttttgccagcagacgataagattcaaccgccagaaaaacatccgaggctttaacgctgactttgaattgatcgaagttgaggcgatccagatgatcgacatgtcgcatcgctgattccagcagggcctgcggtgtaggttcaccgtatttttcctgcagatctttttccagcgatccggcgttaacaccgatacgaatagggatatttttatcgcgggcgcagtcaacgacggcgcgaatacgctcgttattaccgatattgcccggattaatacgcaggcagtccacgccgtattcagccactttaagcgcgatacggtagtcaaagtggatatcggccaccagcggcacattgacctgctgcttaatcagcttaaaggcttctgcggcatccatggtcggtaccgaaatgcgcacgatatcaacgcccacgcgctcaagggctttaatctggtttaccgtcgcggccacgtcagtggtgcgggtgttggtcatcgactggacggcgattggcgcgccgtcgccaacgggcacctggccgacgtaaatacgtttggacttacggcggataatgggtgcttggttatgcatatttcttctccacaattgcccggtacacgcgatacgctgttattgcgcacccaacgtcaggcgagcaacctggttattacggataaaacgacttaaatcaacgggtttattctgatattgcacctgaacaacggatggcgcgccaattttcagacgataaggtgctgtgcctgacaggctcagcttgccgccgctacgctgaataccgctgaacagttttttaccggtagcatccgtgacgtccagccagcagtcgcccgtaaaggtcatgaccactgaattgggatcggcagccggttcgctgaccgccgctgcgcctactggcatctgctgcgcagtgttggccggtgcagtgctactggtatcagtcggtgcctgcgaaggcgacacgaccgcgttgttctcttcctgctgcgtcgccgcagccgtgttattgccgttactgctttcagcgggggccgtgctggtcgctgcgccagtgttagccggtgtactgctggtattattgttcagcggtacgctggtgctgttatccgttgatgcggcgttagtttgccctaacgggatcgactggctgctgtcgctgctactgccgttctgatcggccatcgacaccagttcatcctgagaggctttatggttctgccaccaccaggcacctgtcagaccgaccaccacgaagatcaccagccaggtgaaaatcatcagccagccgtcgcgtttcttacggcgtttgcccagggaaaaactctgcatcggctcaatttttgtggcgcgaaccggcgtctgtttttccatcatcggcagcagttcctcttcaggaatatgcaccagacgggcataagaacggatgtaaccgcgcaggaaggtagaggctaaattcgcaggtaatctgtcttcttcaatttcacgtacggtagaaagtttaaggcacaggcgttcagcaacatgttgctgcgtgagtcccatttgttcacgggccagacgcaggcgtgtacctgtggaatgaactgcagaattttcttgagtggcttcagtattcattagctaaataacgctggtactgtatcgattgcggaaaacgtcgcgctaactggtcgccataacgtgaaacgtctgcggcatttccctgttgcgcggcgaaacgtatgtgtaacgccaggctgcgtgccgtcgtcggcagcggctggtaaagctctaataatagcgctacgttagcccactggtcattttcgaccgcgctttcagcttcggctagtagcgcctctcctttactctggtccgcatcgagcgcatatgacaacgcagcacgcgctgcctgtctgtcccctgcccgcagataacaataacccgacagttcatacgcatcgatacgggcgtctccttcctgcgcacccttcgccctgataaactgttgatgcgcatcatcatactgccctaaagcgcaaagaaacgcaccgtaattgttagggatgtaaccattatgtggcgcaattcgctgcgcatttgaaaaatggaaatgcgcagcggcgttttgcccttgccgctgagccagcctggctaaggccaggggcacccggtaatcctggggatcagcagcctgtgcccgcaggagattgcggcgcgcagcggggtaatcttccactgccaggtagtgcatacccaattgcaaacgcagttctgctgccccgggttgtgacggtgaactgacacaaccgcttacaacaaaaacggccagtaatgccgcgcgcatccctttgcacatatcgtctccatcctgttatctccgtggcgggcatcagcctgccacgcagagacagaatgggaaacgctgttaatcagcctttcagagcgccttcacagatatcgcttcgcccgccattttcttacgcagggtacgcttggtacggtcaatgacttcaccggctaactgaccgcaggcggcatcaatatcatcaccacgggttttacgcacaatggtggtaaaaccgtagtccatcagcaccttagaaaagcggtcgatacggctgttagagctccggccataaggcgcacccgggaaggggttccatgggatcaggttgattttacagggcgtttctttcagcaatgctgccagttcatgcgcatcatccgtgctgtcgttaacatgatccagcaacacatactcaatggtgacacgtccctggtttgcattggatttaccaatgtagcgtttaaccgcggccaggaaagtttcaatattgtacttcttgttaatgggtacgatgtcgtcgcgcagtttgtcatttggcgcatgcagcgaaatcgccaacgccacgtcaatcatgtcacccagcttgtcgagggccggaaccacgcccgaggtcgacaaggtgacacggcgttttgacaaaccaaaaccgaagtcatccagcatgatttccatggccgggacgacgttattcaggttgagcaacggctcgcccatgcccatcatcaccacgttggtgataggacgctggccggtgactttggcggcaccgacaatttttgccgcacgccagacctggccaataatttctgatacgcgcagattgcggttaaagccttgctgtgccgtcgagcagaatttacattccagtgcgcaacccacctgagatgacacgcacaaggtcgcgcgctcaccttccgggatataaaccgtttcaaccagctgatctcctacgcgaatagcccatttaatggtgccatccgttgagcgcatctcttcggccacttccggggcgcgaatttcggtgagttccattaagcggttacgcagcttcttgttaatgtcggtcatctgctcgaaatcatcgcagcagtagtggtaaatccacttcatcacctgatcggcacggaacggtttttcaccgagcgagacaaaaaattcacgcatctgctgacggttaagatccagcaggttgattttttggctcttcggagagacggaaataggcgaggtggacgcggacgtcacaatctgttcggacataatgttctctggcctcgttgttacacgttatggcgctgttgggaaaagaaaaaattacgccttcactaagctgactcaatgaaggcgcaatattgtacaacatctgctgcctgataacaggtgagacttgcctgtgttcagcagatttttgtaaagccgcgtacgcgtcagccgctaagggattaacgcgtgcgtgggcagatttcgttttcgccgaagaagtaggcaatttcacgggctgctgattctgcagaatctgaaccgtgagtggcgttctcggtgaagctgtcagcatagtcagcacgcagtgtaccggccagtgcgttagcagggttagttgcacccatcaggtcacggtgacgctgaacggcattttcaccttccagcacggaaaccacaaccgggccagacgtcatgaattcaaccagaccgtcgaagaacggcttgccctggtgctctgcgtagaaaccttcagcctgctctttgctcagctgcagcatttttgcgccaacgattttgaagcctgcgctctcaaaacggttgtagatagcaccgatcacgtttttcgcgacggcgtttggcttgatgatagaaaaagtacgttcgattgccatgatgacctctgtcttgacgttctgaagaaaccggaggcgcgccccggctaagaaacggcgccgattataggggttgagtgtgacgttgcctatcacagaacccataatttattgaaaaatcttgatctgcgtctgtgcggacagctttccactgtgatttagcgcaaaaaacactcaatcgcgggtaaagccgacggaggcgagttgaccggcttcatccatcaccaccagctgataatcgccagcccggtcgaggcgcagcgacagcgtgccgttctgactttccgtctcaagcggctcgccatttaaaaaccaccagcgctgaacgccctgaccaccctgcaccgccaccggcatcaccagcgtcgtagtgcccggcagcggctgaacgcgctgtccttcgataacgccggtgacaatcagcggcgcgctgctgccctgctgcaaaggtggacaccgggtgtcgatagccggtaaacgctgcgcccgacgctcttgcggcggcagccaggcctccagcggcagcggccacaccaggcgttcatggctgatagcatgcggacaatccgccgcaacccgcaaaccctgttcgttctgccagtagtgcaggcgtaagccgctcaggctttcctgccccggcgcgagtaaggtgggcggtagcgtctcatttaacacccagctctgccgccgctgtcgacagttctcatccccggcaggcaatggctgaccgccaggccaacagatgctggccacgctgaccgacgctggacgcggatcggtgggcatttcctgagcggctacgcggttcatcagtacgctgttaatttgattcatgacaggcacggcagacgcgaagccaaattggccggccaccggagtggcatccggtcgtccaacccagacaccgattaaataacgaggatttatccccaccgcccacgcatcgcggtagccatagctggtgccggttttccacgccagcggtacgacagcaggcgcgctgccattgccagcaggctgggcctctcccgccagaatacggcggataatccaggcggcccccggcgaaagcagcgggcgcgcctgtaaaggttgatcggccatccagcgcagttgagcggcgttgccatgacgggcaaaggcactataggccgcgacgatatcatccatgcgcgccccggtgccgccgagtatcaaggagaggtttggctccgcccccggtgggaaacgtaaattcagccccacgttgcgcagacgtgcggcgatatttttggggccaagcgcctccagcagttgaacggcgggcaggtttagcgatcgtactaatgcctcgctggcactgaccgggccatgaaaaccggtatcgaagttgcctgggcggtaatcgccaaagcggcgcgggacatcctgcagtaaggactcggcatgaatgagcccatcgtccagcgccatgccatagacaaagggttttaataccgagcctggcgaacgcacgctggcaatcatatcgacatgaccaaaccggctgtcatcactaaagtctacggagccgacataaccccgtaccgccattgtcgtgtgatccaccaccagcatcgccagcgaggtccgtggggggagctggtttttaacattcagcgccatgttttccagttcacgctgcagggacgggtccagcgtcgagacaattttatcgtgcgtggtcatcgacagcagtcgtcgcgccagcaacggtgccatctgcggcatctggcgcggcggaagccagaccggctcctcgcggatttcggcgacctggcggggcgaccagacatgatactgtgccagcctgtccagcaccttgttacgtgcggcttccgcccgctctggccagcgatcggggcgcagacgactgggtgcctgcggcaatacggccatcagggccgcttcgcctcgtgtcagctgcgacggggcttttcccagccagctccagcttgccgccccaatcccttccagcgtgccaccaaagggcgcgcgattcagataaagcgttaagatgtcgcgtttagaaagatgccactccagttgcagagcgcgccatgcctgaatcagcttgccgcgcagtgttcgcggttgcgggtcaatgagtcgtgccacctgcatggttaaggtgctgccgcccgaaatgacgctgcgatgacgcagatcctgccaggctgcgcgaagcagggccaggggattaatgccgggatggtaccagaaccagcgatcttcataggtcagcaacgcctgtaaataggccggcgagacgtcactgggggtgacgggatagcgccagatgccctggctgtcggcaaagcgccacagtggcgtgccatcctcggcgaccaccacgcgtgcgggctgcacctctttgaggggcaaggggaataaccgatccagaatcagcgggataaacagcaaggccagaataaaaagcggcagggctacccaccgctttttgatgtgcctgtttttgatcacaacccggcccggctacggttgtacatgcagttgttgcggcgtagcgccaatcgcccgccactcaggtacatacatcgattccacctgcggtggcggcatgtggtagaggcccggcgtcaccgcgcgcgccagatacatcaaggtggcaggacgataagtatccactgccagcgcggcaacgaagcgatcgtcacggaactcaatatgccggatgttggcctgctgcatatccatcatgctctcttttaacgcatccgcactgtcacccaggctggcactgctgtctgccagattctggttttccagctccagtccggccggtaacagatccacgaccagcgcatcgctgatgcggcgtttcgcagccacggtaagacggaccaccagcaattcaccgctgcgcagattattgagatccgccagtttaccgtccagggtgaagtactctcgcttaacggacagcatatggctgaccggattcggcggcgtcagcggataaccgaccacattcaggctgccatacagcggtgccgtgccagggttgctcacctcaacgccttgcgccagttgttgattatccagccctttattcacaggcccactgctgcttacgggcggttgatgaccctgtaatatcgcctgccagtccttaccctgtgcggtttgcagcgtgcgcgccgccaggtaaagcgcattgttctcctgggtggagagccagcgcttcccgttcagctcttttgacagtgacagcagcaggctgttttgcagttccggctgcagctgatattccgctaacagggcgatcatcatcccctcatcgcgcaccgtgctgccatagtctccaaaccagcggctttcaggtcgtgacagcgtggcgccctgcatcacagccagcggcgaacgctgcccatcccccatcagcttcagcgctacacccaactgtatcagcgccagccccgatttagccttgtcacgcttttcgtaaagcgcacgcaacgcgcccagtggcgcacgctgctgacgcgccagcaccaggccggcataagcctgaacgctgaaacgcaatgcatcggtgtcggcactgccaccggcggtgatttgtgaagggtcctgtaaataacgcagcagccgtgcgttagcccgatcaatcacgtcagggggcaaggcatagcccgcttcgctggcgcgcagtaaaaagtcggtaacataaggtgtgagccagaactcctcttcactctgcttactccataacccaaagctgccgtcagcacgctgcatcccggccagacgggcgatgccggtgtcaacggcggcccgacgaacgtcatcactgctggtttttatccccatagcgctgagctgcgcctgactggtatagagcgacggccagagaccgctggtggtctgctccagacagccatagggataggcataaagcgcactgatgtagctggcgatatttaaaggcggacgattactcagagtcagttgtccactcagggtttctgcatccagacccgcaaatgccgccgccgtgacctgccaggggctatcgtggtcaatgacagcggcaaaattgagggtttgcgcaggataaggcggccttacgccaatcttccacgtctgctgactgggccgcaccgtctcaccgggcaggttcagtcctgaaatctgcacctgcacttcgccgtcaccaaacccggttgtcgccgtcacgggcacctgcaaggtggtcctttcgccttttgccagcgtcacattttgtgtagccgcgcccgacagtcctatcagacctttggcagtcaaatctaccttcagggtttgcggcaggtccgtcagattggtgatatccagtgccagtgacgcgctgtccccgctggccagaaaacgcggcgtggccagttcgctgaccagcggggcagccaccaccagtttgcgttctgctgcgccaaagctgtcatcgctccagacctgcgtcatcagccgcagctcgccgttaaaggccggaatgggcagcgtcactgagcccttgccgtttttatccagcgtaacggcctgaagttgctgtgccacgatattgacatgggtgaccggttttttaccgccgcgcgtcatggattcgtcttcaccgtctccgccaaagcgcagagcggccagccgtccaccgccttcaatcagttgaccaaacacatcgtactgatcgacgttataacgcttgcgaccgaaaaaagccgtccagggatctggcgttttataatccgtcacgcttaacacaccgctgtctaccgctgacagcaggacgtgcaccttgtcaggcagcgggccgccttcacggctggcctgaacgttcaccgtcaggttctgctcaggacggaccttatcgggtgcgtccagcgtcagcgttaaacgtcgcgcctcggtcgccatcggcagatgtaacagtccgaccgcccgtttcggcgttgcgccgctggccttgtccccttcccgaaccacaatggcactgaaatagagatcgtgacgctgccagttgtccgcgatcggcacgtccacctgcgttccaccctgcggcaccgttaagggttgccaccagagcgtcccgctgctggattccaccatcagatagcctttcccggccgtgggcgattcgacctgcaaatggacggtttcacccggctgatacgcggctttatccagcttcagtttgacctggtccggacgcagtgcgcctgtaccattggtattatcctgccagtcatagcccgcctgaaaacgcacgctgctaatgattttttcacccgactggacttcaagccggtagctgccccactcaaccgggaagctgaccttcgtgctgccgtcagcgggaatgctgacagattgctcatcttcctgcaggtctttggcatcgtaacgtgactgccagccttcgctgtcagagaaactccagtagtaatcacgccgttcacgaatcaaacgcacatcaagcttttctgccgccagcttagcgccctgactgttggcataaacaatatcgaattctgccaggctgttttctggcacggtcggctcatcgtgatagctgtcattgcggtaatcataaaccgatttattgccaaacagcggacgaatgccgggcaacgcgtccgcgggccagatggcctgagtagcacgtcgggtgaccgggcgaccgccggtttccagcaggctggcctgcagtatcaggttcagcggtgagtgaagctgatcccactgattatccacggtcagttgcgccttgccgttggcgtcaagcttaagatcgacatcgtccagactgcgcttcaggccctgttcggtgatgtcaccaaactggtagcccggcagcgcagcaaccgcttcacgggccggacgcagatagagctgtccctgcagctgattgcctgccgcaggcgcgccatacagatagcgcccctcaatgtcgaacgtaatatcggcatccgctggctggggttgttcatcgtttttcagcgttaatgccatgcgctcaggcagaaaatcctcaacgcgaaaatgccactgccgcagctggttatcaccggtattcagccgcagcatccagccgccggtcatcgccgaagtcggtaaagcaaaccgctgctgatagaaaccgtcctgcggctgccagaccaccgtgcgcactacctcgccgtcaggctgtaccagttctgctttaaccggttgggccggtaaaggcttgccgtcagcatcgcgcagcagcgcattgacgatcaccgtttcgccaggccgataaatatctcgtgggccgaagacgaagagctgtttgtcatagccttcgggccccgctacggggaattcggctaaatccagagccggacgcgccaggtcgatcagcgaggtttgctcgcccttcatggccagcaggaacttgcctttttcatccgcattaaggcgcaaatgaccgctgctgtcgctggtgccgttttgcagcacctggcctttatcattcaacagcctgatactgacgccggaaagcggtgcaccgttttccagactctgtgcgaagagttcaaactgggtgggaaagcggtgcagcgacaggccgatatcgctcagggtaaacagcgtcgcaggcatgctgtagtgataagtgcccgcctgcttcatcaccgccagataaacccctggctgctgaagcggcttaatgtctttcagcggcaactgcagtttttcccgcgtgttacgggccgggttgagttcaaagcggccggtatacaccagttggctggttttcagcagttcctgagattgccaggtagacaggttgttgccgtaattccactgggcaaggaattccgccaggcccgcatttttgattcggaaaaaatccacatccacctggtccacgttcaacgccagtaccggcagcccctgagcgatacgcaatggcaacagggagcctcggctggcaaagcccaccatcggctcaatgtcacgggtagtgatttttttgctgtaggccgttgccagcgtctcaccgctggcggcgcgcaagcccgaatcgacggtcacggtgaactgacgagagggttcaggatggcgaaaacgcagggctttacgattgctggaaagctcccaaccaccatcgactttgccgtgtttatcgtcgatcaacctgaccttttgcgccagatcctgcttgtcatccagcggctgattaaaggttaaaaccaacgccgccgcgccatcaagctgtaattcagagagatcgataatggtgagcggtttgctggcctgcgcgctggctgcaggggtttctgcactgacgggaaaaacaggtaaggtggcgacagacagcagcgaaccaccgatcagcatgctgaacagcagccggttaatgcgttttttcatggtaaatccttcaccgggccccaggggaattgttgtataacgctgggcaatttcacatcaatgctcgcatttaatcaacgcttctcttgagatggtgtgcacattacccgacactggcatgacagattgctgagatgaggttgttatgacgacgccactgtttgtgtccgccgactggttacaagaacactacaacgatgaaacgctgcaggtactggacgcacgtatgctgccgccaggcatggatgcggttcgcaatatccaggctgaatacctggcggggcatttgccccaggcacctttctttaatattgaagcactttccgatcacaccagcccttatccgcatatgctcccgcgcgctgaaagttttgccgtggccatgcgcgagctgggtgtgaacagtgataaacatctgattgtttatgatgagggcaacctgttttctgcgccccgcgcctggtggatgctacgcgcatttggtgtggcgcaggtttccattctggcaggcggtttacaaggctggaaagccgccggcttgacgctggcggagggcgaagtgaacctgcccgaaggtgaatttgacgcagagtttgatgacggcctggtgaaacgcctgactgacgtgctgctgattagccatgaaggtggtgcgcaaattgtggatgcgcgcgcggctaaccgcttcaatgccgaggtagatgaaccgcgtcccggtttacatcgcgggcacattcccaacagtttgaatctgccgtggaacctgctggttgaacagggacaactgaagccggcgtccgaactgcgcgccctgtttgccgaagcaggcgtggatattcatcaacccattgtcgccacctgtggctctggcgtaaccgcagtcgtgttgattctggcgctgacgtcgctgggtgtccgggatgtctcgctctatgacggttcctggggcgaatggggcagccgggacgatttgccgattgcgaaataaggaaacgcgcggccagagctgccgcgcgcgttgtcagataatacgctgaccgcctttgaaatcgcgcaggaagcttccccagcgacgttcataaaagggcgtaatgtgggcggtaaaaaagtggctaatgccgcgatcttctgccgtgacctcgcagatatcaatgggtgcatcatccagtaatgtgtcgctggcaacgctgccggcggcctgaataatcgtctcaatatcgctgtccgcttcaattccaatcagcaagttagccggctcatcagcatgttctcggatgctggcaacaaaggcgcgtttcacctgcttatatttgctaaatagctgggtcagggagtcgatcatctgagcgggcggctctgccacttctgacagcaacagcgactgccccccttccagcacgctttgctgcgtgagtgcactgccctcttcgcccagcagatggctgatttcggcggcggagaactctttgccggtaggcagctttggattaagaaacagggtttcgccgcgcgtcatttcaaacagggtgcgcacgggtaaacgtaaatacgcctgttcgtcatcgacggcgtcgctcattgcctgttcggaagtaaaaaacggaatgacgctgctgccatcctctttctcccagtgctggagatcgactggcgtgctggcatccaactgctggctggtactttcgccggggacccagacatcggcttccagcaacagctggaaaaattcaggccggtgcgcaggctcggtcgctgccagcttcagcacctcttcaagacggttcatagtttacttctaccttcagaaagcggtggccaggccaccgctggattgcgcttatttcagtaacaggttggcgagggtccgcactccaagaccggttgcaccggcagcccactgatccaccgcgcttttgcggtaggtggctgagcagtcaatgtgtaaccagccctgctgatagttgctgacgaagtacgacaggaacgcggcagcgctgctggcacccgccgagtgcgccgggctggcgatgttattcagatcggcaaagttcgacggcagatggttgcgatggaattctgccagcggcagacgccagaaaggttcgttttcgctgactgcgctgcccatcaccgactgcgccagattatcgtcaaaggtaaagagtgcgtgataatcgttacccaccgccgttttcgctgcaccggtcagggttgccgcatcgatcagaagcgtcgggttctgctcactggcatcaatcaggccatcagccagcaccaggcggccttcagcgtcggtgttcatcacttccactgacttgccgttgcggtaacgaataatgtcgcccagcttaaaggcgttgctgctgaccatgttatccgcgcagcagaggtagagcttaacgcgcttattcaggccgcgagagattgccatagccagtgcaccggtcacggtggctgcgccgcccatgtctgacttcatcgagtccatgccagcgctcggtttcaggctgtagccgccggtatcaaaggtaatgcctttgcccaccagacacgcgtaaacgggagcttcgctgtcgccggttgggttgaaatccagcgctaaaaagaccggcggacggttggagccgcgaccgacggtgtgcaggcccatatagccttgttcacgtaaatcgtcgcctttggtgatgcgatagctgacggcttcaccacccagttcactgagtaagtcgatagcgctgtgcgccagtgtttccgggcccagatcgtctgcaggtaaattgatggtatcgcgcacccagcccacgatcttacggcggcgatcaaactccgcctgctcgtgttcacccagttgcggccagtccacctggtttttaccttttggaccgcgatagccctgccagaacgcccagcactgctccaggtgccagccttcacccaccagcgccacatgacgaatgccctgtccatccagtttacgggcggcccgctggatggtcatcaatgcatccgcatcacgcaggtgcagcgtcatgccgttttcgttgctgcttaacagcgctttttcgccccagcgcgcatcggcgggctggctgctgagagtaatcttcatcggttgtgtattcattgtagggctccgtattcgttattcgtttcatccagcctgtttttgcgacggcttttaattcagatgttacgctgcacgccgcagacgttgtcggcgcacagtttgtcagcctcggctggcaaatgcattatgacttcatgagttcgcgcagccgggtaacagacttctgcaccagcgcgatggcatagtcgatctcttcttcagtggtaaagcgtcccaacgagaagcgaagcgaactgtgtgccagctcttcgttcaggccaagcgcgcgcaggacataggaaggttccagactggcagaggtacaggccgatccagacgacagcgcgagatctttcaacgccatgatcaacgactcaccttcaacgtcagcaaaactcacgttaagaatgttggcgcaactgtgctgcaaatcgccgttgacactcacgccacctgtctgacgaagtccctgccagagccggtcacgcagtgcagccaggcgcgccatctcgtcttcgcggacttcacgggcaatgcgataggcttcacccataccgacaatctggtgcacaggcaaggtgcccgaacgcatattacgctcatgaccgccgccgtggatttgtgcatcgatttggatacgcggtttacggcgcacatacagcgcgccgatgcccttgggaccataaactttatgggcggaaaaagacatcagatcgacagggagttcgctgagatcaatcgggagtttacccacgctctgggtcgcatcaacatgaaacaggatgccctgttcgcgacaaagcgcgcccagcgcggcaatatcctgaatcacgccgatttcattgttcacgtgcatgatcgacaccagaaccgtgtcgtcacgcagcgccgcgcgcagatcctcaacagcgatcaggccgttcgcggcgggcgtcaaccaggtgatgtcaaacccttctcgttcgagttgcaggcaagtatcaatcaccgctttatgttcggttatgctggtgacaatgtgcttgccacgcgcctgattgaaatgggcggcacctttaatcgcaagattatcggattcggtcgcaccggaggtaaacacaatttcacgcgggtcagcattgaccagctctgcaacctgattacgcgcaacgtccaccgcttcttctgcttgccagccgaaacggtgtgaacgggaggccgggttaccaaacgtgccatccagcgtcaggaattgcatcattttgctggccacacgcggatcggccggcgtggtggcggcataatccaggtaaatcggtaatttcattgcgctacagctccgtatagaaaatcatacgtatttatagcagattcagcccctaccgcgttagcagtaagggccggagaagcggaggattacgaggcgcgaaggttaacgttgatttcctgagcacgggagttctggaaacggcggttgtcgttggcattttggcgatcggccacatccaggatttcctgattattcaccagctcggccagcgtaatgttgttcaggaactcactgatgcgcacgctcagatcgcgccataagacgtgagtcaggcagcgttcgccgccctggcagccttctttaccctggcacttggtcgcgtccacggactcatccacggcagtgatcacttcacctaccgcaatcgcattggcttctttacctaacagatagccgccacccgggccacgaacgcttgcgaccaggccatgcttgcgtaaacgcgagaataactgctccagataggagagcgaaatgccctggcgttcagagatatcagccagtggaaccgggccctggtgagaatgcagggcaacgtccagcatagcggtaacagcataacgtcctttggatgtcagtctcatagcatacaacctcaatagcgtccggttatcggaggattagcgaagatgacagcaagtctgacattcccgagtaatttggtcaactatttaaccaagtaaattactcaagtatttaacctggtaatttactcaactattattcgctgtccggcttcgtctttttgcgcttctcaaaagatgagagcataccgcgcaaaatattcagctcatcgcgttcaggacgggcgcgcgtatacagacgacgcagtttgctcatcacctgaccggggttggcttcgcggataaacccgctttccagcatcatgttttccatatgctgatagaagcgctccagatcgtccaccagcggataaggtgaagcgtcgtactgcggttttggactctgcttctcttgcgcctgcagccaggccatgcgcacttcataagcaataatctgcacggccatcgccaggttgagcgagctgtattctggattggcctggatcgccacgtgatagtggcacttttgcagttcctcgttggtcaagccaacacgttcacggccaaacaccagcgcgacgggtgcctgctgcccttcttcaatgcttttaacaccgcattcgcgggcgtccagcatcggccagggcaaagagcgggaacgtgcgctggtgcccaccaccaggctgcacccggcaatggcctcatccagcgagtcaacaatcttcgcctcgccaatcacgtcactggcacccgcagccagagagatagcctgagaatcaggcttcaccagcgggttgaccaaatagaggttagttaaccccatggttttcatggcgcgcgctacggagcccatgttgccggtatgagaagtttccaccagcacgatacgaatattttgcagcatagttgggatcggtcagaaaatgatggggcgtactctaacataaagcaggacatttaccgaacaccctgctatactccgcgccgttttccccgttctttaacatccagcgagagataccgatgcatccaatgctcaacattgccgtgcgcgcagcgcgcaaggccggaaatttaattgccaagaattatgaaaccccggacgccgtcgaggccagccagaaaggcagcaacgacttcgtaactaatgttgaccgcgacgcagaacgcctgattatcgaagtcattcgtaaatcttacccaaaacataccatcatcactgaagaaagcggtgagctggagggggaagatcaggacattcaatgggtaatcgatccgctggatggcaccaccaactttatcaaacgtctgccccacttcgccgtttctattgccgtccgtattaaaggccgtacagaagtggctgtcgtatacgatccaatgcgtaatgaactgttcagcgccgtgcgtggacaaggtacgcaacttaatggataccgcctgcgtggcagcatcgctcgcgatctggacggcacgattcttgccaccggtttcccttttaagctcaagcagcacgcgccagcctacatgaacatcctgacgaaactgtttacccagtgtgccgatttccgtcgcacgggttcggctgcgctggatctggcctatgttgcggcaggtcgggttgacggttattttgaaattggtctgaaaccctgggatttcgccgcaggtgaactgctggtgcgtgaagctggcgggctgattactgacttcacaggcaaccacggctacctgcaatcaggcaacatcgttgccggtaatcctcgcgtggtgaaatcgctgttatccgcgatgcgtgatgagctaagcgaagcgctgaagcgctaaaagaaaaggcggcacgttaacgtgccgccttttttattgcctgtcggttagtgacgttcgtgtgtgagtacctgagctggctgagtacgacgacccaccattcccatcacacctgccagtacggcttcaataatcaggataaagaaggcataccagctggctttggccgttgccttggcagcctgttcacccgcttcgcgcgctttctgctctgcctgttttttcagttcctgatatttctgcatggcctgctgatagctttgttcagcctgattaacgatctgttctgcttcctgatcgctttttccggtccgcgctttaataatattttttaacgcatcacggtcggctgcctgtaacgtatccgaatgacgttcaatgacgcctttaaaccagttggttaaatctgtgtcggcggtttgaggatggttagcggtattattcgcctggttctctgcattctgcgcttcattattcgcatcctgcttcagtttttccggttgtaattcaggcttacccgtttgacgcaacgtagtttccagttctttctgcatatcgtttaaattaatattgttttgctgcagtttgtcttttgccatttgcgtaacagatggcgcagctgctgaaataccactgcctaccgcctgaaaacccgtgccaagaatattcatggcaccgcctaatacgctactggcaaggctgaccgccaggtaaatagttaaaacggtgctaataccaaacatcagcagtccgtgcagcgcaccttcacgctgggccaggcgtccggcgacgtaaccaccggcagcaatggcgaggagcatttcaattgccgtccagactaacgcaccggttcccaaatgtttaaatggattatcttcctgcaaaggatcaatggtggtagcaccaattgccgtacccagcaaggttaataatatgtgaataatcaaagcacaaattacaccggcaaaaatggcactccatgaaatgcgtttaaggggtaaacctgccgttccagttaccagcggatcgtggtaaccattattaatacgggtatcagccatgagatattttcctcgcaacacagaaaagccgtgccatgtttatttattcccaggatgggaagtggattagctgttaatagcgtagtcagtgaaaacaactttcaccactaaaccgtcaacagaaaaatgaaaatagcagaggaaaagaaaaagcggagaattcacagcggaaattgacttccgctgctaaggaaattaaaacggccggattccacccgccagcccgggttgggctgattgccaaagtgcacagcccacaacaattaatgtcagacttcccagtaatgccagtacaggcagcaggctgcgcgcacctttacccgcctggctgtcagcgccaagacgttgcgccagagcacgggaacgctgaaccagtaaaccaatggcagaaatggtcagggcggtgcccagggccatgacggctgcagagagcacgccccacagataaacgccaatcaccttagagaacagcagcatcataaccgcgccagagcagggccgcagtcccatcgacaccaccaccagcagttgggttttgccgttaactgcgccggccacctgctgcgcactcggcagatgcgcatgcccgcaaccacaatgctcatcatgttgatggtgaggatggatcgcatgaattttcattgccgacggtggacgcagcagcaaccaaagcgtcttgattgcccggtagccaacccagatgcctaaggcaataaccagcaggtagctccccttctccagccagaaactgctgagatgcagctggcgcgacgaggtttttagcaccacgagcatcagcgtgaccaggataatggcgaccgagccctgaagcagggaggccagcaacgtcagcttcatgctggtttttaattttgccggatgggttgccaggaaggtagtaatcaccactttaccgtggcccggccctaatgcatggagcacgccataaatcaggctaaatgccagtaacgacagtccggcatgatggggctgctctgcaacctgctgcaggagctgggtcatctggcgatgcaacactttttgccagagaacactttgcaggagtatctgcggccagtgtagccagattgccgcccccaccgtaccaagcgctgcggcaaatagcgccagcggccacagcctttttttgggcctcgtcgtaagcgttagtgacatgtcaggatcaccgtttgcgcgaactgcctgcctaaatccatttcctctggcggcgcatccgccttgtcaagcgagagggcatattgtttcaatgaatcgtcaggctttggcgtatgtaacgtaaatgaacagcgtgactgtaacgctggcggtacgcttagcgcctcaggtttgtcgtaaaacatatcgacgaagtaggtgggatcgaaggtcaaaatctcgaagcgctcattgttgagtaaaggcggctcggccagcggcaggacaaactccagtaccgccttgttgccgctgcgtgacagattgtactctgttggtaaattcaagaacttcacccgctgcttgttgtgccagatttcagaaaagtaatgttgtccaagcacgtttgccatcactcccgcagccagcttcttccataccaccgtacccggtttggcatcactcgcgtcatacagcaaatcggcagacgtaatctcatccatggtccaggtcattttcaggccagtgaaacgatcgtccttcgtgaccagctcggttttcatatcgataaagctatggggatgtgccaggactgacgaacttaccaggcagagtagtacgaaaaacatgcgtttcataatgttataaagtaactttcctgatgaaaaggtttcataagtaacaaaattttgtgacccgccttaaacctctgaacaaaaagtcgggtaaaccgttcacgggtccaggtggttgactattcttagctaaaaatagcctgctggataatgattgatgagttctgctacatcttcagcaccactcttcaccggtttacagcgtcgctgccatctgttgttactgctgtttctgcctgctcaagcgctgacgcttaaaagattaagcctgctgaacggagtggatatcgccaccgcgcgacaagatatcgcggaagtcggtgatgagatacagcgctatcatcaactggagcttcaccagatggtggatggcagcctacgcattcatggtacagagctggatcgccgaatttgcttaatacacaatttgcgacgcagcctgcgactgtcgcaggcctttgtctgcgagcattttgctgcccccttacgtcagcgcctgaaacagatgaaaattgaaaaagcgctgtacgatgaaaccaacttgcaggcgctaattcagcactgcagcctgtgccttaatcgcccgttcagcactcgcgatcaactctttttacaaatatttatgaaatacggtctgtgccaacgccagcctgccatctttactgcccagcagcaggcatggctggcagcaaaggcagaacgccaggccgcaacagatgtcatccatcactggcaaaaacgctgccatctgtcgccggacgccagcgagactgatttctggacgctgctctttagcctgctccactcgcctgatccagactgcgtcacgcattccagcgaacagcgtctgatgcgcgccactcagcgactgattgatgactttgagcattatgctggcaacgcttttcatgaacgatctgaactgcagcagcagttatatacccatttagctcaggcgctggatcgcacctactttactattggtattgatgacagtgtggcacaagacgtaaccaggctttatccgcgcctgctgcgcacgacacagcaggcgctggccgcttttgagcaggaatatgagatctgtttcgaagcggaagaggtcagtctgatcaccgtgattttaggtgcctggctcatgcaaagtagtgcgctacaggaaaaacaggtgctgctgcttaccggtgacgatcctgagctggaacaggatgtcgagcagcagatccgggagatcaccttgctgcctgtcaatattacttaccagcgcgttgaggattttcagcgcgatggcgcaccgcgcgaagtcgatttaattatttcgccatatgtgacttcgctgccgctgttctcgcccccgctgattcacgcagaactgccgctgacagaataccatcagcaacgcattcgctatttgcttgaatcgtagcgcgggcgcaggaacagtgcaggcacgacaaccagcgccatgacccagaagagatgaccctgcagatgggtaaagaggacgccgcaaatcatggtcatcaccgcaataccgccgcccatcgccagcgccgaatagagtgactgcaaacgaataacatccgttccctgacgtgaagcgatgaaacgcatcgcggccagatggcagaccgtaaagctgccgcagtgcagaatttgcgccacgatcagcaatggcaaggcggtgctggctcccagcaggctccagcgaatcagcgcacagaggcccgagagcagcagcagatcgcgcgcgcgccagcggggaaacagccggtgactcaatgcaaataccacaatttcagccaccacgcccagcgaccataaataaccgaccaccgacgcggaatagccgctctcctgccaccagattgcgctgaagctgtaataggcggcatgtgcgccctgtaataacgtgacgcacaccataaagcgccagaccgcgttttcctttatcaggtcacgccaggcctgccagccaccgcttaccccgccctgcctttcgctgccctgaggatgtgtctgtggcgtcagcaacatgcccgccagcatgctgaccagccccactgacagcagcatgaggatcgcctgtgaagagaacgcactcaccagcatcccggtcagcgccgagctaatcacaaatgccagggaaccccacaggcgcacgggcccataggccagaccaatctgctgtgtccaggttgcagccagggcatcgcttaacggcaccagaggtgagaaaaacaggttaaaaccggtcatcactaacagcagccacatccactgttgcccgacccaataaccgacggcaataaaacaggtcagcagcgccagcagccgtaacgccgtaatcagttgtgctggatttttaacctgggaagcaataaacaaactgccaacaaagcgcgctaccatgccgcatcccagtaacaagccaatttgttcagggtccaggccgacacctttaagccagacgccccagaaaggaagataaataccgtaacagaaaaagtaggtgaagtagcttaatccaagccacctggcggagccgattgccatgttccctccagcagcgatgctaccaggcaataatgagtggtcgttactttggcagagccgggtcgtgcaggcaataaaaaaggatggccggggccatcctcttgtcagactgtgttttcaacagagcctgttatgcgtaaaccggcagacgcgcacagatatccagcactttctgcttagtgcgttcaatggtggcttcatcattgacgttgtctagcacatcagcgatccaaccggccagttcacgcacgtccgcttctttaaagccacggcgcgtgacggctggcgtaccaatacgcacacctgaggtgacaaacggacttttcggatcgttcggcacgctgtttttgttcacggtgatgttagcacggcccagcgcggcatccgcttctttaccggtcatgtttttgctgaccaggtcgatcaggaacaggtggttataggtgccacctgatacgatgttgtagccacgctcaatcagcacctctaccattgctttggcgttttttgccacctgctgctggtagactttaaactcaggctccatcgcttctttaaaagcaacggctttacctgcgatgacatgcatcagcgggccgccctgtccaccagggaatacagcagagttaagctttttgtacagatcttcgtcgccaccctgagccaggatgatgccaccacgcggacccgccagggttttgtgcgttgtggaggtcacgatgtgcgcgtgaggaaccgggttagggtaaacatccgcagcaatcagacccgcaacatgcgccatatcaacaaacagccatgcgccaacgctgtcagcgatttcacgcattttagcccagtcgcaaataccggaatacgccgagaagccgccgatgatcattttaggcttgtgggtttgtgccagatcggccagttcgttgtagtcaattttaccggtttcatcgataccgtaaggcacaacattatacagtttgcctgacaggttaaccggcgaaccgtgcgtcaggtgaccaccgtgtgccaggttcatacccaggatggtatcgccgggctgcaacagcgcggtgaaaacggcaaagttagcctgagagccagagtgaggctgaacgttggcatagtctgcgccaaacagggctttagcacgatcgatagccagttgctcgacaatatccacgtattcgcagccgccgtagtaacgcttgcccggatagccttcggcatatttgttagtgagctgtgaaccttgcgcctgcataacacgcgggctggtgtagttttcagaagcaatcagttcaatgtgctcttcctgacgcactttctcttgctccatcgcctgccacaactcggcatcataatcggcaatgttcatttcacgctttaacatccgcatctcctgactggctatctttaaatcggcaatttacgccccctgagggcgaaggctgacagtgtaaaccgttttatctgggtaaggtagggtgaattccctctttttacgcaaacgtttggctatggaatagcaaagcattttcaccgcattttttgcaatgcctgcccttcaacattattcctgacgatgaaacagatttccttccattttgtagcgaaaacctgccagttgctgccaacaaaaagtaagcgaagatttacagcgtgaaagaagtggatataagatgcattttaaatgcaactttaaaggaggtgttgtcatgcttgatgcacagaccattgctaccgtgaaatccaccctacccgccatcgccgcctgtggtcccgatctcacggcacatttctataaccgcatgttttctaagcatccggaactgaagcatgtctttaacatgaataaccaacgtaatggcggtcagcgcgaagccctgtttaatgcgatatgcgcctatggggcaaacctggaaaacctgacggcgatactgcctgctgttgaaaaaattgctcagaagcacaccagcctcattattcaacccgagcagtatgcaattgtgggtgagcatttactcgcaaccatcaagacactgctgaatccgggtgatgaggcgctggccgcctggggacgcgcttacaacgcactggcagaggtatttattcagcgtgaagatgccatttatcaggcgtcagaacagcaaaaaggcggctggcgcgggaagcgggtgtttcgcatcagtgcgatggaacagcaaagtgccgtcattaaaagctttacctttacgcctgtggatggcggcccggttgcagcgttcaaacccggacagtatttgacgcttcacttacagcctgcggggtttgaatatcatcagattcgtcagtactcactaaccacagccagcaacgagaaaacctaccgtatcgcggttaaacaagaagcgctggggagtgtatcaggctggctgcaccggcatgccgaagtgggtgacgaggtgcagctggccgcgccgcacggcgattttttcctgcaggtgcgcccgacgacgccgatcacactcatttctgctggcgtgggacaaacaccgatgctggccatgctgcacgcgttagctgcacaacgccatccggcgcccgtcaactggctccacgctgccgaaaacggtaaacagcatgccttcgcagaggaagtaaacacgaccggtgcccagcttcctgattttgtacagcacatctggtatcgcgcgcccgatgaacaagacgcaggccgctatgatgcgcaaggtgttatggatttggcgacagtgtcagcgcggctgcaggatgtgaacacccacttctacctgtgtgggccactgggctttatgtcttttatcgttaagcagttgcatgcggtgggcattgcggcagaaagaattcactatgaggtgttcgggccgcataaagagatgtgatctcaggacataaaaaagcccgcaacaggcgggcttctgactcaatcgtaatcaaatcgcttcttcgtcttcttcgccggtacgaatacgtactacccgagccacatcgaaaacaaagattttaccgtcgccaattttgccggtttgcgcggtgcgcatgatggtttcgacgcaggtatcaacgatatcgtccccgaccaccatttcaattttgaccttaggcaggaagtccaccatgtactctgcgccacggtagagttccgtatggcctttctggcggccaaatccttttacttcgctcacggtcatgccggtgatgccgacttcagcgagtgcttcacgtacgtcatcaagcttgaagggtttaataattgcatcgatctttttcatgtcagatcctttcctcacgccctccatgtgcagagggatttttaagtataaatgccgcaggcttattggggcagaaaactactctttaaagtcgctggcgtccagttcatgccgtgacagcagcttatagaattcagtacggttacgtccagccagacgcgcggcgtgggtgacatttcctttggtcatctgcaacagtttgcggagataattgagttcgaactggtttcgcgcttctacaaaggtaggcaacgcactgttttctccgctcagcgcctgctccaccagcgcatcgctgataaccggcgaggaactgagcgcaacacattgctcaataacgttaaccagttgacgtacgttacccggccaactggcagatatcaggcgcttcatcgcatcaacggaaaagctgcgtatctgtggtttgtgccgttctgccgcctgacgcagcagatggttcgccagcaacgggatatcttctgtgcgctgatgcagcgccggaattttcagattcaccacattaaggcgataaaacagatcttcgcggaactctttcttttccatcgcctttggcagatcccggtgcgttgccgagataatccgcacgttaatatcaatatcattgttgctgcccagcggccggactttccgctcctgtaacacgcgcagtaatttcacctgcagcgcaggcggcatatcaccgatctcatccagaaacagcgtgccgccctctgcggctttaaacagcccgtcacgcgcgctcaccgcaccggtaaaggcacctttggcatgaccaaacaattctgactccagaagttgctcgggtaaggccccgcagttgatggcgataaacggctgccccgcgcgcgggcttgccgcatggatagcctgcgccagcacctctttgcccgttccgctttgcccattgatcagcacactgacgtctgactgggccaccatatgtgcctgttcaagcagacgcagcatctgtgggctgcgggtgacaatcgcttcccgccagcgatcgtcactcactggcgcgcgctgtgccagggcctcatctatcgctttatacagtgcgtcgcgatcgaccggtttggtcaggaagctgaaaacgccctgctgcgttgccgctaccgcttccgggatcgagccgtgagccgttaaaataatgaccggcaagcctgtatgacgcttttgaatttcgccaaataatgccaggccgtccatttcatccatgcgcagatcgctgatgaccagctcgattttctctttctgcaaaagtcgaagcgcctcgggtccactggcggcggtggtcacctgatatccctcactggtgaggcgcatacctaacagtttgagcaggctgggatcgtcatccactaaaagcaggtgtgccgcatgtttcaccattactgttcgtcctcttgtggcagggccgttccgtgactgccgtcagacatatcggaggttttgcgcgacgaaagctggcgttcgatatcggttaaacgctccagtttgcgctgggtatcactgagctgctgacgcagttttatctgctgttgacgcagtgaatctgattgcgcatcgctgctctgctgtaaatgggcgtaacgcgtccgcatggcgcttaactcaagctgggcaacctgattactgcgccagagctgaatgaatgcccgcaggttggacggaaactgctcactgtagccatcgagcacgttgatgtagtcacgacgctccagcggcgtcacattgccgtttgccattaagacgccttgcttaaacgctcgcgcccaactgtccaccggccagcgatgggcctccgcgcgcgcttccgcgggagaaagccgttcagcacagtcgatactgcgcatccagtaaaggggattcgtcatagcggcgctattttcaatgcgccagatatcgccgcagtgcgtggtgagatagtcaaccaggctggcttcaggcaccacaacgttgccgctggcaggctgggttgttgaggtgaccggggatgaggcacatccactgagcatcatgctgctcagggcgcttaaaataatgacggcgaaaaatttcatgcttcagactttcccggctgtggtattcagttcgatgcgaaaacaaacatcagcgtcgtcgcaggcaaccagttgcaggctaccgtgcatacggcgcagacaatcctttgcgatgcttaaccccagtccgctgcctttaaccggccctttgcgctggtgactgccctggaagaaaggctcaaaaatcatctcctgctcattttcgggaatgggcgtgccgctgttagcaacctcgatcactatccggtcgtcctgctggcggctgcgcagccaaatgttaccggattcattgccatagttcacggcgttagagtagaggttatcaatcacactcatcaatagcataggctctgcctggcaatccgttgctttgagatcgatatcgacatgcatgagtttggtccgcgccgtaagcgcatgcgcgttaaccacatcatgcacaatgtcattcagcttcaccgcttctagcgtaatcggcccatcggcgaccttacggttgtaatcaagtaattgttcgataaggcgttgcagatgacggctgctgttatccagtattgagacaatttctttctgttccggattcagtgcgcccgccacttcatccgccagcagttctgtgccttcacgcaggctggccagcggtgttttaagttcatgtgaaagatgacgtaaaaattcatggcgttgggtttccagccaggccaggcgttcacttaaccagataatgcgctgccccagagagcgtagctcccgcgggccacgaaacaccatactgcttcccagctcacgtccttcaccaagacgattaatcatgcgttcaacactttttaccggaccgatgatcatgcgggtaaacagcagggttaacgtcagactgatgataaacaggatcagcgcctgccagccgaagaactggccgcgatcggcaatttcacgctgcagttgcagaccacgggcaaacaccacttctcgcgtatcctggaccagctgcacgttcgtcgctgaaaacttttccagtgcctgagaggcgtgagccacgggattgccgttatcacactgcaacgtttccagttgcggcagcgtggcctgcagggttttaaacgccggtaaatcaggcaggctatcagcatgggaactgagcatctgactgtagcgaatacgctgcgtctgataaagctttgccagcgacgtatcgcccagcacgcagtactggcgataactgcgctccagctcaatggcggttcgagccatggcctcactgcgcctgacgtcggtaaacgtattgcggttggtgtcggcagcctgattgcttaacgccgacaggctttcccaggcctgccaggccagcaccagcagcggaaggagcaccagcaaaaaggccatcagcaccaactggcgcagggaccggggaaataaacgccattttttcacgcgacagcttccttaaagatacgcttatcggatgctagcggagtcagcccagagaaggaagaggcagaaaagaaaacggcaggcgcgatggcctgccgttagcgtgccgccctggcagcacgtgagaatgggtggagcctaactcaacgttgcgtccgatgcttgataacgatgcagaacatacgattatcggtgtggtggacgacaggctccgtttggtgcgtcattcgggctttatgagctctacccgcagcgcggtggcaatcataaacaggtgaatgagcagtgtgtcaagtatagcaaggttcatgccaacaatgaaaggccctttattttcagggcattggctgccagcttaccttttaacgcttcgttccggaccgtctggtctgctaaaagtgtcgccaaataccaacacaattttgtcgttcagaatctgctcagaaaaatcatcaagatagatgtcacccattagcgacaaaaaaaggtgacggctgtctccttttgccaacaaccgcgccataaaaaatgggaggcctgagcgcctcccattttttttacagcaattaacctaattgtttacgcgcgttacggaaaatacgcatccatgggctgtcttcaccccactcagccgggtgccatgagttgctgaccgtgcggaacacgcgctcagggtgcggcatcataatggtgacgcgcccgctctcgttggtcacggcggtgatgccgtttggcgacccattcgggtttgccggataggtttctgtcaccttacctgcgttatcgacataacgtagcgccaccagccctttggactcgagggcggcaagatgcgccccatcgcgaacctcaacgaagccctcgccgtgcgatacggcgattggcatacgtgagccggccataccgtctaacagtaacgacgggctggcagccacttcaaccaggctgaagcgcgcttcaaaacgctctgactgattacggacaaagcgtggccacagttcgctgccggggatcaactcacgcaggttagacatcatctggcagccgttacagacaccgagcgccagcgtttgtgggcgatggaagaaggatgcgaactgatcgcggacgcgtgggttaaacagaatggattttgcccagccttcaccggcccctaatacgtcaccgtaagagaagccgccgcaagccactaacgcctggaaacgttccagatcgatccgtccggcgagcaagtcactcatatgaacgtcaaccgcagtaaacccggcgcgatcaaaggcggcggccatttccacatgggagttaacgccctgctcacgcaggacggcaacgcgtggacgcgcacctgtggcaatcattggtgctgcaacgtcttcttctggcttgaatgtcaggctcacgttcagacccggatcgttgttatcctgctttgcctgatgttcctgatcggcacaggctggattatcacgcagacgctgcatctgccaggtggtttctgcccacaaggtccgtaaggtgttacggctttcgctatacacagcactctcgccagaacgaatcacaaagcggtcgccctgcttcgcacatcccagcacatggctgcagtgcgccagaccgtgcgctgcaagaatctgctctactgcctcacgatcggcggcgttgatttgaatgaccgcccccagctcttcggtgaacagcgcagccagcgcatcgctgcccaatgccgcgatatcgacgtcaatgccgcagtgaccggtaaaggccatttccgccagggtaacaagcaggccaccatctgaacggtcatgataagccagtagtttttgttggctgaccagcgcctgaacggcattaaagaagcccgccagttgctgtgcatcacgcacatctgcaggcttgtcgcccaactgacgataaacctgagccagtgccgtcgcgcctaaggtgttagcgccgttaccaaggtcgatcaacagcagcaggttatcctgatctgccaccagctgtggcgtcacgttgcggcgcacgtcttctacacgggcaaacgcggtaatcaccagagacagaggcgaggtcatttcgcgctgttcggtgccttcctgccagcgggttttcatcgacatggagtctttacccaccggaatggtgatgccaagtgccgggcacagctcttcaccaacggcttttacagcgtcatacaggccagcgtcttcacccggatggcctgctgccgacatccagttagccgaaagtttcacgcgcttcaaagaaccgaccggcgtggctgcaaggttagtcagtgcttcaccgacggccagacgggccgaggcggcaaagtcgagtagcgccacaggggcgcgctcgcccagcgcgaaggcctcaccatggtagctgtcgaggctggccgttgttacggcgcagttggcgaccgggatctgccaggggccgaccatctgatcgcgcgccaccatgccggttacgctacggtcgcctatcgtgatcaggaaggttttttccgccacggtcggcaagtgcagcacacggttcaccgcgtccgtcagcgtgataccgtcgcgctggagtgggtgcccctgagcctgctgtttaaccacatcgcgggtcattttcggggttttccctaacaacacatccagcggcatatcaatcgggctgttagagaagtggctgtcttccagcgtcagatgcagctcctcggtggcttcaccaataaccgcataaggcgcacgctcacgctgacaaatagcagcaaactcggccagcttctctggggcaacagccatcacataacgctcttgtgattcattacaccagacttcaagcgggctcattcccggttcgtcactgaggatgtcacgcaggttaaagcggccaccgcggccaccatcgctgaccagttctggcatcgcgttggacaatccgcctgcgcccacatcgtggataaacagaatggggttgtcatcgcccagttgccagcagcggtcaatgacttcctggcaacggcgctccatttctggattgtcacgctgcactgacgcaaaatcgagatcggcatcggactgacccgacgccattgatgatgcggcaccgccacccaggccgatattcatcgccgggccacccagcacgatcagtttggcacccacggtgatttcacccttctgcacgtgatcggcacggatatttccgataccgccagccagcataatgggtttgtggtagccacgcagttcagtgccgttgtggctgttaacctgctcttcgtaggtacggaagtagccgtttaaggctggacgaccaaattcgttgttaaatgccgcgccgcccagtgggccttcggtcatgatatccagcgcactgacgatgcgctcaggcttgccaaaatcctcttcccatggctgttcaaagccgggaatacgcagattcgacaccgagaatccgaccaggccagccttcggctttgcgcctcgtccggttgcgccctcatcacgaatctcaccgccggagccggttgccgcaccaggccagggggaaatcgcggtgggatggttgtgggtttcaaccttcatcagaatgtgtgccgcttcctggtgataggcgtattcgcctttctcagcatccgcgaagaagcgccccacctcagagccttccatgaccgcagcgttatctttgtaggctgacagaacataatccggtgtttgctcgaaggtgtttttaatcattttaaacagcgatttaggctgtttttcgccgtcgataatccagtcagcgttaaaaatcttgtgacgacaatgctcagagttcgcctgggcaaacatataaagctcaatgtcgtttggattgcgccccagtgcggtaaaggcagccagcagataatcaatttcgtcttcggccagcgccagtcccagcgtcatattggcttcaaccagcgcctgacggccttcaccgagcacatcgacgcttttgaccggctgaggttcatggtgagcaaacagctgctcggcctgattgaaatcgctgtacaccgtttccatcatgcggtcatgaaggagtgccgccagcgcctgccactgggtttcggtcagttcaggcgcctggacataaaaggccatgccacgttccagacgacgcacctgcgaaagatcgcagttgtgggcaatgtcagtggctttcgatgaccacggtgaaatggtgcctggacgcggcgtcaccagcagtaaacgcccttgtggtgcatgttcagcgagagaagggccgtacttgagcaggcgctgcagacgggacgtttcatcctcgctcagcggcgcgctgacatcggcaaaatggacgtactcagcgtaaatatcactcaccggcagatgagcgtcctgaaagcgggtcagcagtttgtttacacgaaatgccgacagggcgggcgaaccacgcagaatttccatcataagatctctcgtcttcgaagcgccgggcgacgcttcattgggcgcaacaggggaaaacggggcgtattatagagaaacccactccgcgacgaaaccgtttgcgcaaaatttatggccaacaagatttgcctgaaatttgcgcaaaacttgctttataagttgctctacctgagtttgttgcgcaaaatgcccctcgctctgggagttaaaacaagatcaatactgccttaaaagacagaggccttggagccatcgagagataactatttgaaacgcctaaaatttaattatctggttatcggtcttctcaccgtgcttctggctttggcactgtggccgtccatcccctggtacggtggtggacaagatacgatctcacagattaaatcacggggagtgctgcgcgtcagtaccgtaaactcgccgttgacttactacaccgtgaacaaagcaccggccgggatggactacgagctggcgaagcgttttgccgattatttgggcgtgaagctcgacataaccgtgcgcgctaacctcagtgacctgttcgatgcgcttgacgatggcaaagccgatttgctggcggcgggccttatctacaacgatgagcgtctgaatcgctatcaaaccggccccggttactacagcgtttcgcagcagctggtttatcgcgtggataaaccccggccgaaaaacctgggtgacctgaagggacggctggtggttgcctcaggatcggcctacctgtcgacgttaaagagcgccaggacaaaccagtatcccgatctcgactgggccatttcgactgatcaaagtccaaaagccctgctggaagccgtggcagaaggcaagctggattacacggttggcgattccgtaacgattgccctgcttcagcgcattcatcctcagttagccgttgccttcgacgtcacggatgaagaacccgtcacgtggtacctgccccatgacagtgatgacagcctgaatgctgcgatgctggatttctttaacagcatgggagaagaaggcgcgatggcccgactggaggagaaatacctcggtcacgtcggcaccttcgactatgtggatacgcgcaccttcctgcgttccattgataacgtcctgcctgacattaagccactgttcgagaagtatgccaataatatcgactggcgattactggcagccatttcctatcaggagtcgcactggaatccgcaggcaacctcgccgaccggcgtgcgcggcatgatgatgttaacgcgtaacaccgctgacagcgttgaagtgggtgaccgtaccgaccccgagcagagtattcgtggcgggagccagtatctgcaaaacatgatggaaaaagtgccacaaaccattccggaagatgaacgtatctggtttgcgctggcggcgtataacatgggctatgctcatatgctggatgtgcgtaagctcaccgcgaaacagggcggtaacccggacagctgggctgacgtgaaactccgtttacccatgttgagtcaaaagcgttactacacgcaaaccacctatggctatgcgcgcgggcaggaagcctacaactacgtagagaatattcgtaagtatgagattagcctggtgggctatttgcaggagcaggaaaaacaccttgcccaacaggccgctctggaagcggagatgggcaaaggttatcctgccgtcacgcccgaggtggcaatgaactaactgtcgcgctgcgcctgacgcagcgctttttgttgctggcggcgcatacggaaaaaatcgctcagcatccccgcgcatgcctcttccagcacaccgtgatgcaacgccacctgatggttcattcccggatgacctaacacgtcaatcagggagccggctgcgccggttttcacatcgtgcgccccatataccagacgaccaatgcgagcatgcaccatcgcccccgcacacataatgcacggctccagcgtaacgtagagcgtggtatcaagcaggcgatagttttccagcacttttccgccctgacgtagcgccatgatctccgcgtgggccgtgggatcgtgttgcccgataggccggttccagccctcgcttatcacccgctctccctgaaccagcaccgcgcccactggcacttcgccctgctcccatgcgcgctgcgccagggtaagcgcacgacgcatccagtattcatcttgttcttgagtcacgcagaccactcccggcagcaaaaaagcggcgcattatacccatcacgcccggaaaaccgaagcgcgatggccgttattccagctgctgtaattcaccaaccggcgtgacgcgccagcgatgctggcaaaagaacaacaacgggttgtcctgtttgctgtcgctgtaaccgctataaagctgcaatggcgtaccgatctgctcttccagctgcacgactttttcgtgaccaaggcagcgcattttcaacacacgtcctcctaaaccgcgctgcatctggctggcgatcagctttactcgtggcaaaaacgcggagtcataatagacctgttcaaccagagactggggggaccctgtaatcagccacacatctgcatcatcactgctgaggtattcactgaggcgtttctgcaccacgggaaaggctttaacgcgttgccgaaaccattgggcgaattcggcctccaggcgcaacagggttgcttcagagcggccaaaggtaatcgaccacaacagcaaactcatcggccagcgcgcggcacgtcccttgaccaataatcctgcgcccaccaccggcagtaacgggaccaccagcaaaacattcagcggcttgcgacgcagtagatagcgcatgaaggtgccaaacatgtcctgttggtgcaatgtgccatcaaggtcgaaaaacaccacgcgacgttgtatatcgttggtcaaacaacactcctttttaacgaatatgcatcaacagcctctattgtagtcatcttcgtccagcgaggcgatgactgtcattttttattccagtgactacaatgcccattgaatcatttattccatgcggaacatccgctaaatcacaaggattgagcatgagttcattgctgcgcattcgccagctttatccctctctggcgctgaacgagcggcggctggcggattttttactgtcacaaccggatcgggcacggcatttaagttcgcaaaagctggcggaagagtcaggagtcagtcagtcgagcgtggttaagtttgcgcaaaagctgggatacaaaggttttcctgcgctcaaactggcactgagtgagtcactggcggataaagatgccattactgtgcacaatcagatactgagtgacgatccgcttaaagcggttggtgaaaaattgctgacggaaaaactctcggcgattcgtgcgacgctggatatcaacagtgaagagaaattaaatgccgtcctgcagttgcttaaacgcgcgcgccgtatcttgctggtcgggattggtgcctcaggcctggtggcaaaggatttttcatggaagctgatgaaaatcggtatcaacgcggtggcggaacaggatatgcacgcgctgctggccagcgtgcaggcgatgtctgccggcgatgtgctgctggcgatttcctataccggcgaacggcgtgagattaatcttgccgcgcaggaagccgttcgtgtgggcgcggacgtgctggcatttaccggctttacgccgaatacacttcagcagtgcgctacgcattgcctgtacaccgtggcagaagagcagagcacacgcagcgccgccatctcgtccaccaccgctcagctggcgttaaccgacctgctttttatggcgctggtgcagaacgatcctgagcgcgcatccagccatattcgtcacagtgaggcgctggttaagaagctgatttaggcagaaagccaggctcactaagcgtagataatatgctaagcatataatgcaagaagccagcgataacgctggcttcttgcaatgctgtgaatactaaccaaaccttaaaagactagctacgactcagatcttgcgtagagataggtaaatactggctcatccctgtagtcgctgattcgactgctgccttgttttttgctaccagatagaaggtttcagccgtaggttgctgagcgtgatccgcagaataaagggcaaattttacgactttctttccaccttcatacttgcattccatatcccagcttatcgttgttccttgcgttgctttacatttaccctttccataggtgtactgcaggaagttattcgttttattttccgccgacgcaacgaaatctggccgagatccgcctgcggagaggcttgcataagctgttgttgcagccagaacagccacgcctgctattaaaagaattctttttttcacctgacacaatccatcgatatttttgatgagtggattttatcggaaaaatcctaatcacgcatctgctctcactcattttatgacaagatatttctactgagcgcattttttgtgtaaaccttacaaaacctgcgaagatgacttccagcggttctaaagcctttgctcatcctgacgtctaaaacttcaactaaagaaagttaatttctttagctctgagcataccgaacgcgataagaaccatataaatcaatgcgttattaattttattttggtctttcaggattttacctatcagcatcatttttgcgttaaacagaatatgatactgtctggcgggcttagggcggcagacaaagcctcatggctattgatttcggacttatacctgtagcgccaatagcgaaagttgcgctgagacattttggcgtattttactgccgataatggcataaacgaccaatattatttatcgaattaagaaaccacaatggctttactgattaccgaacgctgtattaactgtgacatgtgtgaacctgagtgcccgaaccaggcgatctcaatgggtgagtcgatatatgagattgatgtgagtcgctgtaccgaatgtgttggtcattacgatgtgccaacctgccagagcgtttgccctatcgataacacgatcatcattgatccacagcacatcgaatcacgcgatgcgctgtgggataagtttgtacagctagatggttagctttcgataatcaccgtggcgcaggcatagtgacgctcgtccgccagggtgacatgcacatgttgcacgcccagccgttgcgccatctcagcagcatgatcgaagaagcgcagcagcggtttacccagcgcatcgttataaacttcaaactggttgaaagccagcccgccacgaatgccggtgccgaacgcttttgctgccgcctctttgaccgcaaaacgcttagccagaaagcgcaccggctgaaggtgctgctggtactgctgccattcggcatcactgagcacacggcgtgccagacggtcacctgagcgtgaaatcacgtcggcaatacgcgctatttcgacgatatcgctacccagtcctaagatagccattaacgacgcgcttcccgcagcagctgtttcatctctttcaccgcctcaggcaggccgctcatgacggcgcgtccaataatcgcatgaccgatgttcagctcatgcatttccggcagtgcggcaatcggcagcacattgtgataggtcaggccatgtccggcgttgactttcaagccgcagctggccgcaaaggtcgcggcctgacggatacgtgccagttcagcctcgcgggccgggccttcaggcgcttctgcgtaggcaccggtatgaatttcaatatagggcgcaccgctggtcaccgccgcctcgatttggcgatgatcggcatcgataaacagggacaccaaaatgcccgcttcgctgagttgtttcaccgccgcgttgagtttttcctgttgtcctgccacgtccagcccgccttctgtggtgacttcctgacgcttttccggcaccaggcagcaaaaatgcggtttgatttcacaggcgatagccagcatctcctcggtcactgccatttcgagattcatacgcgtttcaatggtatcgcgcaggatgcggacatctctgtcggtaatgtggcgacgatcttcgcgcaggtgcacagtgatgccgtccgctcccgcctgttcagcgataaacgctgcctgtaccggatcgggataatgggttccacgtgcgttgcggacggtagcgatgtggtcaatattcacgcctaacagtaactcagccatgacaatcctcggttcattatggtcattgtgctgagtgtaccgcgcagagataaggccaggctacggtcagagctctgtctcgtcagaaatagtcggcttttttttcggtgtaaactggcgaaaaagctcctggctttttagcggtttaccgcccagatagggtttgagcgccatgcgggtgaaacgcttggctgcacgcagggtttctgcgtcggggaattctcgggtaaacagcgcctgcagctcgcgaccggtgaaactacgctggttcagcaccaggctggcaataaagcccttctcttcacggtagctgtaggtcatggtttcgctgaccggttcgccgctgcccgcgcagtgcaggaagtccacgccgtagccaaggtgtcccagcagcgccagctcaaagcgacgcagcgccggttcgggtgaaccttcggcccctgccagcatctggatgcattgcaggtagtcaaaaaacagttcagagaagggaatgtgctgttccagtacccgagacaacagctcgttgacgtacaggccgcaataaagcgtgataccgctgagaggtaaggccagggagaccgcttcagcgttgcgcagggtttttacgtccccgcgcccgctccagcgcaccagtaaaggcgtaaaaggctgtaacgtgccttttaactgcgaacgccgtgaacgtgccccttttgccagaacacgaacgcggccttcactttcactaaacaggtcaagcagcaggctggtctcgctgaaagggcgactatgcagcacaaaggcgcgttgccagccttccatttaatcagagatcgtctgtgtaacccaggctgcgcaacgcacgttcgtcgtccgcccagccggatttaactttaacccacagttcaagatgcactttcgcgtcgaacatctcttccatgtctttacgcgcttcaataccaatggttttgattttggcacctttgttaccaatcaccattttcttctgcccttcacgctccaccaggatcaaaccgttgatgtcgtaaccgccgcgcgcattcgacacgaactgttcgatttcaaccgtgaccgagtaaggcagttccgcgcccagaaaacgcatcagcttttcacggatgatttctgaggccataaagcgctgagagcgatcggtgatgtaatcttccgggaaatgatggtcagacgccggcagatgcttacgggcaatagccgcaatggtgtcaacatttttaccgttttctgcggagatcggcacaatatcgataaagttcatctgctggctaaggaactgcaaatgcggcagcagaatgcttttatcctgaatattgtcgattttattaattgccagcagcacgggcactttgccatcgcgcagcttgtttaataccatttcgtcatcgggcgtccagcgcgtgccgtccaccacaaagatgatgagttcaacgtcaccgatagaactgctggccgcacggttcatcaggcggttaatcgcccgcttctcttccatgtgcaaccctggcgtatccacatagatcgcctgataggcgccttcagtatggatgcccataatgcggtgacgagtggtttgcggcttacgcgatgtaatcgagaccttctgccccagcaactggttcagtaaggtggatttgccgacgtttggtcggccaactatcgcgacaaagccgctgtatgtaacgttttcgctcattcgaatcctgaggttttcagcgccggttgcggcgccgggataaaactattccagaccaagtttaatcagcgcctgttcggctgctgcttgttcagctttacggcggctggaacctacgcccaccaccggctctgccatgccactcacctgacagtgaatggtgaattcctgatcgtgggcttcgccacgtacctgcaccactaaataacttggcagtggcagatgccgcccttgcagatactcctgcaggcgcgttttgggatctttttgtttgtcacctggactgatttcgtccaggcgcgtctgataccagtcgaggatcagtttctccaccgtctgaatatcactgtcgaggaacacgccaccaatcagcgcctctacggtgtccgccagaatggattcacggcggaagcccccgctttttaattcgccagggcctaaacgcaggcattcacccaaatcgaactcacgcgccatctctgccagagtgttaccccgcaccagcgtggcacgcatacggctcatatccccttcatccacgcgtggaaaacggtgataaagcgcgttagcgatcacatagctgaggatggaatcgcctaaaaattcgagacgttcattgtgtttactgctggcgcttcgatgcgtcagggcctgctgtaaaagttcagaatgtgtaaaagtgtagcccagtttacgctgaagcttgttaatcaagatggggttcatgcgattccagttctgttttgcgtctgtcactctgcataccaaacagggctggaaaaccaacacattctgtttggtgtgcagtggcccccaaatggaggccaccctatttgcctgacggtcaggctacggttagtggataccaccaatacgactgagtcgtacgccggttggccactgaccttcttgtttttcgaaactcatccagatggcgaccgctttacccaccagattgcgctcgggcacaaagccccagtagcggctatcggcgctgttatcacggttatcgcccatcatgaaatattgtccctgcggcacaacccagctagcctgcggctgacccggctgctgataatacatgctcgcctggctttgtgcttcggttactaacagaatgtcatgcgtcacatcgcccagcgtttctttgcgcgttgccagacgtaatccgccctgcatgctgtcattcagcggtaactgatagaaaccattacccgcttcattgccgtcaaacccgctgaacgtctgaacaaatttgctgggttcgatattgctgtatgtcacaggcagcgctttgctacaaggtttgccattatcgcaggccgggttaatggtcagcgttttactgtatggatcgtacgtgacccgatcgccaggcaaaccgatcacgcgtttgatgtaatccaggctgggatctttcgggtatttaaataccgcgatatcaccgcgttttggatgcccggtcgggatcagcgtcgtttgcgtaatcgggtctttaatcccgtaggcaaacttctcgaccagtataaagtcaccaatcagcatggttggcatcatggaaccggacgggatctggaagggctcataaacaaaagagcgcacaaagaacaccacggccagcaccggaaatactgatgctgcggtttcaatccagcccggcttaggtgccatcttcgccagcgctttgctgtcgagtgaacccccggcctgcgcctgcgccgccgcctgcaccgcgcgccgctgtggtgcccacttaatacgatcaatcacccaaagaataccggtaatcaatgtcgctatcgccagtatcagggcgaacatattagccatttgagatccttatttgctgtcttttccgacatgcagaatggcgaggaatgcttcctgcggcagctcaacgttaccgacctgcttcattcgcttcttaccatctttctgcttctgcaacagctttttcttacgactgacgtcaccgccataacatttggcgagaacgttcttacgcagctgtttaacggtcgagcgagcgataatgtggttgccgatagccgcctgaatcgcaatatcaaactgctgacgtgggatgagttctttcattttctcaaccagatcacgtccacgataaggtgcgttttcacggtgggtaatcagcgccagcgcatcaacacgttctgagttaatcagaacgtcgacgcgcaccatgtcagaggtctgaaaacgtttaaaattatagtccagtgaggcatagccacgtgacgttgatttcagacggtcaaagaagtcgagcaccacttcggccatcggaatttcataggtcagcgccacctgattgccgtggtaaaccatgttggtctggaagccacgtttctcgatgcacagtgtgatgacgttgcccaggtactcctgaggcagcaacatatgacactcggcaatgggttcacgtaactcttcgatattattgagcggtggaagctttgacgggctatcgacatagaccacttcgccgctcgtggtttgcacttcgtatacaactgtcggtgcggtcgtgatcagatcgagatcgtattcacgttccagacgctcctgaatgatctccatatgcagcagacccaggaagccgcagcggaaaccaaagcccagtgccgttgaactttcgggttcgtagaacagtgaggcatcattcagactcagcttgcccagcgcatcacggaaggcttcataatcatcagagctgatagggaacagaccggcataaacctgcggcttcacttttttaaagcccggtaaggctttatcagccggattacgtgcggttgtcagggtatcgcccactggcgcgccaagaatatctttgatggcgcagaccagccagccaacttcgccgcagttgagttcattgcgatcaacccgcttcggcgtgaagatgcccagtcggtcagcattgtagacctgaccggtgctcagtaccttaattttatcgcctttacgcatggtgccgttttttacccgcaccaatgatacgacgccaagatagttatcaaaccaggagtcgataatcagcgcctgcagcggggcttctggatcaccttctggcggcggaatgtcgcggactaaacgctccaggacttcaggaacgcccacgccagttttggccgagcaacgcacagcatcggttgcatcaattccgacgatgtcttcgatttcctgagcaacacgatcgggatcggcagcgggcaaatcgattttattcagcaccggcacgacttccagatccatctcaagtgcggtatagcagttggccagggtttgtgcttctacgccctgtccggcatcaaccaccagcaatgcgccttcacaggctgccagtgagcgggaaacttcatatgagaagtcaacgtgtcccggtgtgtcgatgaaattgagctggtaagtttcgccgtctttcgctttgtaatcgagcgttacgctctgcgctttaatcgtgatgccacgctcacgctccaggtccatagagtcaagaacctgtgcggccatctcgcgagcagttaatccgccgcaaatctgaatcaagcggtcagagagcgtggatttaccatggtcaatgtgggcgatgatggagaaatttcttatgtgcttcatttataggaatatcttcacgtagagaatcagttaggaacctgagcacagacacattcaggaagatcgctcttaacccacaatcctgtcagcctcattaatgacgacgcatattacactgttaaggccgcgcataaaagaatggaacgttgtggaaacgaaacagttttttgcgaggagtcataatggcaaaagccgcagcaagtgcggcttgagtgaggatcaggcttcgctttcaacgcgcagcgcatcaggcggcaaagcgatgttcaaaataacgggctggaaggcttcacgatcgccaaatttcatggaaatgcctttcgcaacgataaacccgcccacaccgcctaacagcgcaccgctggctgccgccaggtcgctgccaaacagcgcctgaaacaggccggcaaacaggaacaggccgaacagtggcgtcatataaaccagcagcgctgaacccagcaggctgctctctttgatgcccagttcaacgcgctgacctggctccagcggcttgctgctggctatctgcatcacgtgcgcattcttaggacccagcttattcagcatatggctgccacagcctttacgagcctggcagctgttgcaggacgtttttgcttctgtgtgcagcgtggcgatgccatcctgccatgccacaacggtggcccattctctcatcattttttcgccccgagctcgacgctgtctgcgatacgttttgccgtcacgggcggtagctcgccgacgaccgtaatctcgttattatcgcgtattacggtctgcaccgtacgacgtcccgtgcgcaatgtctgtgcggtgctgtttttatctgctggcgtcacattgacggcaaagctaaacaacccatcgctgtaaagccgtgactctagcgatttatttaatgtgggaatcattcgacggctttgagacaccagcgtcattccagcgggaagccagtcgggctgccagtctaacgagacgttatcggctttagttaatgacaacgacggcggcagattggctttctccagtccctgcatcagattacgtacgccatcatcgaccgcaaagctgataacacggaattgctccatcgtttcgccatcgcggtccagcaaatcgacgcgaagaggaagcttggtatccacgtccagccatacaacatagctgtagcgcgtgccatcgcgtgaaacgatgcgcaccacgtcgcacatctggtcggcaatgcgcgagcggcctacggtaataaagtcataggcgacgtccagcttggcgaaatcggcataaataatggacgggagcgcatccacaatgtgattgcccggcagagagaaaggctcaatgccgggttcaaaatagctgatatcgttgccgcgctgaatcacttcacgaggcgggccgtccatctgcagcacctgcgcatacacgcgatcgtcaataaccgcatgacgatagcgcagcgattccatgccaaggcgggacacattgatataggcgaattcgtagttgagggtctggcttgcctgctccatctgctgcaataacgccccagacgcagaaacctgcgctggggcggcagatgaccacaacaggctgcctgccagaaggctgacggcataccatagcggcttcattactgctgctgcattcctaatgactgattaccagggacattggcctgcgcttgtttaggcgcattggtttcaaactgcagctggtccgcatggaggcgacgctggagttcatagtcctgcagcatggcattgacgcggcgacgctggtcctgcacctgttgcgtgacattaccgccgccaaaggcatcagacggcacgcccaggctcacaggtgaggctttacccatcacaggtaaggtattaaacaccggcgagtcggaactttcgacgccgccgctggccggttggttgtaatgctggacgccaacgataacagccagggaaacacaggcggcgacgccaacctgggtaatctgtgccgcccacgggcgaactttatgccagaacggcattttttcccagcgagaaggttcgggctgtgcttcggggatcaaggttgtaacgttgcgctgtggctctttttcaatagcagcagcgacgcgcgcagcaatatcaaaatgcaggtgctcaccaacatcaccacgcatggtatcgcggatgagatggtagcgttcccagcttttttgtagatctgcatctttagacagcgctgaaaacagctcgttatctaaagcctcaccatccattaaagcggaaagtttttctttctgcatgcctaatacccttccagtagccgttatcactgacgttggataagcggttgaactttattatcaatggcctcacgtgcacggaagatacgcgacctcaccgtgcccaccgggcaatccataatgacggcgatctcttcatagctcagaccgtcaagttccctgagggtaattgccattcgcaagtcctcaggaagcgcctcgatggtacgaaagacgatttgtttcagttcatctgacaacattaagttctcagggttcgaaatttctttcaatgcgcccgcactttcgaagttttcagcatcaattgcatcaacgtcactggaaggcggacgccgtccctgagcgaccaaataattttttgctgtattcactgctatccgatacagccatgtgtaaaacgcgctatcgccacggaacgaatccagtgcgcgataagccttaatgaatgattcctgaacgacatcaggcacatcgcctgaagggacatatcgtgagaccaggctcgccactttatgctggtaacgaattaccagtaagttgaaagccttctgatcccccttctgaacccgttcaacaagaacctggtccgctaactgctcgctcatccgaggtaatgtctccccaaatactttcttatgcgttaaggaactgccagcacaccgctattgagcaagcatgcgctttgagtctttgcgtggcgaaaagttcactctcagcctctttttagccactttacggcagaattacacagtttgttggttttcgttcagtgtaaagcgcgcaaatcgcaggcagagtaacctatgacaacagctttttcatctttaaatccttgtaatcgattaagtttggtataaaaaaccctgcttaaagccgttatacattaaccttttgatatatctgataaattaatttaaaggcgcgaatcctgcgccgtttgtgttcaaaatacttcacaaaaaacgaccaaacgcttatgctcggtccattcttgtttagtaaattaaacaccatgacaactttctctccctcagattatcagtgcgatgtactcattgtgggcagcggtgcggcaggattgtcgctggcattgcgtctggcagagcattatcaggtcaccgtattaagcaaagcgcaggtgaatgaaggctcgacgctgtatgcgcaaggcggcattgcggcggtctttgacgaaaccgacagcattgattcgcatgttgaagacacgctggtcgcgggggcaggtttatgcgatcgcgctgccgtctcgttcgtcgccagcaatgcgcgtcactgcgtacagtggttgattgataacggggtggcctttgataccgatccacaggctgcgggggagatgcgctatcacctgacgcaagaaggcggccacagtcatcgccgtattctgcacagcgcggacgcgacgggccgcgaggtagaaaccacgctggtaggtcaggcgttacatcatccgaatatccgcattcttgaacgcaccaacgcggtggatcttattctttcagataagctcggcctgccgggcccgcgtcgtgttaccggtgcctggatctggaaccgtaaccgcgaacgggttgaaacctgccgcgcacgtgccgtcgtcctggccacgggcggtgcggccaaagtgtatcagtacaccacgaatcccgatgtcgcatcgggcgatggcattgcgatggcatggcgggcaggttgccgtgtggctaacctggagtttaatcagtttcaccccacttgcctgtttcatccccaggcacaaaactttctgctcaccgaagcgctgcgcggcgaaggtgcgtggctggtgcggcctgatggttcgcgttttatgcccgactttgatgcacgcgctgagctggcaccgcgcgatattgtcgcccgtgccatcgatcatgaaatgaaacgcctgggcgtggactgtatgtatctggacatcagtcatcagcctgaagcgtttgtgcgttcgcacttccccatgatttacgaaaaactgctcacctttggctttgacctgacgaaggataagatcccggtggtgcccgccgcccattacacctgcggcggcgtgatggtgaacgagcagggccgcaccgatatcaacggcttgtacgcgattggtgaagtcagctataccggcctacacggtgccaatcgcatggcgtcaaattcactgctcgaatgccttgtctatggctggtcggcggcggaagatctgctgcgtattttacccgaggttgacgctgtagacagcttaccggcctgggacgacagccaggtggatgatgccgatgaacgggtggtgattcagcataactggcatgaactgcgactgtttatgtgggactacgtggggattgtgcgcaccaccaagcggctggagcgggcattgcgtcgcatcacgctgttgcaacaggaaatagacgagtactaccgtcacttccgcctgtctaataacctgctggagctgcgaaacctggtgcaggtggctgaactgatggtgcgctgtgcgctgcagaggaaagagagtcgcgggttgcattttatccgcgactatcctgatttgttacccgaggcacaacctaccgtgctgcaacccggtcatgacataaataaatagaagtcgcgcgtcaggctttgccaggcttcagagtattgtctgtccgcgtcgcgaatagccagccgttcaaacagggtttcgcctgcgctgggggaaaaccccagtagcacccgatgaggtgggcgatgcgcgtattccgcaacgtcaaagcgaaagcgtaaatgccagccgtcagcctgcgcctgggcgataacctgctgccctgtcgcttcgggtaagatcacacagaaaaacccctcttcttcaatcagcgaggccgcacaacgtaataatgtttggtgatctaacgaaccggtggcgcgcgcactgtctctagcggacgtcgcgcaggccacaccgggctcaaaataaggaggattactgacgataagcgagtagcgcgcttcgcagttttcagcccactgggcgatgtcctgctgatggacatgaatccgcgttgcccagggagagtgctggatattttcgcgcgcctgctgtgcggcatcgggatctaactctaccgcatcaatgtcaaccgctgacggagtacgctgggccagcatcagggcaatcagccccgaaccagcaccgatatcaagaatccgcttaactccggccaccggcgcccatgcgcccagcaaaataccatctgtaccgaccttcatcgcacagcggtcgtgggcaacaaaaaactgcttgaaggtaaaaccattcttttttaattgtggccgcgtctgcggcttgtcctgcatcatactcagcgaccattcacctttttacctgccgtacggcaaggggtcagtgtaacgtggtgggttggggaattcacgtcgttgacgtaatctggcgcagtcaataccgataaacagatgaagattatgtccgatctgtctataatcagcgccccaaactgaggtagaacatgaccgtaaccacattttccgaacttgaactcgacgaaagcctgcttgaagcgctgcaggagaaaggctatacgcgccctacagcaattcaggctgctgccattccccccgcgctggagggccgcgacgttctgggttcggcacctaccgggaccgggaaaaccgctgcgtatttattaccggcgttgcagcacctgctcgattttccacgtaaaaagtctggtccgccacgcattttaattttaacgccaacccgcgaactggcgatgcaggttgccgaccaggcgcgtgaactggctaagcatacgcacttggatattgcgacgatcacgggcggcgtagcctatatgaaccacgccgaagtgtttagcgagaaccaggacgtggtggtggcgaccaccggacgtctgctgcagtacattaaagaagaaaactttgattgccgcgccgttgaaaccctgattctggatgaagctgaccgcatgctggatatgggctttgcccaggatatcgaaaccatcgcaggtgaaacgcgctggcgcaaacagacgttgctgttttcagccacgctggaaggcgaacacatcaaagattttgccgagcgcctgctcaatgatccggtcgaactggaagccgatcccagccgtcgcgagcgtaaaaagattcagcagtggtattaccgggcagatgacctggagcacaaaaccaaactgctggttcacctgttaaaacagccagaagttacccgcaccattgtgtttgtacgtaagcgtgaacgtctgcatgagctggtcggctggcttcacgatgccggcattcgtaccagttaccttgaaggtgagatggtgcaggcgaaacgcaatgaggcgattaagcgcctgattgagggacgcgtaaatattctggtagcaacggacatcgctgcgcgcggtatcgacgttgacgacgtgagccacgtgattaacttcgatatgccacgcacggcggacacctatctgcaccgcattggacgcaccggtcgtgccggtcgtaaaggcattgcgatttcgctggtcgaagcgcacgattatctgctgttgggtaaagtcagccgttatgtggatgagccacttaaggcgcgcgtgattgatgagctgcgtcctgtgacccgtgcgccctcaccgaaatccacgggaaaaccgtcgaaaaaggtgcttgtgaagcgtgcagagaaaaaagcgaaagacgaagagaaaccacgggttaaaaaacgtcatcgcgatctcaaaaatgtcggtaagcgccgcaagccaagcggcagcacgccaggcagcgagagtgcggaataattcaacacccgctcaaaaaaatcgcctctttatgaggcgatttttattttatcaggccagtaaatactgctttagtgccattttaacgcccaacaggttactccggcctcacagtcaggtgtgacgcgcctgcccgaaaagttatctccttgttaatagaaataaattcccggataaggcgttgcgttttatttcgacaccagagccattacaaactttctgtaaaggtgcgggtaatcacgtcgcgctgctgttcagcggtgagtgagttaaaacgtacggcatagcccgacacgcgaatagtcagctgtgggtacttctcgggatgtttcacggcatcttccagcgtttcacggcgcaatacgttgacgtttaaatgctgtccaccctcgacgcgcacctgaggtttcacctcgacaggcacttcacggtaagcgacgtcgccgagttccccaatcgtcacaatctgatcctcctgatagcctgcgacggcacagagacagcgcgcctgcgctttttcctcgtccagcagccaaaacgagttaattaaagccggattactcgattgggtaatctgaatacctgtgatcatttcaatccctccaacaacgtgctgacggttgccaacaccgtgaatcagtcaatttgagctgttggtatatcacccgatagcgaccatgactttgacctgcatcaattacaatcgggcgttttatcctcacgctggtaagcttttgattttaaaaacgcgccttaagaaaatttcgtttaatttttaaaaaaattttgggcttcatgtctgcagagtgaaccgctaagcttaaggttcgaaatacaagggagttgatcatggctgaaaagctgacctggcatgacgtgctggctgaagagaaagaaaaaccctactttatcgaaaccctgaaacatgtcgctaaccagcgggctgcaggcgtaacggtttatccgccgcagaaagatgtgtttaacgcgtttcgcttaaccgaattaggcgatgtgaacgtggtgattctgggacaggacccttatcacggcccccatcaggcccacgggctggctttctctgtactgccgggcgtacagacaccgccgtcattgcaaaacatgtacaaagagttgcagcaggacattccgggctttgagaaacccaatcatggttatctggccagttgggcggaacagggcgtgatgttactgaacaccgtactgaccgttgaagccggtaaagcgcattctcatgcccgactgggatgggaaacctttaccgatacggtgatcaaggctatcaatgagcagcgtgaaggcgtgatctttctactttggggctcacacgcgcagaagaaaggcagcattatcgatcgccagcgccatcacgttctacaggctccgcacccttccccgctttcggcacatcgtggcttctttggctgccagcatttttccaaaaccaatgcgttgttacgcgatgccggtaaaaccccgattaactggacgccggtcttacctgagtaaacgccataaacacaaacggccgcgtcagtgcgcggccgttgcaggataaagcaataatcaggctttcgctttcgccacggcaaccatagccggacgcagcaggcgaccattcagcgtataaccaggttgcatcaccatcatcacgtggttcggctcgaaatcctcagattccatcatcgacatagcctggtgcacttccgggttaaacggcacaccggtttcaccgaccacttcaacaccgaatttacgcaccgcgcccagcagggatttcagcgtaagctcaatgccttcaaccatagaggcagacttctcgtcttctttgtttgccagttccagcgcacgttccaggctatcaatcaccggaagcagctcattggcaaacttctccagcgcaaacttgtgcgctttttcaatatccatttcggtgcggcggcgaacgttttcaatttcggcctgcgcacgcagttgagcatcacgtacgcccgtctgcaactgggctaactcagcttcaagctgagcgatgcgctcatcacgcggatccacctctactgctgtctccgcgtcctgaggttgatgttgatcctgttgaatttcgtctgagacttgctcgtttggggtgttctgttctttactactcatgaatttctccgcgttttgcacattcacttcgctggttggcttattatggggattggtttgacggtttcaagggaacacgtcacatcatcgtgccgatttggcttatgaggaacacccactcgatgaacaaacactttaactgtattggtattgtgggccatccacgccatcctaccgcactcacgacgcatgaaatgctgtgtcgctggctgaccgccaaaggctatcccgttattgttgaacagcagattgcgcaggaactgtcgcttggcgatgtccagaccggtacgctggctgaaatcggtcaaaaagccgatctggccgttgtggtgggaggtgacggtaatatgttaggcgcggccagagtgctggcgcgttatgacattaaagtgattggcattaaccgcggcaacttggggtttttaaccgatcttgaccccgataacgcgcatcaccagctcgatgaagtgctaaacggcaactattttgttgaaagccgcttcctgctggaagcgcaggtgtgcaagtcggattgctcgccgcgtatcggcagcgccatcaatgaagtggtgctgcatccgggcaaagtcgcccacatgattgagtttgaagtttatatcgacgaagtttttgccttctcgcagcgttcggacggcctgattatttctacgcccaccggctcgaccgcctattcgctttccgctggcggcccgattttaacgccctctctggacgccattaccattgtgcccatgttcccgcacaccttgtccgcgcgcccgctggtgatcaacagcagcagtacgattcggctccgtttctcggcacgtcgtaacgaccttgagatcagctgtgacagccagattgcgctgcctatccaggaaggggaagatgtgctgattcgccgcagcgaaaatcatctcaatcttatccatcctaaaaattacagttatttcaacacgctgagttcgaaactgggttggtcaaaaaaattgttctgaaaatgaccgcgccctctttactgtataaaaaaccagtttatactgtatgaaaaaccatatgtgtttattcatacaggtgacgctatgctggcacaactgaccatcagcaatttcgctatcgttcgtgagctcgacattgattttcaacgcggtatgaccgccatcactggtgaaaccggtgcaggtaaatctattgctatcgatgcgcttgggttgtgccttggcggacgtgccgatgcggatatggtgcgtcagggcgccagtcgcgcggacttgtgtgcgcgctttcaaatcaaagcctcgccgtcggcacagcgctggctgactgacaatcatctggacgacggtagcgagtgtctgctgcgccgtgttatcagcgccgatggtcgctcacgcggctttatcaatggcacagccgttcccctctctcagttacgcgacctgggccagttactgattcagattcacggacagcatgcccatcagttgctgctcaagtccgatcatcagaagcacctgctggatgcctacgccggtcatgacgacttgcttgttgcaatgcgtgcgtcctaccagacgtggcaccagagctgccgtacgctggcgcagcatcagcagcaggcgcaggagcgtgaatcccgccgagagttgttacagtatcagcttaaagagctgaacgagtttgccccggtggcaggcgagtttgagcagattgacgaagagtacaaacgtctggccaacagcggccagctgttgtcgaccagccagcaggcgcttcagctgttagccgacagcgatgacaccaacctgaacagcatgctgtacagcgcgcgtcagatgctgtctgaactcagcgcgctggatgacaaggtgagcggcgtttataacctgctggaagaagcggcgattcagttgagcgaagccagtgacgaactgcgccactactgcgacagtctggatctggacccgaaccgcctctatgagctggaacagcgtatctcccgacaaatcgccctggcccgcaagcatcatgtggcaccagaaggcctgcccgctgtgcaccagcaactgctggatgaagcggaactgctgtcacagcaggaaagcgatcaggaaagcctgcagacgttggtaaccgagcactacaacgcagccctccagtgtgcagagcaactgcacgctcagcgcagccgttatgcaaccgagttacagcagctgattacccaaagcatgcatttgctctctatgccgcacggtcgctttgccattgagctgattttcaaccctgagcaactgaccgccgacggtgccagccgcattgattttcaggtgacgaccaaccctggccagccgttacagccgctgggtaaagtcgcctctgggggtgaactgtcgcgtatcgcgctggcgattcaggttatcaccgctaagaaaatggaaacgccggcgatgattttcgacgaagttgacgtggggattagcggtccgacggctgcggtagtgggtaaaatgttgcgccagcttggggaatccacccaggtcatgtgcgtaacccatctgccgcaggtggcgggttgtgggcatcagcatttctatgtcagcaaggaaaccgatggcgaaatgacggaaacgcacatgcagcctctggataagcgcgcacgcctgcaggaactggcacgcttactgggcggtagcgaggtcacccgcaacacactggctaacgcgaaagaacttttagcggcctgatatgcacttttttaccacagcgtggtcatatgcatgctctgtagaggtttccaatagcgaaaaggtttattatcatcgacagctaatgtcgcctgaataataaagcctgccgcaggcagagttcagaatttgatggcagaagaacagcctgtaaaaggcgtttcgccccggaaaaggaatgtatagatgcgctgtaaaacgctgactgccgcggcagtagtaatgttaatgatgaccgcaggatgttccactttagagcgcgttgtttatcgccccgatatcaatcagggtaactatctggttgccaatgatgttgccaagcttcataacggtatgacacagcaacaggtggcctatacgctgggtacgccaatgatgaaagatccctttggcagcaatgtctggtactacgtgttccgtcaggagccaggtcacgagaaagtgaaacagcaaacgctgacgctgacctttgaccgcagcggcgtactgaccaacatcgacaacaagccagcgctgtcttcgcaggataactaatcgaagaggcaaaggtcgttaccgacaaacgaccgggcatcacagaatgtaaaaaggcgctgataagcgccttttttaatgactggagtttgaaccaacaggttattttttactgctcgccgcgcgctccgcacgttgacgacgaagctctttaggatcggcgataagcgggcgatagatctctacccgatcgccttcctgcacgctgtcgctcagttttaccggatggctgtaaatccccaccttgttgctggccaaatcgatttcaggccgcagttccagtaagcctgatttgcggatagcctgctcaaccgtgctgccctcttccagttttacatagtgctgatactgtttttcgggcagggcgtacaccacctcgacagagatatcaggcactgtaaacctctttggcgcgctgggtaaatgcctgcaccatgctattagccagttctttaaagattcgaccaaatgccatctcaaccagcatgttggtgaattcaaactccaggcttagctcaaccttgcaggcatcctccccaagatcgataaagcgccagccaccggtgagtttacggaacggcccatcgaccagttgcatatgaatgctctggttgtcagtcagcgtatttcgggtggtaaatgttttgctgatgcccgctttcgacacgtcgactgaagccgtcatttggttttctgaggcatccagtacgcggcttccggtgcagcccggcaggaattgcgggtaagcatccacatcatttacaagttggtacatttgtccggcgctaaaggggaccagcgccgaacgactaatctgagccataatggttcctgttcgtcacaaaaccgctaaataatagcattttcagcgattaaacaaaaattcctcattgtcatggtgtgctagaatagcctgtttcctgctgccccgctggactggggatgcgataaccgaccaagtgatgtaaaatacgcggcattatgacaaagaaaaaaacacacaaatccggttctgccaccattgccatgaacaagcgcgctcgccatgaatacttcattgaagaagaattcgaagctggcctgtcgctacagggatgggaagttaaatcactccgtgcaggtaaagctaacatcagcgacagctatattctgctgcgcgacggtgaagcgtatctgttcggttccacttttcagccgctggcggtggcctcatcgcacgtggtctgcgatcccacccgcagccgtaaactgctgttaaagcagcgtgagctggactcactctacggtcgtgtcaaccgcgaaggctataccgtcgttgcgctgtcgctctattggaaaaacgcctggtgtaagttaaagattggcgttgcacgcggtaagaaagagcacgacaagcgcaacgacatcaaagatcgcgaatggcaaatggataaagcacgcattatgaagaatgccaatcgttaaacactggaattcgatacgcttttttgctagtatttgaagttctggggctgattctggattcgacgggattgtgaagccttaggagcatgccgaggggcggttggcctcgtaaaaagccgcaaaaaaatagtcgcaaacgacgaaaactacgcactagcagcttaataacctgcttagagccctctctccctagcctccgctcttaggacggggatcaagagaggtcaaacccaaaagagatcgcgcggatgccttgcctggggttgaagcgttaaactgaatcaggctagtctgtcagtggcgtgtctgtccgcagctgaccggcgaatgtaaagactgtactaagcatgtagtgccgacggtgtagtaatttcggacgcgggttcaactcccgccagctccaccaaaattctttcgcggcgataccagaattgtccgctgaagtcctgaaagcccgcaaggtgaaagctttgcgggtttttttgtgtctgtaaccttccaggacgatccgcctgaatccagaaataatcggcacacgttaagatacacgctttaatgtgggccaaaaacatgtaccaattatggtcggaaatcagtcatggcgcggatgacatgcccctcaccaataacaaaatcctcaaaactaagcccctaagagaaagacttcacgtcgcatgatggcgacgggcttttcctgctcaacaaaacgtctggtaagaagctatggcgtttccgctatcagaggccaagaagtagtagccgaacaaatctcagtcttggctcatacctgctctaacgctagctgctgcacgtcagatgcgtgaccagtatttgtcgctgcttgctcaagggatcgatccacagaagcagcaaaaggaagtttctgagcaacgtcagattgaattggatagcattttctcagttgttgccgataggtggttccagcttaaaagcaaaagcgtcaccgaggattatgcgaaagacatttggcgatcactggaaaaggacatcttccccgctattggcgaaattcctgttcaagcactcaaggccagaacgtttgttgaagcactggagccgattaaaactagaggcgctcctgaaagagttcgtaggttagtgcagcgtatcaacgagattatgattcatgcagtcaacaccggattgaccgatgctaacccagcgtctggtgttggtatggcttttgagaagccaaaaaaacagcatatgccaacactcagacccgaggaattgccaaagttgatgcggtctttatctatgtcgaacctatctgtttctactcgctgtcttattgagtggcaacttcttactcttgtgcgtccctcagaagcttctggtgcgaaatggacagaaatcaattttgagaataaactctggactatcccggcaacaaggatgaaggccaagcgtgaacatattatccccttatcaccacaagcattatatattctagaggttatgaggcctgtaagcgctaacagtgagcatatttttccaagcagaaacaacccaaaacaatcgatgaatagtcagactgcaaatgcagcattaaaacggattggttatggtggtagacttgtcgcacatggtttacgtgcaattgcaagtacagccctgaatgaagctaactttaactctgatgtgattgagtctgcattggctcattctgataaaaacgaagtccgtagggcttacaatcattcaacctgccttgagaaacgcgttgaactgatgaattggtggggcatttttgtttataacaaaattcaggagatgaaatgtttaaaaaattaagaataaaaaactttaaagcatgggaagatacacaagaaatatccatggctcctattacgttattttttggaagtaatagctcaggtaagtctagtataggtcagcttctaataatgctcaaacagactattgattcacctgatcgtaaaagtcctctttattcaggagggccacagacagcagtacagcttggctcttttcatgaaatggttcatcaaagagattcctcaaaaaaaatatcatttgaatatacttggagcattgatgatgagttaagggtgaaggatcctatcagctcaaacatcttccaaggagatgaaatatcatttggtgcttcagtatgttttaacgaaagtcagcggattgttgaactttctggcttcaattatgaaatacattatgaaaaccagcttggattttcagttggacttgaaaggaatttaaatactaagaatgactttaagacaaacttctctaattataatttagttaggcaaaaagggcgcgtttggtcaattaaagaagccgtaaggttttatggattccctgaagaagttgtagcttattatcaaaatgcagactttgtgcaagagctaaatttacgacacgagcagttatttcggtcactttattacctcggaccgcttagaataaaagcatcaaggttatatccatggtctggaatcaggcctgaaagcgttggattttctggtgaaaatactatttcagcgcttttatctgccaaagatcgtaaaataggccttggctatagaaaagtgacaaaacctttcgaggagataattgcattaaaattgaaagaaatgggacttattgacgatttcatcgtaaaacccatctctgaaaatcgtcaagaatatgaagttaaggtatgtacgaaaggctcaaaatcttgggtggacttaccagatgtaggatttggggtatcgcaagtattacctgttttagtacaatgtttctacgcacctagtggttctgttatcttaatggagcagcctgaaatacacctccatcctaaggcgcaatctgttttagcggatgttttaattgatgttatacgttcaaaggaaaatggcgaagatagaaaaattcagttaattatagaaacccactcagaacatttcctgagaagacttcaaagaagaatagcagaaaacgaaatatccaaagaaaatgtagcagcctatttctctgattactccaaaaacaaaccgtcacttactcctttgttgattgacgactttggcaacatcaaaaattggccggagcatttctttggagatgaaatgggtgatataactgcgcaatctaaagcagccatacagagaaaacttgaggaaatgaaaaaaaaatgaaaattcccaagaattatattttagatactaacgtacctaaaactgctaatttagcagttgttgcagatggagtaactaatgaaaatgccaaatgtattttaagctgcgttgaactgattgagaaaataacaagcagtaaagatagtggattagttcttgactcaatggatgaaatctttgatgaatatagaggacaacttaatttaggcggctcgcccggacaaggggatgtctttatgaaatggctgcatgataatagatggaactttccagaaaccgaccgtgttaacataactaaaaataatgatacttactccgaattcccacaacatccagaactagttaactttgatatttcagatcgtaagttcgtggcaacatcaaacgcacacccaggaaaaccttgcatttatcaagctgctgatagtaaatggtggggatggaaagatgcattactagaagtaaatattaaagtgtgctttatggatgagcaatacatagaaaccatctataacaggaagatgaaaggatgagcgagattaatgtaaaattcccaagcactcctcacttcgctatttcagtcactcaagatattagaaatgacaaggtgcttgatgatgatatgcaaaatgacgccctaacaaaagagttaatcatcgaggagaaaattgacggtgcaaaccttggcatatctttcgattttgaggggaatataatattacagaatagaggaagcattttaaatcccccattctctggccagtggaaacctttagataattggttaaaattaagacttgagaagctatttgatgtccttactgacagacatattttattcggagagtggtgttacgccaaacattctatccattacacatctctccctgactactttttagcttttgatatttatgacaaaagcttgaaaaaatttatagattttgatagacgtcaagagttaacggaatccatgaatattttatctgtacctttgttagggaagggtttttttcgtctaaatgaattacccagttttataaaaaaatcttcatatagcgattcaatttcagaaggagtttatgttagagcatcagattcctatcaaaccttttttagagctaagattgtaagaaatgattttactcaaaatatcgctctgcactggagtgcgagaagtatcattaaaaatagtttgctcattaacaaatgcaattgagctgccgtgggctgctgttaaccgcgcgcaatgctttccccgccacgcctgcccgctttatacaccacttttcatgcaggtgcatgctacgggcctagccgcgcccggcatggcctgaacgaggcaaaacgattcatgtttttgcatgcagatccatgcacgctatgcatgcacggctctttacaaagcggctcgccaaaaaaaaggctttaggaaggcaaaggacgggaataaaaaaagccgctggttgtgcagcggcagtgtaaaggattaatgaatctggcggaatgcagaaccataacggcccagcgtctgactctcccttaagcgggatactcacacggtcataaagaccaataccttttgcctacatcgtcatacttatttacaatctcaggcaggattgattaagtaacgttagaaaaaaagcctcaaacccactactaaataattgtttcatcggaggaaatggaatgcctcgcaatctcgcacctgcatactgtgtagttcaacaacctggtaacctcggattccaggcaagaatgcttttcaatgacagtaactcagaagctgctcgtctctttatgcaaaccaatgcagacacgccctggctgaatccgggtcagatagtcattgttgcagacccagcttcttcacaaaccatgcaaatgttgaacgctttaaggcaggccaaacagaaaactaacattgcgtttgttggtgtaactcctgacgaagcgagctttatgcagcaacactacggtttgatcgctgccctgactactgcgggagataaaatttttggcactattggtgacgttggtgagagatacttttcagagatcgagaataccctcaaaaagatagaaatcagttaccaaaaccagttccgtactcaggggacactgattagtcagcaattcttcgcagaacgtaaccggctcttcaatcagctaaaagaacttgtgaacaagccactactgaaatcattgattcgttatgccgtgaagttcaagccttacgaagacatgcgtagagcactgaatctatccagccgctccatcgtacatgaatggtccactgtagggctgggagggatacctggctattcgaattatgtagatagtgcagcgaaagcggcaaaatttttgaaatcaggtggctacataggtatagggtttgcctttgcgggtaccacgaatgaagtcgtcaatgcctgcgttaaaggacgagagagcgaatgcaaaagaacggcgttcaaagagtacggtaagtttggagcttcaacattaacaggtgtgggagctggtgcagccggttctgtagcaggattaggtgtatgcgcagcaatagggatcgccacagcaggaacaggagcggtagtatgtgcagcagttggctcaatcgctgcgggttatgtcggtgccaaagcgagcgactctataatggatactatctatgaatacatgggaatttgaacaatgaagtcggccataatggttttaattatgcttcctatggtttgcttagtggtaagcgttcttttgtatctaagtaacagatcccgctacaacaaattgatttctgacttccaacaaaagtatatgctgcctaccccttacttattgcattgcaatatgggttacttaggttcgccactaatgctctatttttttatgcgattaaaacaaaacaaaaaaatcttctttttagacccaaaaagtcaggcctatgattttgcaagtaacagtcaacatagcgcagagataaatagcctcaaaccgttatattttacttttttattgggctttttttgttgttttttacttgcagttatcgctgtcctaatcaaaattaaaataatttaatgatgtaaataaacacctgttaacagccaatttctctttaccattaagataattgatactgaaaccgttaaaaaatagccattaacgttgcaggcatagcaggtggtgcagcgggaggggctttagctggtttggtatgcggcccgtgcgcacccgtttgcgttttgattggtggattggtggtgcacttgccacctttgaaatgggacgtttgtggggataatcatggaacaaactctttcggtaaagcttgttgagcaaagtaaagcgactgattttcagcaggccgtttctgaagtagtgatcgataacaatccgacgggtatcactataaaaggacaggtactcgaagcctcagttaaagtcgacaatgacaggtatattcttttcacaatggatgatgtgatctttgaggagtttcttacggttactctcatcagcctgagtcaggggattgttgaaagcttgcaggttggcaacgagtattcgtcaggctctttcgaggcgctgtctgtcaatcacaaaaccattgagttcaatttcattggtgggtctgtatggacaattaaagtgaacgactctccaaagctacgtgttcccttcttttccgatccgcgtggtgtaaaacgctcttcaggtctgaaagcgtacctgacgatagatgcaaagccatcgccctccacaacatgaaaaaccatttaacaaaagcaattggtatacgcttaggtataccaattatctttaaattaaatatttatattaaatttcatagagataggtgatttattcaaattccgccagccaaacaccaccccacccacaacctccccaaaacccccctccccatccttccccttgacaacctccccctctatgccctaaaaaggaaacgatcatttcctaatcggaggttagccatgaaaccatcttcccataccggtagtgcgcaatcctctgcggggcgaccacgcgctttcaacgaagcacaatttctggatggggccattaggcttttccgcgatcgcggttttagtggcgtcagcatcagtgacatcaccgcggccaccaacctcagtaccggtagcgtttacaaggcgtataaagacaaacagggcgtctttgccatggcacttgagcgctatgtgtttcttcgcgaagaacagataaaaacccggctggaaaaggcggcaacgagtaaagacaagcttgcggaactgctgcgggactatgttgagctcagtcagggaaaagacggcaagctgggctgcatggtggtggccggtgtcaccagcttcgaccagcttggcactgcggccagtagcctggagacacagctggcaaagcggcgtagcaacattgcggaattgattaaaaacggaaaacaggacggttccattgccgcgactaccaacgaaaccgccgctgccgaggtcattctggcgttacttcagggaatgcgcgtcatcggaaaggcctcaaccctcacacaggatactgagcgttttgtggctcaggcgctgaaggtactggaataagccatgattatttacgtcgttattgccgttctcgccggggcgatgctgccgttgcaggcggtcttcaatgctcgcctgggctatgcgctgggctcaccgctttgggcggcggcggtatcggcactggtttcggcactcgttctttttatactcggggctatcacaaccggaaccttcccgcgcacctcatccctgccgtctctgcctttatgggcgtggtttggcggtatttgcggtgtgatgacgctggctggcgtcacggtcagtctaccgcgcctgggtgccgccgcgatggtcgccctggttatcgccgggcaggtagcgttttctctggtgatcgatcgtttcggtctgttcggtgttccccctcatcccattacagtacaacgtgccatggcagcggttctgctgttagccggtactgtacttttactacaggaatagattatgcctgcttttatgctccccgctgcacctaatggttttagtcaccactttgcgcgtgtaaatggtctgcgctttcattatgtgacaggtggccgtgaggatggctttcccctggtgttactggcaggtttccccgaaagctggtttgcatggcgaaatgtcatgtgtcccctggctgataaataccgaatcattgccgttgatttgccgggacagggggatacagataagccgctttccggttacgacactcaaacggttgccacgcgactgcatgcttttgtcgattcacttgatttaggatcgtactttcttgccgcgcatgacgtcggtgcctgggtcgcctttacctatgcaatgttatatggcgatgaaatacgtgcgctgaccctgatggatgccggtatcccgggaatatccctgccggataaactgccgtcggcctccgacaaatcctggaaaacatggcactttgccttccatgccgtggctgatcttcctgaagccttgctggcaggacgtgagcgcatttatctggaatggtttttccgcgagaaagccgctgatcacagctgttatggcgagactgaactgaccgaatatgagcggttgcttaaaacaccggggggattacgcgccgggctggcattttacagagcgctgtctcaatccgctgcgcaaaatgcagaactggtcaggcttgggcggttgatcatgccagtgctgggactgtccgccgaccagggctccattcctgatatggctgccacgttgaaagcctacggcgatgatgtacagggtcagcgtctctcggattgcggacatttccagcccgaggagcaacccgaagccacggcccatgcgctagcctcgttttttggtcagtacgcacattaaaatccgttgattagtctgacaacggtataacgtaatcagaacgctaatttattatgcgaagccgtcatagcgcttttgaaatagcgttttgtaggaggatgaagcaaacgggttcggtgactctgcgtgaaaaaataaagccacgcatgttaagccggcaatttcttaagttgttatcagaataaaccgacaggcatctcaattaacggacaaatattggacgccgcggtaaaggtcgataacgacagatatctgctgttcacgacagacgatattctctttaactgtaacgctaatcagcttgagcaaagggaatatcgaaagcctgcaaactggcaatacgtcttcatcaggttttttcgaacagctatcggtaaatgacgaaaccataacattcagtttcattagtggttctgtgtggaaaataaaagtgaatgacgccccaaactccgcgttcctttctatcgcgagcaaggtggcgtcaaacacttttcgggtttaaagtcctgtttaaaacagagtctaagccctcgcccacctgattaacaccttcgtggcggttagggatatatgcccggatattcccatcatttcagcctgtcgcaccctgtattgtcatgaaaccatgacaaatctgaatgacacgccatccacgcaatgccggaaccaaacctgacaaggtcatgttatgttttaaacgttcctgtaaagttgatgatgagttaactattcaataaaaaatcgttactcactcttaaaaggtgatggattacaaagaagagaatatttaatctttgcaagttacttataggcgccttattatttattcttaccgttaattcaatgttaaatccagaaaatcataagtaaaaatcatttcaattaaatcagttaacaccaaactctggcgagcgattcgtgatgccgccctctcctcccgctcgcctttatccgttaaaaaaactattcagtttccggacggatttattttttcgacaattgataatgattcttgagttgattcccatttgcatatggaattatgatttctttcgagtttggcttcctcaactggatgacaatcgttaaaggattaatcgttatgctgccgttaaaaaaaatcacccgtcatattactacgagtttattcattcccgccttgggtatggtttcccccgctctggctgagcctgatattaacgacgacaatgaagatgtgatggtggtaacggcatcggcaattgaacaacggcttaaagatgcgcccgcatccatctctgtcatcaccgcagaacagctggaaagagacatcggtaaatcggccacggatttggcggatattctcgaacgtgtcgcaggcgtaacaaaagcgattggtacagacgtgagttccggtattcaactgcgcggaatgccagcggcatatacgctgttgttggtggatggcaaacgcataggctcaagtaacggcatcaaaagcacacagcaaaactatttcgacgacattaactggattccaaccgaatccattgaacgtattgaagtggtcagagggccaatgtccgcgctctatggttcagatgcgatgggcggtgtggtgaatattatcaccaaaaaaaataatgatgcctggcacggagcattaacggcaggcacccgtcagccgcaagatggtaaccggggaaacactcagacctggacaggcagcatcggcggcccgctgggtaatggatttgatttgcgcgttaacggttcgtggaataagcgcgaagcggataaaagcgagaccggcgcattgcgctggggaagcggccaggaaggacgcaagaatgaaaattacggcgcagaactcggctgggatattacccctaatcaccgcctgtccgtttctactcagcagggaactgaaaaagggattcccggcgagtccagtgacggcagtgaaattgcgctgcgtggcgtggataaacttgaacgtgaaaattatgcgttggattatcgcggtatttttgactttggcacggtgaagctgaacgcctatcaaaataagttcaaaaactgggtgtccgatatcccggtgatttctggcgctaccgtgacgggcagccaggatgtcgcgctatggaataaagaaagcatcgtggaaggcgatattaacctgccttttgagttcggcttaccgcacaacctgacattcggcgcacagtggaaaaaagaagagctgaacaatcctcgttctatcggcgtagtagcggacgcctccagcacctacggcaaacacagcggtgaagccaaaagcaccggcctgttcgtcgaagaccagatcgacctgctggaggatgtttcactgactctgggcctgcgcagagataataccgattacggtaacaggacaacgccgcgcgcctatctggtctggcaagccacggacgcgtggacattaaaaggcggttattcagaaggttttaaagcacccagcgtgcgccaggcaagcaaaggctttattgaatcctcaaaaggcgcgggatgtaacggctatgccgattacaacggcgggggttgttacacgatgggcagcgaccaactcaagcctgaaacatcacaaaactgggaagttggcgcaatcttcgattacgagggatggagcgcaggactgactttctttgacagccgattcaaagacaaaattgccgctgcccctgttggctatattccgggcgatacctccggccgctactggcttgaacgcgtcaatcttgacactgcgcgcacccagggcctggagggcaatttaacccttcccttgatatcagaagaaaagggtccctggatgaagcgtctgtcactgaataacacgctcacgcgaatgattaaagccgaagattctctgggcgtgatgttagtgacaacgccaaaactctccacctggtcttctcttgactggcaggttaatgacgacataagcctttcatttaccgcaaaatactatggaaaaatgctgggactgaacagcagcgcagaccaggccgcacgaggcaataccgcgacagcacgtatccgaaaagcctacatgatttatggtctgtcaggacaatacagggcaacgaaacaccttaagtttaatgtcgggctggacaatctttttgataaaaatcctgtctctgacaatccgtcctcaagcggggattcaggcaacaattacgcggtgcccggtcgcaccatgtatgcctcaataacggcctcattctgatcgccctgctttgttatcaggccgctgcattaagggcgttttgaaaaggatgattcaggtaaaccagcccggtatggcgatataaaacctgaacgttaacagatgccagcatcacgttttatttattgcgacctgagaggaagcggtgctggcacgttgagcgtcatacaggcaaggcgtgccggttatctgacctgacgcacagattaacgattgtttataactgactacgaatgctttcccatggataaaagcaacgcgcaaggagaacttatgcgtttccctcttctgacgattttatttaccctggcctgcatactgaccgttttccctccggcttcggtccaggcggcacaaacggtcagcgtcacgcatctacagggaaccaccgcgctgccgctgcatccccaacgcgtggtgatcctgaatccggccacgctggatattgccgatgcgttaggcattaaccctgcgggcgtcgcgcaatccggtttcacctatccggcgcatctggctaaatacaacagccatgactatttcaatgccggcacgctgtttgagccaaactatgaagccttaagcgctgccgggccggatgtgatcttggcgggtggcagagcccttgcggcctacaacaaactcagcgatatcgccccaaccgtttcgctggatcttgacccgaacaatgtcatggcaagtctgacacagcgtactacgcaactgggggagatctttggtaaacaggcccaggcaaaggccgttttaaccgcctttaatgcacaaattgcagaccttcgcaccgccgccgctcagtcgggcagcgccatgatgttaatggtaaacggaggcaaactcagcgcctacacgccgcactcccgctttggttttatttttgatgtgctgcagttcaaacctgcactcgctatgccaaacgccagcaaacatggcaatgccatttcacccgagctgatcatgcaggccaaccccgactggctgttcgttctggatcgtgacagcgccatcggcagcaaagaaggcctgtcggcccgccaggtactggataatccgctggtgcgccgcaccaccgcctggaaaaagcagcaaattatctatctggattccgcctcgctgtatattgccggtggaatccagagctacagcctcatgatgaagcagatcaggcagcacctgatcgcggccgggaaccagccctgaatgaaatacggggcttatcttgtcagcctgggcctgctggctgcgctggttattctgagcttagtgacgggcgtaacccgcgtgtcattaatcgacctgtggcaagatgcagagatgcgggacattctgtttatcagccgctttccgcgtaccgtcgcgctggtgctggccggtagtgcgatgagtgtcgcgggccagatcatgcagatgctgacgcaaaaccgctttgttgagccttcggtcgtgggcaccacgcaatccgcaagcctggggcttttgctggtgatggtctggtatcccgccgcgcccgtcatcgtcaaaatgtgcatcgcgtccctgtttgccctggctggcacggtgctgtttatgctgcttattcaacacatccgtcagaaaagcgcttttatcgtgccgcttacaggcatcatgctgggggccgttttcagttccgtgacgacatttttggggatgcagtttgatatcctgcaatccctgggcagttgggaatccggtgacttttccagcgtgatgcagggacgctatgagctgctctggattgtcgggctgattacgctgctggcggccttcattgccgatcggttcacggtggccggcctgggccatgacttttctgttaacgtcgggcttaactaccgcaagattcagttaacgggcatggccatgatcgccatcgccagcggcgtggttatcgttgtggtcggtgttttacctttcctgggattgatcgtcccgaatattgtcagcatgatttttggcgataatttgcgacgaaccgtgccctgggtcgccatgacaggcgccatgttggtattgagctgcgatatcctgggacggctgattatttatccctttgaaattccggtcagcgccttactcggcgtgctgggcgcagccgtttttctggtgctgattatcaggggaaagcgctatgccaactaatctgttgcaaccgtcccacgccccgagagcggcacgatcgcccgtgaagcggttgtggatattggcgctgcttgcggtcgtattctccctggtctttatgacccttaatctgcagggaaatatcagctatatactgaaacaccgagggcagattttattaaccatcgtactggtcgcctttgcatccggaatcagcacgctgcttttccagaccattacgcaaaaccgcattctgtcgccgtcggtgatggggcttgagtcactctttgtctttctccaaaccctgttggtgttttttattcagctttcgcaactgagtcagatgggcagcgtggtgcagtttcttggcgaaacggcgctgttaatgatctttgccacactgctctaccgctggttattcaaccgcagtgggctggatcttcaccgggtattgttaactggcctggtgttcggcacgctgtttcgcagcctttccggtctgatgcagcgcttactgtcacctggcgaatttgccgtgctgcaaagccggatgtttgccacctttacccatgctgatgctgaggtactggccatttcagccatgatgattgttgcgatcaccgttatcgtctggcggcttcggcatcgccttgacgtcattgcgctagggcgcaatagcgcgacggcactgggcgtgccctatcaacattatgtgaccggcctgctgctgctgatttcgctgctggtggcgatttcaaccgcgctggtcgggccgatgacgtttctgggactgttggtggttaaccttgcctggccggtggtgggctcctggcgtcatggttatttgctaccaggggcgattcttattggcatcattatgctgacgggcggacagttgctcctggagcagttgttcaacatggcgggaacgctgtccgttattattgaattctttggcggtgggctctttatttatctggttctgaaaaaggtggcgacgtgattgaagttgcaaatgttaataaagcgtacgggcccttatctgtccttaaaaacattaatgaaatcctgccctcatccggtatcacctcaatcatcgggcctaatggggccggcaaatccacattactgtcagtcattagccgcctgatgatgcccgacagtggcgaggtcaggatcgactcgctggtcgtcaatgaaacgcacagcgagaagctggcgaaaattatgtcagtgctgcggcaggataatcattttaccagccgactcacggtttacgatctggtgagttttggccgctatccctattcaaaagggcgcataacggaaaacgataagcatcatattcatcaggcattatattttctggatttactgccactggctgaacggtatcttgatgaactgtccggaggacagcggcagcgcgcctttgtcgccatggtgctgtgtcaaaataccaaatacgttctgttggatgagccgctgaataatcttgatatgaaacacagcgtgaccatgatgaagcagctacggcgcgccgctgacgagctgggaaaatccattatcctggtcatccatgatattaacttcgcctcgacctattcagaccatattatcgccatgaaaaagggtgaggtttttttcagaggcaccccggctgaaatgatgaaacccgatctgatcgaacgcctttttgaaatacctgtcgcggttgaaaccgtggcgggacaacatattgcggtttactaccgttaatcctgtgcactgagcataaccgcagacggtttcccccggccctgtcacgctcatgccgggcaaccgtccgcctgtcagccgggtctgcgctaatgtgggtttacaggatgcgtgtttttcgccgtacgcttttcacgcgctacgtgcatacacgaaatcacagaaaggttttctcgcgcccagttgggccgacagtctggccgcactgtcccgcatcaggtcgcccagccctgccgctttacgatccagggttaatcgtgacgatggccccgtcagcgcaagggccgccgtcaatttatccccttcgccaaacaccgggatggcaaaggcggcagtatgcggatcgcgcgcgcctgaggtatagagcggtaaatcgggcgcgtcagtaaacaagctttcgcccattccccagtgacgcagcacctggctaatcgccgagttatccagcggataaagcgagccaggcagtcgcgtatggcgcaaaccgtccgacgactccgcacggaagacacaaagacgctggccgttatcaatcacataccagctggcgctttcgtttgttgccgaggccagcgcctgcagttcgggctgaaccacgctggccagatgaaacgactgttcatacagcttgcccagatacagcaaccttggccccagggtataaatgccattctcccttctgaccacataactcatgcgttccagcgaattcatcaggcgataaacggtggttttatggtaacccgaaagctgagacaacgccgtgagtgacagactttcttcgcctggcttaaaacagtccagcaaggccagtgccttctctacagcattaacgccttcatttcccattttgcttctcctgatttttgctggaaccgagtgtacccgaaactgtgagtcacatcttgtttacatcacaaacaagctcgcaacactggcgtcatcgtcagtatcaccgatatagtggtttcataatgtacaacctggttttactgtgtaaaacaacctatgaggtacgctatgtccaccaatgaaaaacccatgattaaccgtgaagttacgcgagtcagcgctgattatgtcagacgcgcggctgaatttcaggccgcgattattgctgatgtggcaggcagaaggggcacacttcatggccgcatcaagcccttgggtgcacatatgaaagtggcgggtccggcagtgaccgtcgaggttcgtcccggtgataacctggcgatccatgctgcgctggcggttgccaaacctggtgacgtcatcgtggttgatggtaaaggtgatatcagctgcgcgctattgggcgagattatggcaacccaggccgaagcgtccggcattgctggcatcatcatcgatggcgcagtcagggatgccgatgcactcagcacgcacacctaccctgttttttccgcaggccttaacccttgtggcccaaccaagtcgattcccgggcgcgtgaattatcccgtttccgttgccggtgccacgattaacgcgggcgatctggtggtcggagatatcgatggcgtggtggtcgtgccgcgcgacgacgttgaaatagtattagcactcgcggcgaaaaagctggatatggaaacccgtcgtattgccgcgatcaaagcgggggacaaaagaccgggctggctgaacggtgcactgcgtgcagctggcatgttagcggaaggggaggaactctgatgcgcaaacaggacaccgtcatcgtaactggcgaagatcttgcccccgccgccctcgcgatgctggacaattatgaggtggtttttgcgggcagtaagccgtctgaagacgacttattcacgctgtgccagcagtataatcccgttgggatcgtggtgcgctatggaaaaatcaacgcacgcattatggatgccgcgcctgcgctgcgcgtgatctccaagcatggcagcggcattgacgtcattgatcaagatgcggcgggcgaacgcaacatcagcgtccagtctgcgccaggcgccaatgcggcggcggtggctgaacatacctgggcactgattctggcctgcacaaaatccctgctcccgctggatcgccggatgcgtgagggacactgggataaatccacccacaagtcacttgaactggaaggtcggacgctcgggctcgtcgggctgggcgcgattggcggccgggtggcggatattggtcgcgtgtttggcatgcaggttattgcttacgatccctgggcgaaaaccttgcccgcgggctgtgagcaggtggatgatttagccacgctgtatgcacgcgcagatattgtgtcgctgcactgtccccttaccgcgcaaaacagcaagatgattaatgatcaggcgctggcacagttcaaacccggcgccgttctggtcaacactgcacgtggcggactgattgatgatgatgccctgattcgggcccttaaaagcggcaaactgagctcggcggcgctggacagctttaccgttgaacctcttactgcgccgcacatctggcagtctgtcgaaaacgtcatcattaccccgcacatcggcggcgtaagcgataactcttatgtgaaaatgggcaccgcctccgtgaccaatctgctcaaggtcttagcgcaaaaggaagccaccgtatgatgtgcctgacaacagcggaagtcaggcagacaacgattttcacccggctgcctgaccgtttccgcgtccccgacagcaacaatacctgggctgccgccaatcgcggcggccagcttaccgattcgtttctggaagggccggtctggcatccttcgggctgtctgtacctgaccgacatcccctttggccggatattccgggtcgatatggcaggcaactgggagatcgtcatgcagtacgacggcgaacccaacggcatgaaactcaccgacccggatacgcttctgattacggattatcgtcacgggttaatgaagctttgtcttaaaacgcaaacgatcaccccctggctgtcgcgccgcaatagcgagagttttcgtggcgttaacgatttaacgcctgacagtcgcggaaatctttacttcaccgatcaagggcaaaccgggctgcacgatcccactggacgggtttaccgactcagccaggacggccgactggatatcctgctggataactgccccagcccaaacggactggttctgtcgccagatgaaaaggtgctgtatgtcgccatgacgcgcggtaactcaatctggcgcgtgccgcttcagcgagagggttcgatcagcaaggtcggtcaatattttacctcgcacggacccagcggtcccgacgggttagcgatgaacgcgcgcggcgagctgctgattgccaatccgggcctgggccgcgtctggctgctcaacgatctggctgagcctgcagaaatcctcaccagccccgccggacgctccaccactaatctctgttttggtggagaaaatttacagcagctgtttattaccgaatccgtcagcggcagcattcttacctgttcaatgaaaacaccaggccacccactgcccttcctttccactgcttttctctgagaacaactctgcgtttcctgaacgcagcggaggcaaccatgaatctgcattctgcaagcgccggctcacctgttgagccgcaagccgtgtccgcatctcgtgaagaaatgaatcaaacagattttgaacaaagcgagttagcggcgggtaaagcgttccgccgtatcctgccctttatcttcctctgttatgtcgtgagttatctggatcgcaccaatgtcagcttcgccgcactgggcatgaacgccgatctgggcatcacggctgaacagtttgggtttggggccgggatgtttttcatcggctatttcctgtttgaagtgcccagtaacctgatcatgcaaaaagtgggtgcccgtatctggatcgcccgcatcatgatttcgtggggcatcatctccatggcgaccgccttcgtcactggccctgccagttttgcctttgcccgtttctgtctgggcgtggccgaagcaggattcacgcccggtatttacctgttcttcacctactggtttcccggaagctggcgcgcaaaaattacggcggcgtttttggtcgggattcccgtggcaaacatcatcggcgcgcccttatccggcatgctgatgcaaatcaccggacacgaacatatccgtaactggcagtggctgttgctgctggaaggttttccggccgttatcctgggcataatatgcttgttctttttgcatgaccgcccagcaaaagcaaactggctaagcgatacggaaaaaacgttgctgagcaggcgactggcagacgagcaacagcagatagaaaaggcgcacggttccagcctgcgtgatgcactgcataatccgctgctctacctgctggctttcattaacttttgcggcattgtgggttctatcggtgtcggcctgtggatgccgcagatcatcaagcagattggcgttagccataccgcgaccggcttcctgaccgcattaccttacgtctgcggcgcgttaagcatgctgttctgggcgcagcgggcaaatgcatccggccaccgcattcgctggatcagcgctgcgctggtgatcgccgccatcgcgctggcctgcagcgccgtggtggatgaccccgtggtgaagatgcttgcactgtgctttaccgtgagcggcattctggcttttcaggcatcgttctgggcattaccttcaggttttctcacaggaagcgccgccgcagggggtttagcgatgattgtctctgtcggaaatctgggcggctttgtcgggccttctcttattggctatgtgcgccagacaagcggaggatttatgtgggcgctgctggcagtgtccgctgtgttaatgacaggtgccgccaccgtggcgttaatcaacgatccttaccgcaaaacgtagcgcaatcggcaacttattttttataagaaaaacaaggcgctccgggcgcctctttcctttcctgcgccctcctctcgccctttatctgccctgtaaacgtgtctggcataaaaaaagcgccctcaggcgctttatcgatgttcagacgaacccactatttgcttgcggtcgacaggctttgatccacctcgattttcgccgcgcttttgcggcccatgatcagcaccgcaatgcctcccgcactgcagagtaccgccagtggaaccatcgccaatgcatgactgccggtttgctcattgataatgccgtagacgttaaccatcaggccaccaccaatcagattcgccattgcgccgatagcggctaagcctgccgccgcggtggtggaagacatccagcccgacgccagcgcccagaatggccctttcatggagtaagcaccaatcagcaccagcgacagaatgaccacgcttcccgccagcgactgcgtgaggaaagctgacagcagaccgcccgcgatcaggaaaagcgttaacgcagtatgccagcggcgttcacccgtgcggtcagagctgcgtccccagataatcataagaaccgacgccaggccataaggaatggcgttaaccagaccggtggtgaagttgtccagcccaaacgacttgagcaactgtggcgaccagacgctcaatgtagaaccggcagccgaagcacccgcataaatcagtgccatcacccagatgtgtttatggcgcagaagctgccacaacgaaatatggccaatcactttgcgtttcgcattttctgccgcaagcgtggtgctgagccagttacgctgctcttcggttaaccaggtcgcattttcagggcgattgcttaacaggaaaaaggcggcgacacctaaaagcacggcgggaacgccttctaaaataaacagccagtgccagccgcgtaatccgaaccatccatccagtgacaatattgcgcccgagatcggtgaaccaataaagtttgccgccgggatcgcaaccataaaggtggcaatgacgcgagcgcgatatttacccggaatccagtaggttaaataaaggataacgccgggaaagaatcctgcttcggcagcccccagcagaaagcgcaggaaatagagcatttcggcacttgaaacaaacgcggtgcagacggacacgatgccccacgtcaccatgatgcgtgatatccaaatctttgcgccaatcttttgcatcgctaagttgctgggcacttcgaacaggaaatacccgacaaaaaacaggctacttgccagaccaaagaccgccctggacaagccaagatcctcgttcatttgcaacgctgccatcccgatgttgccccgatcgataatcgcgatcagataacagacgatcaggaacggcagaatccgtcgtataacgcgctttacggtctgctgttctatctcggaggttaaagcgccattcggcatcttttcagacatggtgttcctcgcagaattatcatggttttacgccgggacacaatcattgttttaccctgtaaaactacggtgtacaaagtacaatcattatctgggtaaacctttccctgtgcaggcaaatgttatgaggttgtgtgatttgtcacaaaaaggtagctgcacgagttgtgatatgtgacgctgcaggagttttcaggcggtgatcttgtggctacctggggataagccgcagagaaaaagcaggcagagccttcccgcaaatggggtttggttccgcgcgggataatacgacagagagaatggcctactggttaacgctcgccaccagcggcgcgaagaatggcaggcaagttgaggcgacacgatggatgagcctcaaccagcctgaaggtcgttatgctttcagcgaggcacctttagagacaatcacgttctgataccaataaaagctcttcttacgactgcgtgccaatgtcccggccccggaatcatcgcgatcaacatagataaaaccataacgtttagacagttctgccttagacgcgctcaccaaatcgatcggcccccaactggtgtaacccatcacattcacaccgtcttcaatcgcctcacggacctgcagcagatggtcattgagataattgatgcggtaatcatcctgaaccataccattcgcatccggcgtatctttggcacccagaccattttccacaataaacagcggtttctggtagcgatcccataaagtattcaacaaggtgcgcaagccgaccggatcgatttgccagccccactctgaactcttcagatgaggattgggcaccatgctcagaatattgccccgcgcctgcttgttcagttcttcatcggtggtcacgcaaccggtcatgtagtaactgaaggagatgaaatccacggtcgacatcagcgcatcgcggtctgcgtcggtgatatccagttgaatcgcgttttcacgaaaatagcgcaacatgtagccgggatacgcgccccggcactgcacgtctccaaagaactgccaggtgcggttttcctgcagcgccttcagaacatcttcgggcttgctggagagcggatacaccagtccacccaacagcatattgccaattttgccgtctgcgatgacctcgtggcaggctttaacggctaacgcgcttgccactaactgatggtgaatggcctgataaacctgcgctttgctgctggtttccggcaggcccacgcctgtcatcggcgcatgcagcgacatgttgatttcgttgaacgtcagccatagcttcaccttgtgttgatagcgggtaaaaacggtacgggcataacgttcgaaaaagccgatgacctggcgattgccccagccgccgtattgtttaaccagcccccacggcatctcgtaatgagacagcgtgaccagaggcgtaatgttgtgtgctgccagttcatcaaacaatttatcgtaaaaagccaggcccgcctcgttaggttgcgcctcgtcgccatggggaaaaatgcgtgtccaggcgatggaaacgcgtaaacagctaaaccccatttcggcaaacagtgcgatgtcctggggatagcggtgataaaaatcgattgcgatatctttgatgccgctgtctcccgccacgcgttcgacaaccgggccaaaaaccccttgtggttgtacatcagaggtggacaagcctttaccatccttgagatacgcgccttctacctggttagcggcaagcgcgccgccccacaaaaatgtctctggaaatgttttcatctgactctcctgttagtggtcactgacgcgcagcaacggcattcccgcctccacagcggaagaggacaaaacggtcaccgtgtcgaagctgtcgctgttactgataatgatgggcgttgccagatcaaatccggcagcaagcatggcctgacgatcaaacgtcagcagaatgtccccaggttgcaccttgtcgccgacgtttacgtgggcggtgaaaggtttcccttcgagtttgacggtgtcgatgccgacatgaataagcacttcaataccgctatcgctcagcaggccaatggcgtgtttcgtctggaaaagcgaggcgacttcgcccgcaaagggcgcaataacctggttatcggctggaataatggcgacgcctttacccatcacgccgctggcgaacgtggcatcaggcacctgatcgagagctaacaccgtccccgtcatcggtgccagcacctcgttcttctcgacagacagcgcgcctggaagatcgggcgtcagcgtgttgggcatgccagccacaagggtcagcacaccgctcaggacgaatgccaccagcgcaccgacgatgccgccccacagcgtcatatcgacgccaccaggcgggatcatctgcgcgatggtaaaaatattggcaaagccaaatgaataaacgtgcgcatgactgaatcccacgatggctccgccaatcgcgcctgcgacacagccgaagataaacggacgccgcaaaggcagattcacgccatacaccgcaggctcggtaatgccgaagatgccggccatgatcgacgatcccgccagcattttctgacgagcgtctcgggtgcgtaaaaaaatccccagcgtggcgcccacctggcccatcacggcgggcagtaacatgggaagcattgagtcataaccgagcaccgccagattgttgatcattaacggaaccaggccccagtgcagaccaaaaatcacgcagacctgccatagcgcgcccattgccgcgccggccagccacggtgccagttcgtagatccattgatagccattcgcgagcaactggctgagccacgtcgccaccgggccaataaccagaaaggtcagcggcacggtcaccacaatacagatcagcggcgcgaagaagtttttcatcgatgagggcaacagcctgttgccctgcttttccagccagcagctgacccatgcagcaagaataatgggaatcacagaggagctatagttgaaccaggtaatcgggatgccaagaaatgactcgcttatcgccccggcttgctgactggcgtgaaaagcctcaagcatcatcggatgcgtcagcgcgccaccaatgaccagggtaataaaaggattaccgccaaacttcttaccggccgtataacccaacaccagcggaaaaaagaagaacaacgcatcgctggcggcaaaccagattttgtaggtgccgctgtcggtggtcagccatccgcacaccaccgcaagagccagcagccctttcaaaataccggaggcggcaagaatgccgataaacggcgtgaaaatagcggagatcacatcaatcaggcggccaaaaaaatgccccttttcagccttatcatcgctgtggtcgtgcgtctcgtcagtgagtcccgcttcatcacacaccgccagccagacctcgtgaacgtggttgccgatcaccacctgaaactgtccaccgctctctaccaccatgatgatatcgggatgctgcttgagcccttcaacatccgcctgatgatggtctttgagccggaagcgaagacgcgtggcgcaatgcaccagactgatgatgttctctttgccgccgacgtggctgagaatatccctggccaacggttgatatttcatgttgatgtcctcagagcgatgccgctggcatctgttaaaaataaaaaaacctgagaacggcccccttgtgtgtcatgggccgcgctcaggttttgcctgcgcaatgcagttacaatccggtgttaataaggcttaatgcgcctcttttcttacccgttcgatatgaatggcaagaaacataatctcttccgttgtcagttcgcgctgatagctttgcagtagatactgtgaaactttctccgcgcatttccaggctttcgcatagttgtctttgactgccgaatgcagtgaaacatcatcatccggcaccacggtgcgcgttaacatgcgttgagcaaaaaatttcaggtgcgtcacaaagcgctgataactgagcgactcttcctggtaatccagcttcagttgatatttcaccagttgcaggatttcctgcataacatgcgtcacgtgcatcacttctggcatttcactgttgagctgcgcggtgaccagatgcagcgcgataaaaccggcttcgtcctcgtccagctcggtatgaagacggctggcaatgatttgcctggcctcctgccctaacgcaaactccctgggataaagccgtttgatgtcccacagcagaacgttcttaatcgccagccctttcttctgtcgctcaatcgcaaagtagcagtgatcggtcagggtgatgtacaaactgtcctgcaatttccccagctgttgtgttgcccgttcgataatgcgatcgcaggtcgtcatcacctccagcggaatctggttgagtaactccccgaggcgatgaaccagctcatcgttttgcagcgcaaacaccttttctacacgctgcttgtccagcgcttcacccacacgtttctgaaacgccagcccccggcccataacaacctgctcacgcccgtgctcatccagaacaaccaccacattgttattaagtattttggcgattttcatcagaaccccagaaacaaaaaaacccgacttccggcacaggccaggaaatcaggttttgcctgccgcagcagtaacaatccaaaaaaggcatcttatcagtttcattttgcgcctcaatacaccacctctaaaaacgtgatgtcgcgcgaaggtatcaggttattccccacaggccagtcggagtttagcgaaaaaatcttccaggatgaaacgcgagtcgatgtgctgatagacacgaatagtgcgtgttccctgcacggttttataactgagatcgtcgtttaatgcaggcgccggacgctcttcataagcgtattcatgatcatccagtaacaacccaacggcggggttatcgcccattatccagacctcgctttttggccatggaatacctttcaggcgcgccgatgcccactgattaaaatcaataagctgcttccataaccagcccccggtttcaccttgcggtttcaccttgcggtttcactcgcgcagccagctctgccagggaaacccgcatggacatataaacattatgcggcacctgccaaagtggcgctttcgaggcaaacagcagggaagcggcgcgtggatcattaaacatattatattcccaaccccctgcgggataagggttgccgccaatccagacgaccgtgaggcgagacgcgatttctggctgagcgtcaagcgcttgcgcaatgtccgtggcgggccccaataccagaatgaacaggggccggctatcctcacgcaatgcttcgtgaatgatcgcttttgctccctcgctcacaggttgtggtttgtcacttagcgcgttaactgcgcctctgtagacgggcgtttcactccccattatccccaacagatgtgtcaacaacgcatagctctctgccatcgttggcttgggatttttcatcatctccgcggtgcggttgtactgtgccgcaataagcccccgtatcttaaaagttggcgtaaggagcgcatgcaccaccgcaaaagcatcgtccgcttcattactggcatccgtgctaatcatgacacgtaactgttttgccggatcgggagcaaagggcaacgtcttacaggtaccggcaaccgcgttgcagcacaccaacatgaacaggatcaaaaagagtctcatcgcattctccatcaaaatgttacgacggttttcagttcagttacccaggcgtcttgtgttttcgctacgccgcccggatggtgccagtactgaatgccaggctgcagctccagccatggaacagggcgaaaacgataatagatttcactgttgagggagtggcctgagtgtggaaagtaagaagcagagtgataatcatttattccactgattttattgagataatcctgttgacgtgcgtagtggttactcatatcaatccgggttaagccaaaaccaatccagtcatctggacgggcgtcaaacagccctctgtaacgcagtgatgcagcgtaaatggcatggatataattgcttcgctgatcgctgatccccaggctcaatgacgcactgagcccacgattttcatcatcctgatgccgcgtaagctgctgattcatccccgcatacatgaaccaggttcgcgtgcgttttacgtaaccttcggggtcatcggcgcctgctccaccggatttaccttggtaaaggtcgtattgtggcgcgttggtaaacagcacgccgaggttgtaggcaccgggtaagccacgaatctgtggacgcgtttcgatttcgacgggtaacagcacacctttactgccttgagtcgatgcactccacgcgtggctacggcttgctgcctgcgaattttgttccagaatgccgcccttcagtgtcacttcaggcgtcagtttgtaatcaagcgtggtgccccacgtatgaacgttccagttattccaggtcattgcatttgcagattttccaccgcactgagaaagcatctgaaaatcacaagggatgatctgatcaaacgtctgtactttgtttatcatgcctatgcgccaggtcagacgccgatcgtcgaagctgcgcgcgaacgttaaccatcccaggcgagtaatggactgccctccccaactctcctgagtcagatcattaaattttacacctggatgctgtagacgtcgggttgtaaggtcatcattgtgattacggttaacgatattcccttcaatacgagcgtccggaatgcccgtccagcgttcaagatcttgattaaatgtgaaagcaaattgatcaatataggcaacgtgtgagtcgtgatcgtagccaccgccgccattccaggcgagttgattgagaaagccgaactgataagtgaaaccgttgtcgctcagcgtttggcgaatacccagcatttcacccaacagggggtcaggaggggcttcaaatcccaaaacggttccattccactcctgagcaaggctggtataagaagccgagaataataccattccacataacagacgccggtaataattattttccatgttgaaaaccatttttattaatgtgtattcgtccgcgagagagatatcactcgaaacgttaatttttccagaggcgaagacagcgcgtaattagccccatccgtacgatcatcatttaaattttatcggtaagttaaactccattctgtgcatagatttaagacaaaaaaaaacctaagtacccggcagccaatacggccactaaatacttaggttttgcctgtcagacagtcacaatccagttatctaatcgacgccagactaacatcgtattttttaattacaacagcagaagtaataaaaattaaaaaaacgtgagccaactaacaaacacgcagcagtttttatttaaaaaatcagatgctggatatgactatatctttttcatacccttcacttacgtcataacagaaaaggtaaagcgaatatgacaatatcagcgcaataaaatgaactcgtttctgctgctcactttgcgtatcgctcacccttttacaacacttcaacccataaagcagtaagttgcaaaggtcggtcattcaggatgaagtcaaacttcgtcattgatgtgaaactgtgaaaatctgtaaactctttttcagagggtaaacgtctgggatacgatcacagaggcgcaacatgctgatcatttttacaaaagtgtgtggcctgttgaaacagtgagttaagggttaacacgctctgcttcaacagttaataacatggttttgtcctgtgccgataggtgagataccgcatattaaaatattggcccactaacgattaagcatgacctcatagcaatcaaactgaaatatatctttagtcgtaacaaaacaatgaaaaagcataatcaatattgcagatttttttatttattgataataaatagtaaaaaatggagccttgaaatgaaataccacaccgttgccactgcaatgattatcatgttgagtttaccgtcattggctggcatgaataaagtcgttgacggcaaacgcccgccaaatacggttaaatccgtaaaggtgttttttaccggcgcggtcacgcttaataaggtgatgtcgctttcatccgtgctcgatgagatcggtcagaattataaatcagccacgcaggtgctgctctatatcagcagccccggtggtgacattgatgccgggaaaattggttatcaggtcgttaaaaactcccccattcccgttacgaccgtaaacgcctcctccgtggaatccgcggcgacgatgatctactgcggcgcacaaaagaggcaggttatgggtgacagcattttcttactgcatgcgccaaccgttggaaacccgccgcgtagcaatgtcagtgaaaatatgctggacgagaaaagcgaatttaccagcagataccggaacgtgataaaaacgatttatcagtcctgcacccacctcactgacgagcagattgaaaagatcacctacagtgaagataaccataagctgctggacaacaagcaggcattagccacgggcatcgccacaggcgaaatgaccgattttcagcctgctgatgccgcgtattatattcatgataatgactaaaagatgatgaagaggggcagagcctgcaagtcagacaaggttcgagccgttggatgacaacaccgctcatttccccttgctgtgcagagggttttgttgaaaagggtgcacagcatatgcacccttttttgacagacgacaagcaggttttcgccctttaggacatggcttacctgcccactttatctacctgtcaccactcaacacagattttgcccagatgcgagccgctctgctgccaggcgaaggcctcggcaatatcgtcatatttaaacgtccggtcaataaccggcttctggttcatactttccagcgccttaacgtagtcaatctggtcctgacgactggcaacgatcacgcctttaatggtgacctgcttcgccagaagagacagaatggacagcgttgcttcatcgccggaaatgataccgatttgggtgatgtgcccaccgattttgaccgctttcagtgactcgcccagcgtcgccgggccgcccacctcaacaacatgatccacgcccgcgccgttggtcaatgcgaggacgctatcgccccagttcggggtggtgcggtagttgatggtttcatcggcacccaacgctttaacgtacttaagcttttcatctgatgaggaggtggcgatcaccctggcacccatcgctttggcgatctgtagggcggcaatggacacgccgcccgttccctgcaccagcacggtatcgttggcctgcagtttgccttcggtgatcagggcgcgccaggctgtcaggccagatgtggtgatcgtggctgactcagtgtgcgtccagcctttcggggcatgggtaaaggcattctcagaacgcaccacgtattcgctggccatgccatcaatgccgtctcctggcgtgtgggcgaagccaccgacgtctgccgtgggtttgccggacagccagacaggaaagaacgtcgaaaccacgctatcgcccacgcggaaatcgttaacgccttcgccaacggcgtcaacaacgcctgcaccatcagacagcaggatgcggccatcttcggttggaaactgccccgtcgcgacaatcagatcgtgaaaattcagggagccggctttgatagcgacccgaatctcacctttgcccggttggcccggatcggcgatgtccgacacatggatattgttgagtccgccaggtgctttaagggtaagtgctttcatgcttttctccgttaaaagagggatgtcttaatcagcagttgctaaacatagaccatatgtgcattttattaaatacggtcatttaggtgatataggtacattttggatactgtaaaaacccccagatatgaaaattacgatgcggtggcctgcccggttgaagccacgctggaactgatcggcggcaagggtaaagggatgattctttaccacctgcaaaacgaaacgctgcggtttaatgcgctaagaagacggctgggggatatcacgccgcgggtactcacgcggcaacttcgggaactggaaaacgtcgggttaattcatcgcgaagtgtatgctgaagttccgccgaaggtggagtacagcatgaccgaagaaggcgcttcgcttgcgcccttgcttgggctgttaaagcagtggggagagcaacacgcgctggccttattaggcaaaaaaaacccgccgttgtgccggaaacgtccgaggctgaagcacaatgaatggccgtgcgcgctgacgccgaaacctgttatgactgacgctggacaggttcctccgcaggatatcatggggaggaacccgaaacgcccgtggtgaggttcagtcgttcagtgcgtttccatctgccacatcagaatgtggcccgcagcaaccgatgaccggttttctgtgcagcctcgccatcgcttatttcgcaagcacagaggcaaccgactcacagttcaccggcatcctgtgctctgccacggagacaacacaaaatccggccgcatctttgctgtaatgtgccgccacactgaaacgattgtggcgtttaatctcctcaaccggcgggactgagccaggcacaccacccactgcggtttgcgagcctaccgtccagggctgggtaaacagattgtcgttaacgctaaccggcccgtcggtgggtatacctcgaatataaacactgcctcggtttgacgtcccgtagcggccataatcaaacagattattgtttatgatgatgtttttcccgccgtggccctgcgcgcccttgtgcatatcaaactgatggtaagcgccccgtgctccgccattgagcacaaggttgttataagcgtgatagccctcaccgtcatcgccttttccggcaatagcatgacgattagcgttaaaggtattgcagtagatatcggcctgggcatggccattttgtaccaccacaccgtagcccagttgggtacggatattatcgtggataacgttgtgatgaattttattgtcgacggacgtttttacgctaatcccggcccacggccagtgataaatctcattgttgtcgatatcaatatgatcggtgccgggtaaaaactggataccaatcgttttattcggcgtgtccggttgtccagagggaccttcaatacgcagcccggttatccttgctttagcctcaacaacatacacaggatattgattaagtccgtcattgatccacggcgtttgtaataaagcgccccgactgcctttttcaccacgattgctaaaaagcgtctgcccggctttgatgcgcaaagcctgtggctgattcggcaccgtgatggtgacatcacccgggatatagatgaagggatgattgctgtcgacagcctgtttcaacgcatcgaaagtgcggacagtaacatagtgggcgacgttatccggcgtaagacgatcctgatactgcgccccaccaccaataacatcgcaactgcccaccgcgctaatggcagagccggatatcagtaacaggcccgctatggctattttcattttggtcatctcctgtcgacgcccgaccgccgatacaggccaggctgtcacatacgccgttttgcagggcagcgatcgccctgccatgttttatccaatggtactgtctacgaccgcccgcgcttgtgcaaacagttgctcataatgcgagtggctgtcctcaatcgtctcctccacccccagggtgttatagaggaaatgaacctccacgtcaccgatcgccagatagcccgtaacgcccatcatgtaatccgtgatgtttttctcccagccgtatttaataaaggtttgctgagaaccgccgaccagtgccagccagcgtacttttttatcttttaacgcgctgttttcaccgtaggccagaccatagttccacacacgttccagatagccttttaacatggcgggatagctgtaccaccataacgggaagacaaaaataatggcatcccgatcgttaagctcgctgaacaggcgatggacttgtggcgagtagcatttaacgggattttcccactctggttcgtcctcttcccgcatcgccggatcaaagccactgcggtagagatccagcgttttaacatgcgcgccccgttgttccgcccgatggcgcaggctcgccaccatctgtgcggtgagtgaatcggcccgtggatgtgaccaaacgatatacaggtttgctggtttcatctttcacctcatcttgtgttgaggcactcacattacgctcgccacattactgtgtgaaacctatgatttgagataggttaatgagagattttcactaatgaaactgaacgtttatgacttcgcgacctttatcgcggtcgcccgccacaaaagctttcgcgcggccggtgacgagctgggcctgtcgccctcggcggttagccatgccataaagcagctggagcagcggctgaaaattcggttgttcaaccgtacgacgcgaagcgttgcactcacggaagcgggtgcaaatctgtttgaacgtttgcgcccggccgttgatgaaatcaatgtgatactcgatgaggctaactgttttcgtcagacgccaatgggttcactgaaaattaattcctcgcgtctggcctcgcgcatggtgttaatcccgctggtggccgcattcagtcggctttacccggatatccgcgtggaaatcaccacagaagaccggctggtggatatcgttaaagagggttttgacgcaggcattcgtctcagcagcagggttgaaaaagacatgatcgcccttcctgtcggccccaaaattaagttggttgtggtggccacgccggactacttcgcccgccatgcgcccccggcgcacccacgtgacatcgttaatcatcaatgtgtgatgtttcgtcacggcagcggtcgcatttatcaatgggaattcggcggcccggaaggcaggcttgagatacttccgggcggtaatatcgtactggatgatatggactctcagcttgatgccgtgctgtgcggcgcgggaatgggctatctttatcacgaacaggttaaaccttacctggcggacggtcgtctgattccggtgctggaggcatggttacccgaacagcccagcctgcagttttactatcccagccgccattatatgtcctcggcgttaagggcatttgttgactacatcaaagccgcttcgtcagccgcgttcagccgttaagctcgtactcttttaacttacgccacagggttgtcgggctgatgccgagcatggttgaggctctggccttatccccctgggttgtcgccatgacgcgcctgatcagctgcttttcctgcttctttaacagatccgtttcatcagccacaggctcacagggcagagactgatggctggcagggccgtcctcatggccgaggcgagcgatctgcagcagtgcgtctttgtcgatcacatcgcgatcgtgaaaaacggtcagcctgtagatgaccgactgtagttcgcggatattaccaggccaggggtaacgcgttaacaccgccagcgcatctggcgtaaaggtgatgttttttccctgctgatggagtaaatgccggacgagtaattcaatatcgccgtcccgttcagccagcgcaggaagcctgagcgccagaatattgatacggtagtaaaggtcctgacgaaaaacgcccttttccactaacctgtgcagatctttattactggcggtaattagccgaaagtcggccgcaatgagctgctctccccccagacggacaaactgcttttcctgcaggacgcgcagtaatttgacctggacattgagcggtgcttcgctgatctcatcgataaaaaccgtgcccttcattgccatctcgaagacaccgggctttccgcctttgcgcgcgttcgtgaaggcaccgtcggcatagccgaacagctcgctttccagcaggttttcaggaatggcggcgcagttgatggcgataaaggggccatgttttctggtgctgtgatgatgaatactctgcgcaaagagttctttgccggtgccggtatcacctaaaatatggacgggggcatcatgacgcgcacacagcttcgcttgattaatcgcgatgttaatgcttgctgaatgaccaataatgtcatcaaaagcatagcgggtataaaagccttgctgttttttctttttgtccgcactgtttcgccactggctcttgctctgaatgaatccggtcacgatggaatagccatcctggcgctttgtataatgctttattgaggtacagataaaatcaccgtcgagttcaacaatcatttcgtttacatctgactcgtcgataattgagcgataaatctctttgaaagcctctttacggtaaattttatcgccagcatgacactgaaaaagggttttacctctgttgttaatgctcaccacctcccccatttggtcaatgcacataatgccctcacgagactgattcatcgcggaatagctcatatccagcttcagattttcctgatggatatattttaataaactgaaggcctcattgatggcttgctcaattgaattattatccgtgtcacccatcacaacattaaggtcatatttccttgccatctctgcaaccgtcaggccgcctatgaccactttgtagttgttttctgcaagattttttacgacactttcaatatcatagtgattatagacctgacaaatttttaaattttcattggtcatgttttggtaatgcttaagcgcgttacaaaactgtggaaaacctatcgcagcgatcttttgcgatttattttttgcctgcttaagaatacgataaatgccatgaaaatcatgggctatctcgatcaccggaatggtcacattgctgcgaagcagcgcggcagtcccgccacgactaataattatttttgtgcctgatcgaatcatctcattcgctttatctaatacttctgaatagcccgtctcgtacactggcaattcaagctgcttttcaataagaaaatttaaaatacgttgggttatggttttcgaaacggagaaaatgacgatttcattagacttcattaaagattcgcttttgtcgatcgctatttcatcgagtataaggataacgatgaatgagatattgacagacgtcattccagcttgtgtaaaaaaagccttgctacgtttaggtcacaaggctttcgaggcggagtatttaacgattagtaatgcaggcgtcgatagcagatctggccattactcactgtgacgcagttatcgatatactgttcaccttgcagtctggcaccctgagtatcttcgaaaacaattttttcattgcgcagttttaccactgaaatatcggcaaatgcattcggctccagcgtacctgtctgcccttgcattttcatcagtctggccggcgtgctcgtaaccgcccgaataacctcaaacagcgacatccccatattaaggtatttagacatgacatgtagcaggctgtagaccttatcggtacgcagactgttgcgctgagttaagtcggtgctgatgatatccgggtagaacccctgatccatcgcattgcgggcaacgttaaaatcaaaatgcgccacaccgtttgaacagtcaaagattacgcctcgttgctgtgccgccagaacagacgggtacacctcgccctgaccgttgagaatggtatgacctgtgccgtggaaacagtgcgcatagatatcatccgcgttgaaatgctggatgagttcatctgccggtagccgtgagtccgttacgtgtacacagagtgaggtgttaagcttacgcgccagagcaacggtcgccaaaaacggatcgctactgtagagctttcctttggcaatatcctggctgtaacgcagtttcaagccaagaatattgtcctggttttcagttaagacctgctcaattttttccgggttaacgttcgccggattggtgttttccaggtaacccgtcggcccgccgccgagcgtcgacaggcccacattgaccacattgagatagctttttatctttacggtcgcggtgttaattacgctattacgaaacagcctgtaatttacccagccactgctgccggcatcgaccacgctggttacaccattgggtaaacaaacgacatccgggttgacgctgatagccgtgccgccgtgaaaaacgtgggcgtggaaatcgataagcccgggcagaacaagacagcccgcggcatcaatcaccgtttcagcatcagtaccatcgacgtcatttaggtcaacaatacggttaccgatgatgccaatatcccgcctgatataatcgtgtttatcgagatcaacagtcaggccattcctgataagcatatccagtttcatgtttatcctccggttaaataccaattaacttccagtaagggataccaatcaggaaataaacaatgacgttaatcagcaccatcatcgtgcccaaaaaccagaaagtcttttgcggaacatagccgctggagaaggtaaatacgccagccccgttaccataatgcgtcaggagcgcgccgtatcccgccgaaaacgccagtgacagcgcgatatacatgggatcagcctgcgtggtcataccgagggtaaacagtacgggatagaacgagaccgcaaacgctgtgttggatacaaagaaataacgcaccgcaagactgataaatatcagtacgccaattgcgctgaattcgctgagatgagacaggtccagatagtttttaatcacgccgaccaggaagacatagaatccgcctttagacagcgcgacggcacagccgtaaaaagccccgtaccagataaaggtctgccaggccgctttctcgctggcgacatgttcccagcttaagactttgaataacagcaggcaggcgaggaaggcaaaccccacgggaataaaagaaataccagtaaccgagcccgtcatccatcccaaaacccccatgatgaagaacacgatcagcagtttctcttcacgctttaccgggccaagttcacgcaacccctgctcggcaatttcattgacgttatcgatcttcttcagttcaggtgcataaactttatagagaatccatgggcaaagcagcaggatcaatccggcaggaatgacggccgctttaaaccaggttatccagtccagattgaccttcatgatttcattcgccagcgacacggtaatggcgttggttgccatcccggttaaaaacaggctggatgtccccatcgatacgacatacatcaggatagtgaggtaagcgccgattctgcggctgccgtcgtccggtttagagcccagtgcctcggcaatatttctgaagatgggatatacgataccgccagagcgcgacatattcgacccggtagcgggtgccagcaccgtgtccgttaccatcattaaatagcccaacgtcagcgtatttttgccgtagcgttttaataaaacataagcgatacgtttacccagacccgtgatcacaaacgccttgcaaataataaaggcgctgatgataaaccagaccatagaggtgccgtaaccggcaaacagaatacggggatcgataaagattgatgcgatgcctaaaataatcagcatgataatcgcatcagtaaaagggcgaagcactaaaccgcacagcatggccagataaataccgaccatatgccaggtggtcgctgacacagcctcagggttgggtattatccaaaataaaacgggaaaaaaaacgatcggtaaaagttttaaatagaacatagatgattacctttgctttatcaccacggaagattcacttccgtggcttgagcgaatggatattatgtcagccgatcaacggtaaacgtcatcgatgaattcaacgcccttctcatccagcgttttcttcacccacgcgcgatttgccgtgccatttttagccgcctcgactttgctggcgtcaaattttgcataggcttgtgctttttcaagcagagcttccgcatcacgcaggggaacaacaatcacgccatctgcgtcgccaacaataagatcgccaggacatacggcaacgccgccaacggcaatcggcgtattaacctcacccggaccttctttaaacggacctgccggatttgaccccgtggcaaacagaggaaagtccaataccgataaggcatcaatatcgcggatggggccatccagcacgataccggcgatcttcttgcagtaatgggcgtaagccaccatgatttcgcccatcagcgcgcgggaacggtcgccttcgttggagaccacgatgacgtcattttccgtggccatatccagtgcggcatgaagcatcaggttgtcgccagcccgcgctttaactgtaatggcataacccgccattaccggtttctgtggcgaagatatgcgctgaataccgttacccagtacggcgatacgattcatggtgtcagcaatattcgcggcgggcagttgcgcgtacgcgttaagtaaatcagggttgccttcgggacgttttaaataaatacggttgccaatagtcatcttattctccaaagccgggaacgggccaggtgggttttttacccgacaaaacctcatcgataccgattgcggtatgcagtgaagctctgtctgtggcttctttcgtggcggcgccaatatgtgggccaataacgacattactgagtgagaaaatcggatcgttcggatcgaatggctctttctttaagacgtccaggccggcaccagcgataagatggttagcgagcgcgtgatacagcgctttttcatcaacgagcttgccgcgggcggtattaatgaagtacgacgttggcttcatcatcgcaaattgcttttcgccgacgaaatccagagtttccgcggtggttgggcaatgcagagagacaaaatcgctttcctggaaaatacgatcaaaatcgtcggtacgctcgacaccttctggcatctccgcctgggttttgtagggatcgtaagcaatgactttcatgttgaaaccgtgcaacgctttgagcgcgacacgtgagccgatattaccgacgccaattaagccaagcgttttaccgtccagttcgacctttggcgtacgtaatttagcccagtagtaatcctccagcatcttctcttcgaccagcctgaagttacgcgagcagtgcagcatgtagaaaatagccagttccgcaacggacatgctgttagcaatgggcgcattcagcaccacaacaccgtgacgtttggcggattcaagatcgacggtgtcatatccggcaccgtgtctggccacgaccttgagtttcttagccgcctcgaatacgcgatcggacatttttgaaagacgaacaataatgccgtcacagtcaggaatatctcgaatgatgtcctcctcttccattcctgaacccgtaatcagttcatagcctcgactttctaaataggcgcgcccttccgccataatttcctgagggagcaaaatcttatacgtcatttaatgatctcctgtgttgaatatgcagaatgtattgcagcatgcatgccaggagagagagaacgttaaaaattaaacctaagccactgacagaaataaaaaaacaataaaaatcgcgctacaacagaaactgattgaaatgtgatatgacctttacctcaggaaatattttttcattttaaaaacatgtatggaaaaagtgatttcattttgaaataaggaattgtgaagatattcacaggcagggaaagatggtttttacgccgatgaacagcattattgaaatccataatgaagaggctgacttatataagcccataaaaaaagggctcatgctaaacatgaacccttcaggtttcggctaaccgtcgcgacttagcgccttgataagctgctgctgtattttatttttctaagcacgttacactcctgctaattattttaatcaggatgaacatgtaacacagttaattgttaactgacagattggaaatgtaaaatgttcatcacggcgttcgactcttgatgggtacaatatttcgccaaatcccacccgataatctcagattctcgggctcacttcgcattacgttggtcacacactgcagatagttttctttccagcgctcactgaatgtcgcaagactttcgaatctctccggatcgaccattttttccatgaagaagtcaatgcgaccctctttccataccggaacactgaacacggtgggcaagtgcattttatatgccagacgagagctgaaagtggaataagtaatgtgttgaccatgaaattcaatcgttggtgcggccaggtttagtgcaccatcaatagcgatgacgattgactggccgcggtgtaaagtttgcatacaggctctgaccacttcggcttcgcttttatcgcttacggaaatcaacttttcgccgtagcctccctttatcacacctggtgtagaggcaacccatttacagttcatatccagcaacgacaggatcacaggtccggcatacatggcaccaagatgggcagagacaatgatgcatcctctttcatccaactgcagacgattaaaaaattgttctacatgttcaatatcagccagacgatacattggttcatcagcctggttcccccggcattccagccagtcgagcaggaaattatcggccagatatccccacttcgcccgacgctcccattccggtcgctccaggcccacgtgctttccagcaatctcccacgcccagtcaaaccgttcgactggcaagctcacctgggaaattttctcattgagtgaggctaatcccgcttcgaatgtctcagctaaatgcacttcccgggcgcctgtataacgttcaaagaccgtttcagcttctgatctttttcccgcctgcaatagtgcggcggctgcataacggttccatttactggttatccctttttcagttgccagacgcatgaactcatcacttgcggcctcatactggccttcctggcgaagcgccctggcataaagcgctctgacatagggcagattgggatgccggattagccaccgctcaagcaacggaatggcaagggcagtttgccctgttctgatgagcgcatcagcgtacaacgtcgccgcccgcagattatcgggattgaaagccacagcctggccgaaatgctcaacggccttgcgtttcgcgtcctgactacgactggatttaagccagacttgtccaaggctgcggcgtaaacctgcgccatcatggcctgcaatcaatgcactttcgccagcctgaattgcctcctgatatttaccaacagcgcttgatatattaaccactaaactggctgcatccgctgagtctacttttagagaggggagaagtgaaaaagccaattccttatccgatagcgcgtggcttttatccaggtagctgaggcaggtgagcaaaatatgattgtcgtgtggacgcgcaagggcctgctttctggctaagcaaatggcctgctcctctttttctgacagtgtcaggctacgtagataaagcgcaaaaatgttgccattgcctggaaaaacacgtaatcctcgctccgccagctcaacggccgtattgaagtgccgacatttaatcaggtgactcgcgaccagcaacacatcctcggtctgacagacatccgccgcgagaagcttgttcaccgtcagcagcgccacatccagattacgcgacgccaggggtgaaattatccagcgccgtaataaactccgactgtttgttgtcttcagcactagcggggacagcagagagaatcccgatgtcacctcgcccaaacgcaaacagccgattgcatacaaaagaatatgttgtgcattcgcaacgctatcttttattttctcaggatgctggcggtaatactggcatatcccctcccagtcctcatatttaagcaaggcagtcggcgatgttttttcaaccgttgtgtatagcttcatcaaattcccttctaaatcgttattcacgcatacgtctgatcgtgatcagtaatgagataaccagataggcgatgccgagcaacacaaaaaacatgagccatttagccccgtggtcgtaacgactggtatcagagatcaccataggttgagaaatgactactaaataacgtctttcacgtagtgcctgtaatttaccctgctggagcgtttgcagagcagcctcccagcgcatcctggctatctctccctggaggcgaagatcttcgaatacaggcaaactttctgacgagccttgtgaacccaacttgctggataaacgattacgctgctcaccaatctgttttttcagaacagcgattttggctgccagtcgtggaatcatggggttctgatctaaaccattagccatgagttgatcatattccgccttcgcctctgccagttgcgtttcaaatccggcaatcaatttataaattgccgttattgtctcctgaggctcaatatccttctgaatatgctgcaccttcagtaaacttaaacgtactgcggcgaggttttcctgtgccgctttaacatcattctccagccactgaatgcgttcctgctgcattctgagcgagatcttattgacgtgctgctcggcaaattccagaatacgttttgcgaaaaactctgctttttccctgtcctgcgccttcacattcaggcgtaacataccctgttgtatatcagcagaaaccgatacttttgataagtagtagcgataggggtcattattaattcctgctggcgcgtggtagcgtgaaaacaatgcgatctctttttgagaaaaatatgttaaaaaccccaattccttttccatgcgatccatcatttctttcgacagaataaactcgcggacccgaaatccctccgacatttcattaccactgccaaaaaaagcggcaccggacaacgtatcctggctggcttccgactgaacaataaatgtggcatcagcactgtaaaaacgcgacgtcattagccaggatattaatacgatggctaacaggggtaatccaatatagagaagaagatgacgcagtgatttttttgcctgactaatgcgtcgctctttaattatcagtgatgctcgtcgaacagagtctgcgtctgttcccaaccattcagcatccttttgatgatcgtcgctgggctgttcagccgtttgttcagcctgacgcaaaagacgttcttcttcttttttttggattcgggcagtccggttctcttccgctatccttgccctgtcctctttccattttttgattcgttctgaattattcacacgctatccgtctaagttctgtttatatatcaaaggtattatcatctgcagatatcaacgcctcacttgactgatatcgctcaaaaagcgcagtggcatgttctaacgttgaacaccttatgatttttccatgcaacagtacgccaaaggcgcgacaatgctgtttgataaggcgggggtttcgggttaatacaaccagcccttttttttgtaattcgcgggagagcgccgtctgcatgcgctgttgtgacgcgctatcaccggtataaagtttgtcatcagcgacataaaggcgacagggaagtaacaggttaatggcataagcaagatgagctttcatcgtaacagagtaactacttactttatccgcatagcgctgttcaagttgagtgagctgatagcagaaatgggaaaactcatccccgtccaggccataaaaactggccatcatgcgcgcattttcttcacccgttaaaccaggcaaaataaagctgttgccgcccagcggcagcgcatcccctcgctcgcccagcaagcatccctcatcagggagatcaattccgcatagcagccgggttaacgtcgtctttcccgagcctggcgctgccagaataccgatacgatcctgataatccatcacaaagtccatattatttaagatgatctggagaccgtgagcagtatcaaaatagcgggtacaatttaataaaccgaacacgagctcgcctcttcgataaataaaaaatcagttattatgagtgctgagaatcaagcgaaaggctaacccagccagaaataacgttgcgcaaaatgctagcgggtacagcggttcaaggcaaaaagattgatagccatcgaacatgccttccctgacaatttcgttagcatgaagcagaggattccagctaagcacattcaatacggaataaggtaattcgttcgcggtataaaatacggccgatattaaaaacatgggtctgagtacgacgggcagagccttataaaccagcggaaaccggtcagacaaagcatcacaaaagtaaccaaaagaacaccccagaagccatgccataaacattccgttgaaaatcaaaagcggtttatggatttcccaatgagagaaaaaaagaaaattaattgatgagacgatgatgtaaataatgacggcatttataaattcaaccgatgctaaagcaaacataacaaactttctttttaccggcaggacaacaatcagtgacatatagaaagaacgcgtgcgcattgtagcggtaatggtatagcgaaataacaggtagggtaaaatccctgcaatcacaaaactcacatcgtcagtaaaaatcggtactttccgcgataaaagttgaaaagagattaccgtgattgtaatccatgcaaggggaacagccaataccatgacatagcttaatacattatcattaaatctcgctcttaaatcgcgtgacattaataagataattagctcgtaacatgaaatgaaattcctgaaacgttcagaacattttttcgagatagccatatatctatgtttatagcgcattggtgctacgagataagaaagcgccaaacgcagcctgaaccttagcaaggtcagttaacgaggcgttagaaatatagatgacgtcaccatccgctatcttaagctttctggcacgaaacactgaatcaggcaggctcatatcaacatgatagatattgggcttacgtccctgctgactcgccagctgcgtttcgttatgtttaaacagaaaaacagcttgaggatcggcaagtttatcgttcagtcctttcgccagcgctatagcatccaggatgctggaatcacgttttactaaagcatgcttgccctgaatgcccgccgcgccaaggacattcacataatcagtgacctgacgcacggtaatacgatcgtctggctgtaacgcaatatccagggcgggttgctgataaagatcggcgagccgcacccggaaattatgctgctggcgggtgacactgatttccgtcatctccgcgctggcattctccatgtttgttgccgccagaaaatgactcaaatgattcatgctctgatcgagaggaaagcgccccatttttccactactaccttccagcgttaccatggcgccagttcgggcagtcagtgtgactaaaacctgtggatttagcactacgcgtgaaagtcgctgggtaatctcgtccgcgagctgtctgacattgagatgattaacggcgattgttcctgcataaggcacccgaaccgtttgatcatcagccacgaaaatattgtcgaaatcagcgcgatcgccatttgagttatcggataaatagcccgcgccccccgaagataaaatggtgatatggaggacatcacctgcagtaagcgaggtccattgccagtcagtatcgttaaaaatggcatcgggtatattatgctgtgatatatcagaatcgtttgttttaaaagccggtgtcacttctatcaggctaaacgcgggatcgtcatggtgaataaggctggatttaaatgcagctcttgggatcgtacaccccgaaagcaatccagccacaataactacaagcatgatctttttcataaaactcatttacattaagtgagagccattcaataaactcagttgaatgacttaggcatggcagtaatggttcgaataaaagatcccaccatattttctacagaaaaacgttcctgcaaaaaggcctgtgtttcctcacaaacacagattctgcctcgcgataaggtgctcaactgcctggcatagtggcaggcctgctccagattaacctccaactcatcatccagaatgtagccagaaacaccttcaataagacattctgcggagccgccggctggcgttgacacgacgggcacgcccgccatttgtgcttcgatcagaacgtttggcaggccttcatagcgggagaagagcataaaaacgtccattttttttagccaatagcctacgtcacgtgaaacaccgacaaacagaatacgcgccaaaatgccaagtcgttcagcccgttgctgagcttcggcacgcagttcaccatcgccgactaaaataaatcgactgcggggatactgcttcaaatagttagccgcgaagtcgatccagacaaacggacttttatcgctaacgaaacgaaaaactccgccgattgtcgtgtcggcatcttttgttttctgcataaatgcttgccagattttatcaggaaccgctgacgatgcttcagtggcaggtggcgaaaccccgttatataccacctggaatttacgttcatccaactgaagccagtcagcgtaacgccgggcgacgcaatagttattactcataaaatctacgcccgggatttgcgccagcgcttgatagagaggttcatattccggtttaaaaagtcgttttcttactatcggcggtaatcctcgcaatcccagttggatacggggaacacctgtaatcagcgccgccagagccacggtcagacaggcaccatcttgccagatggacaggtaatcaggctgccgctgacgaagatgcggcaccagacgcttaataccgtagttacactgtgggggaagatgagaaagcagtaaacgcagttcaggagaatcaaccgcagtatcgtcaaaaacgttaacggttatctttgccatttcaagaacgtcaacttgcgcatcctgcacttctttcaggaaaaaattctgctttagcgccggagaaagagagcgaatgatcaattcgaccggttcctccactttccatccggctatctcaccttgttcctgatattttttggttatttcaatcgccagtctcgaaatttgccgttcagcgccaccactgcctagcgaacctgtacacaatgaaagtcgtcctaatcgtccactgggaagttcgcggatctgccggtggcgatatgacaatatggcatacttcatggcaataatgcgggtattcgttcccgctgtaatagctttgccttcatattcttctagtaaattgcagatcttattaattttggctaaatagtttttatattcttttaatgttttttcttcaataccgctaaggataagctgagcatcttttgccagcccacgattaaacaatcgtcgggcatattcgtaacgcgcttcatcactattttgagcaactaatgcgtcataaattttgtacgcgcgttctgtttcattaagatcgtacaagaattcagctttttttaaggctgccgatgcggttatattctcttctggaaataaacgatcaataagggatatcccttccgatattttcccttcttttttaagcagcgtaatttcctgcatcaatttttttaggttcgtatcaaacataattagcgcctcttaccagacaagcttttttgcagcattacctgacaagtggcaattttcctcgtgacagaatccgtcggaccacctactttttccagtcgttgccagtataataatgcctgctcatagtctcgctgatgcattgaatttaatgcgacgtattttaatgcatatgtgttttcgttatcgaatataagcagctttctggcataatccagattttctttggatgtcatcatgctgccgtcttgtttcatcgactcatcaaataaacgaacaatttgcttatattcacgcatcaaccgctgagcgtcgggatcgatgcgtttcattttaatgagtagggataatgcctcatccagacgaccttcacttttcttttgacgaacatatttaagcgccctggtcgcgatatgacggcactctttttcaaataagaggttgattgaaggcgtttggaaagattgtgaaatctccattaattcggttatacgatcaacgagaaacggcacatcactgatatggcgcatgctacgtaatgtcattgcctgcaagctggtgatattcggattgcgcattaatgtcatatgagacaaaacgcatgcctcttgccataactcactattaatgagtgcgcgcgcgcaataaatagcactcacaggatcgtattctaataaaggccagacaatcctcacaccgactaaaatatcctcatactctttttcttcatacattttctttaacttatcacgccatgtcttttttatagagttattcaggcttgtgatatgagggtaaacagaagatgcggaacaggcgtaaactaaagaggtgctcagcgtggcaaaatcatcagccgaatgaagtgataacgccatattcttccacatcataaaaacattatgtaatttatttttaaatgaggtgctcaacgttaaatgatggctcaggtttttaatacatgaagccgcactgatgataagcccagtatccgtaatcgtcgttaacgctgacaacacgaacgcagactcacgctgtaataaccactctaatgtttgcttaaatatcgcttcatctttgaaggaaattgacaacgataagcctgtttccataaagctctcgttcaggcactgcgactgtacgcccgcatgaaacgcctcagagaatgccgtaccctcggagaaatattgcgtgctgttgaggaattttacccatcctgatggcgtagcggagttcattagcaatacccgcttccagtaatgatatgaccgttcaaaaagttgcagtgcgtcggctgagtccgctgcaactgtcagaacgtcttcatcctcaatttcatttgaaagcatcatttcagccgtagccagtgcctcttcccagtgccctaatccatgcagggctgtcagtcggcagcgcaaggtgctgtcggtcgttccaatcattttttcaacatcaataatgtcctgacaggcctgctcaaagtaacccagccggctaaagatgaccgaacgcagttgtaataaaatcgggtcacgctgattgtttcgcagtgcggcaaataacgtctgtgacgcgccaacgatgtcatttcgtgccaggagtttattgacagacacactgagttcgaacatttgatcttgtagctcatgtcgcgtgtcatccatgtgatgaatttggctgtagatcacatctttaaagattgccgctacaatcgcatcaccaaaggaatcggtatagtgtgtaagatcctcaccatttttttccagtgcccttttctgcccccactttgccatcagataggtgggattaatgcagggaatgcccattctgctggcgctggattctacctttttgatgagtctggctcgcgacggtattggtgatcccgtatgggtaaggccattaatgtgcgtcatgaacatgacatggtcatgccccaggagccgaacgatttcgcgcatgtcctgttcaatggcctcttcatccatctgttcaacgcgaatgcttttcaataaagccctgtcactttccggcatcgtggcatagcagggttcagcttccaggtacgcagacagtttctgatgattttcttttgtcgcgagagaccaataaatacgcgcccgctcaggcttgctaaaaaaatcataaaaatgtctggttaagtaatttatttgtaggcaataatcataagccataaccttcttttggcttgatatttcaacgagataaaaatcagaaggcgtgtggatctcatttttgatatcacgtacagcagggcgaaaaataaaaggctgtactttttccgggatatcatgctctcccagaataaaacgaatctgctgtaaggcttcactgctggtatgggtaaagccataaatttttttaaaattagcttcaaagttaaaataaggttgagctcgcttaatgggattgacgattcggcaactgccaatcggtgtaagcgtaagcatccctgtcgatttcattattttattccacgatcaagtcaataaatacttacgagacagggtataattcatcctgtttatcgatataccatttcacggtaaatttaagcccttctttaatttcaaactcgggctcataagaaagaaaacgtttaatcttgctaatgtcagcctggctatgcttgacatcaccgtcacgaaaacccttatagacaggctcacggaaattcttattatcttgccagttatttaattcatcacgaaggtaataataaagttcgttcaatgtcgttctgtcaccaactgccacattatagacctgattttttgcagcgacattttgtgttgtagctgcaagaaagtttgcctgaatcacgttttgtatatagcaaaagtcgcgactggttgagccatcaccattaatacaaaccggctcgttcttaagcattgataatatccagcgagggatcactgccgagtaggcacccttcggattctggcgacaaccaaatacattgaaatagcgcaaaccaatgctttgaaaaccataattacgcgcaaacacctctgcgtataactcgttaacatatttcgtcaccgcataagggcttaatggccggccaatatgctcttcaactttgggtaacgcgggatgatcgccataagtgctactgcttgcggcataggtaaaactagccacttgcgaatctctcgccgcagtaagcatattcagaaacccatcaatatttgcgctattagtcgtgacaggatcttttagtgaacgcggtacgcttcccaaagccgcctggtgaagtacgtaatccacattttcacaggctttctggcaagtctcaaacgacctgatatcgccattaataaacgtaaaacgcgaccattgttcatcgctgacggtagagcgaacgtcatccaggttatgctgatagccagtcgaaaaattgtccagcccaaccacggtttggtttagacatagcaattcttccaataaagctgagccaataaaacctgccaccccggtgattagccaccgttttggttcgagaaccaaatggattcttaattcatcataagcagtcataattacaacctcatatctgattgctcagccggaagcacatatttcaggtcgtagagtacatgtttatcctttccgtaatcgcgaatatcatcaacgctcatctgtttaaactgctcatgacccacggccacaacaatggcatcataaaaatcggcttcaatcgcctgaatagttgaaataccgtattctcgcgtgacttcttcagcatctacccaagggtcaaaaacatccactttgcaattataattttctaattctttcacaacatcaataattcttgtatttcggatgtccgggcagttttctttaaacgcgaaacccaggatgagaacatttgccccttcaatatttattccttttttgatcattccttttattaactgtccggaaacatagcctcccatattatcattcaggcgacgaccagccagaataatttctggataataaccaatgccttgagatttatgcgtcagatagtaaggatcgacgccgatacaatgtccgcctactaatcccggacgaaacggtaagaaattccacttacttcctgcagcgcgcaggaccgcttcagtatcgatgtctaaccgattaaaaataatcgccagttcattgatcaacgcaatatttaaatcacgctgggtattttcaatcacttttgcggcttcagcgactcggatacattccgttttgtaggtgcctgctttaatgatttccttgtaaaggccatcaaccagatcggctgtttcgcttgttgaacctgatgtgatttttttaatattggtaagacgatattttttatcacccggattaatacgctcagggctgtaaccaacgaagaaatctttattgaacgtcaaaccggacgtacgctcaagcacaggaacgcattcttcttcagtacatcccggatagaccgttgactcataaacgacaatgtcacctttacgaatcacacttcccaccgtttcactcgccttaatcaatggcgtaaggtctggctgcttatattcattaataggcgtaggaacagtgatgatgtaaaaattacaatgtttaatgtcatcaattgaggaggtcaattcgagatgactggcatcgcgcaactcctctttcgttgtttcaagattaacatctaacccttcgttaagctcaagaatacgtttatcatttacgtcaaatccaactacaggtcgttttttaccaaactcaacggccaacggtaatccaacgtaccccaggccaataatggcaattttaacatcatctttggtgatcactcgtaataatcctttgcttaatcgtaactttaaaataaaaacaagccctgacacttatttcaaccacgctaccgcccttagctgataatgctaatgattagagaacagcaatttttgatgttaactttttaggtcaacactctttatcaactctggttctaacgattttttattaagtaagcttttcaggtattaataaatgccggggctctttaacgccgaatttttcagaaatacactttcgccatctgtaaactgtagagggcgagtttataaatctttccgtcaactctttcatacccgattcgtaaagaaaatatttcatggttataatgtctttacgattgactttcactgtagatcggacgttgatattagctatcttctcgcccggctgatgctgaattagttgcctgacgatattatcaggcatatcgaaacaactaaatgctgcaattatgttgtcattttcagctaaccaaaactcagcaagaggtgatagtcgaggactagaaattatcacaatcttttttcttaattcatttgcatgcgaaaaaaaatgaaatgaagaaattaagctgtatgcatttaaattaacaaaaaagtagtttctttcatttgtttctactgccaaataatcaatcaagccttttacaccagcgccaaaatagatatcatttggcggccagtaataccgatatcccatactgggcccccgaattaaacaaaaataattttgcctgcattggaatttttaagatagtaacaatgtcacactatttttgtcttcataggttttctttagaagtgtatatatttctttaggaatattcacacagtgaaagcgcaacttcaaaccaaatagcctcatagattctgactatcagaatatatctctttgtttgaaatggccgtctacattaacgacactttttactttaaaaaggtatttctcattataattgggtttgggattttccatgtgcccttcggattattactaatataataagcatcccaacgagcaatgaaacatttacttacaatttatcgaccacagggtgtcgttttttgtatttaacattccattaatatgttgctcggtgtttatattgatgttgccagagtggaaagtttgttatcaatgcaaatcattttttcaatttcgttatttccgactgtgtttgtaattgtccactcacaagtaaatgagttagacctgtaacaggttgagtggattgtttgccgggatgccctcatggttatgaaaaaaatccgcaacatctcatttccgtaaacagaatatgctgccgttcttcgttctcgtggaaccactaaaagatagattagcagaaccgttagcggcagcgctggttactcttttacgctgagtgtggagacatacaggttagttcgtcattagcttgatacgggcacgtgcatatgagagggctattgagatcctgaccattaaccttcttaacgacaacggttacgagacctgacgtttcaaccctggcgctggccggtctctggtagttataacttatgcatgtctctgacctgggcagaacactaaaatctgcttcgcaggcaaagcatgcccgtcgtcaggtaaacgttcgctattgctgaagtaaagcatcctaaaaactcgctttatcgagccttttcctgttggcatttatcactcattacctgttcaataagcgagctttggggggatcttgacactcttcatatctgttgttttatcgttcgtctcctcccacccttaaagacctgataacgcgttacagcgcttaaaaccactattcacctgaaggttgagtcattcagtgtcaaattctttattttctgttaattttttagtcataaaaaaacaatacgtaaacttcacaactttatgtgaaacataaaaatacagcaacaaacaacaaataaattaaaaatctattatttatttaatacacgcagccaatttaaataaaacacaatagccaaatttaataaaatgaaaagtcaaaataaaaacaccattaaaaataacaaaaaaagttcctcatcaggatccagatcatataaacacaaataaacaaaaagcacatgaaacttattattgaatttgtaccgcattgtcatttaaaagtagtgagccatttaagcgcgcctcatccatcaatggctcaggtaaatacaaaagataaataaaaggacttctcacatgaaacttaaattagttgcagtggcagtaactacattgttagcagcaggtacaacaaatgctgctgaagtttataacaaagatggaaacaaacttgacctgtacggcaaagtacagggcttacattatttctcaggtgacaaaggtgaagatggtgatcagtcctatgctcgtctgggctttaaaggcgagacgcagattaccgatcaactgactggctttggtcagtgggaatacaatatgcaggctaataaaacggaaagtgacaacgatcagtcatggacccgcctgggctttgcaggtctgaaatacggtgactatggctcgtttaactatggccgtaattacggtgtggtttacgatgtgacctcatggaccgatgtgttacctgagtttggcggcgacacttacggttctgataactttatgcagcagcgtgccaacggcctggcgacctaccgtaacaccgacttcttcggtcaggttgacggcctgaactttgccttgcagtatcagggcagaaacgggggcaataacggagaaggcgccaccaataacgggcgtgccgctgcgaagcaaaatggtgatggctacggtgcggctgtaacctataccttctgggacggtatcagcgcaggtctggcctattctcactccaaacgtacactggatcaaaatggtctggcactgggtgaaggtgataatgccgaaacctataccggcggtttgaaatatgatgccaataatatttacctggcagcgcagttcactcagacctataacgccacccgcatcggtaatggtgccatcggtttcgctaacaaagcgcaaaatttcgaaatggtcgcgcagtaccagttcgactttggcctgcgtccaacccttgcttacctgcagtccaaaggcaaggatattgaaggcaattttggcgaccaggatctggtgaaatacgtgggcgtgggcgcggcctattacttcaacaaaaacatgtcagcgattgtcgattataaaatcaacctgctggatgacaatgacttcaccaacgcagccggtatctcaacggatgatatcgttgctgtaggtctggtttatcagttctgataagaccttactcgtacaaagccagctcctgtgggctggcttttctgtattcactcaggtgaaagaggaaagccctgcaaaggtttagcggacattgcctgtgtggaaagtgtcagtttctcctgcaggccgacaggctggatatgtctgcctgccattgcacgcggtgccagaaagggtcgggcggcattgccatgtatcctgagcgacccgcgcgcctgacatcgtcggccagttaagcgtccctttgcatttccccttgtcttcaggcggcaaagcgtatttgtggcggcccgccagcgtttatacgcactctctgcgccagcggctttattccccggacacagcctgccctgatgaaagatgagctccgtcgtctggctttagcggctgaaatcgccaccgagacacaacctgcattttgatgacttcagtgacttcggtgacgttggtgactgaccggacactatgcccgttttagcgatagggcgttcgccttcataaacgcacgccgccaatcgtggtaatccacatcatcacagcccaccggacaggccgcgccgtatagcatgaggctcttgaacggtttttatactttcatggcaggcctggcagcgatgcagacggaaaggacgcgacagcataccgggttcaggcttgccatcacgtccgtttttcaaggactgttaagaccttttacgcgccaacttctctgtgactttcataacggaaaagtagaacagcggtacaaagaatattgccagcagcgtgccgctgatcatgccgccaaacacgccgctgccaatcgcctgctgcgttctggcactggccccgctagccagcatcaatggcatcacgcctaacgtgaaagcaagtgatgtcatcaggataggtcgtaaacgcatacgcgaagcttccagcgttgcctcaaccagcccttttcccccttcgtgcatctgtttagcaaattcgacaatcagaatggcattttttgcggacagtccaatgatagtgatcatgccgactttgaagaaaacatcattctgcatattcatcagactgacggcaatgaccgcgcccagcagcccaagtggcacaaccagcataacggagaccgggaccgaccagctctcataaagggctgccagcaccaggaacaccaccagcatggacagcaccatcagcatcggcgcttcggaagccgattgctgctcctgcaacgagccgccggtccactcaatcgcgaatccttcaggtagctgtttagccaggcgactcatctcgttaagcgcatcgccgcttgaatatccttgtgcgggattaccgtttatctttatggactgatagccctgatagcggactaactgcaatggtgctgtttcccagtcggcatgaacaaattcagagagctgaaccatcccgcccgtcgcattacgaacatacaatccgagtatatcgtcgagctgcatacgatatttcgcgtcggcctgaatgatgacctgctgcatacgatcgctgtttgggaaatcattaacgtaaagcgaccccatcgcaccggacagcgtctggctgatttcgtcaaaagaaacccccatggcaaaggccttttgccgatcgatattaagcctgatcatctgcccatcgggtaaaccgtcaacgtacacatcccgcaccacatggcttttcgccgccagggccagtagctgctcttccgcctgtttcagcgctgcataacctttaccagcatgatcctgcaggcgaagggtaaaacccgatgaattacccagtccgtcaatggccggcgggatgaggttgaaggtatccgcgtcgggattagccgacatcactttctgagcacgttcggcttcggaaaaggcagtggccccctgccgttcgccccagtcttttaacgtcgtgaaggccattgcggagttggggccggaccccgcaaagctgaaacccataatcgcgatgcttgactggatagcggggcttgaaagcacctgctgttcgaacgctttaaccacttttagcgtgcgctcactcgtagcgtctgacggtagctgaatagaggtcataaagaatccctggtcctcttccggcagaaacgaagaaggcaggtttttcatcgcaaggacaagcagcagacacagggccagataaacccccagtgcgccgcccacccgttttaataagcggcttacgccgcgaccataaaggtgagtcatggcggcaaacttattgttaaaccagccaaaaaagcctcttttctgatgggcatgcttatcagtggattttaacagcgtggcgcacagcgcaggcgtcagactgagcgccaggaaggcagagattaagatggaaaccgccatggagagcgtaaactgccggtaaatcgccccgacggagccgctggccatcgccatgggaatgaagacggcactcagcacaagggtgataccgattaccgcaccggttatctctttcatcgccttttgcgtcgcttcttttggaccgagcccctcttccgccatgattcgctcgacgttttcaaccaccactatcgcatcgtcaacgataatccctatcgccagaaccataccgaacatggttaacacgttgaccgagaaaccggccagcagcataacggtaaaggtgcccagcagggcgatgggcgcaacgatggcagggataaaggtatagcgaacgttctgcaggaacaggtacatcaccaggaagaccagaatcatggcttctataaaggtatgaatcaccttctcgatagagatcttcacaaacggcgtggtatcaaaaggaatgctgtaagccatgccctctggcattgcctgcctcagctcgttcaggcggagtttgatccgctctgcggtttttaccgcatttgcgccggacgaaagctggatagccgcggcggtcgaaacatgtccgttttcacggctggcaaaactgtacgtttgtgagccgagttccactcgcgccacatcgctcagtaccacgcgtgagccatccggatttgcgcgcagggtgatattcgcgaactcctgcggtgaaccaagctgtcctttaaccagtaatggatagctaacctgctgaccggcaaccgctggcgagtcgccggtacgtccgggcgcaatctgggtattttcggtagtaatggcccgactgacatcgctgatggtcaggcgatactggctaagccttaccgggtccacccagattcgcatcgctttctctgcaccaaacagctgaacgcgaccgacgccctcaacccgacgaagctcttctgaaatattacgggaaaaataatcgctgagatcggcctcggtaagcttgccatctttcgacgtcagtccgacgatcatcaaaaagttagcacctgaggcttcaacgctcagtccattctgccgcacgacctgcggcagccgcgactcaatcactttgatgcggttttgcacgtccacctgggccagttcaggatcggtgcctggcgcaaaggtcaccgttatcgtcgccatgccactggtatcgctggacgattcgtaatacagcacatgcttaaccgatgaaagctcgcgctcaatcagcgccaccacactgttattcatgctttccggcgtcgagcctggataagaagcgttaatgctgatggttggcggtgcgaccgaggggtaaagtgcgacaggcaattttggaatggagagcagaccaaacaagataataaagacggcaattacccaggcaaagatgggtcgattaataaaaaactgaggcatgatttaccctgactaaacaaaagaaagatgctggccaaaaccctcatctgttgtgctgttattcacgcgccctcgcgtgatttctgatgtaaaacgttgtccgtcaaaccaacatcatcgtgactggcttgcctgctgtatgcgttcacggctccctgagtcggcgcagagcagccttatataaaagccgggttgcgcggcctccccggcaggccagtgcatggttagccaccgcctcccagagcgttttctgggctgtacgcccggcagaacgactgaggggtttcacaggacggtacggcgtcgctatgacgcttttcccctgaacggtcatataaggatgttgtgataaaactgttgcgggatttaaaccgatggcgaacagtaaaaaaataaaacacaaaagtttaattttattaaattccggggcgtcatcacacatactctctaataatgcgcattattccggagtgtaatccgttaacaatgacctattatgtaaaatttatggagagagtatggatgcgtaaaagttaaaaaaatttattcataaagtaatatattagatagacaacctaaaagcgcaggacgtaatatacgccaaaattcattcattaaacagattaatacagcacaggacaaaaataaccctcctgtctatttcaccgggaaaaatctgatatgaaaatagccgaatccgaaaggttaatcatcagaaaatttatggaacaggatgcggcgggcctgtttgcgtatttatccgatccttacccagcctgttttttggatgagaagctggaggattttgccgccgccgtgcaggaagcaaaaaacagaagccgcgacgcgacgcagtttgccctgtgtctgaaacagacggatgccttaatcggccatttttttgcctctaacgacgacgaacccgacgcggagacaatgagcgtgggatggtatcttaatcctgaatatcatggtcatggctttgctcaggaagccgcaacctgcctgtttaattacttattcaaggtgaaaaatgtgaggcgcatttacgcctacgttgcggattataacgacggatcgcaaaagttatgccagcgtctgggaatgcggctggagggctgtttcaaagagcatgtgtcatttactgatgatgacggtataaccctctatgaaaacacgctgattttcgccatcttgcagaaagagtggtgcggacgctgatagcgttccccgtcgccgcatcaccgcgcgacccggtcacctcgcggtgtgcgaatggcaggcaggtcgttttattctgctgcccggcccggtgcttttgctggtctgcctgtactgacaggcgtaatgttcctgatgcaagggcgagcttaatgtctgactgtgctgccctcatcatccgcaacaggttttattcaccttgagggcgttatgagtaacgataatctaatcctggtggcagaggatgactttgaaatttctgatatcttaatcagttacatcaaacgcgccggaatgaaagccgtacatgcggcagatggcgaaaacgccctggccttaatcaaaagcttacagcctgacctggtgctgctggacattcaactgccgttaatcgatggctggaacgtgctttccaccttgcgtaaagacagcaacacgccggtaattatggttaccgcgctggatcaggatatcgataaactgatggggcttcgcctgggcgcggatgactatattgttaagccctttaacccgtcggaagtggtcgcccgcatcgaagccgttctgcgcagagccaaaacgcaggccccaccacaaaccctgataagaacccgctttatgaccatctatcccgatgagttctctgttgagatccacagcgatggacagacgtttacacccgttctgacgaccacagaatttaagctgctaacgcacatggcaaaatatccccgtaaagtctttagccgcgaagagttgcttaatgcctgcctgcccgaaagcgatacgctcgacagaacggtagacagccatatgagcaagttacgtaaaaaatttgaaagctgtggtttatccggcgtgccagaaagtattcgtggaataggctatcgcctgggtgaacagaagtgaataaagacaaagcgctcagtcggcaaatcctcctgtttatgctgtctctgacatttaccattattatcgtggccgtggtgggctcctacctgttttacagctttatcatcgataatttccccggcggtttatccgccagcaacagtgaaagcatgacggtctttgactgggtctggatagcgatcagctctgtaatcagcttcctgattgccttactttttgcttttaagctctccgctaaaatactgaatccactcagctccgttgctaccagtttacgccgcatttctcagggggatttaagtgcccgcgccgctaacagtcagagccgccttggtgaggtcaatattctggtcagagactttaacgaaatggcagaaaagttgcagacgctggataacgaacgcaagtcctggaatgccgcgattgcccatgagctcagaacgcccgtcacgattttacgcggcaggctacagggactggtagaagaggtatttgagcccgatccgcagctgtttaaaagtcttttgcggcagacagagggattatcccggcttatcgacgatttacgcgtcgtgggggcggcagaaggcggttcttttatgctggatgttaaacccgtcgcctttaacgacgtgctggagaacgttagcgcctcgttttgccatcagtttagcgagcagggatttaacctgatcattgagcaaaatactgccgttacgcaatgtgatccgctgcggattattcagtgcctgaccatcttatttgataacgcacttaattacgccacgccgggcgtcatccgggtgcgcagcggacaccgggacaacacgttttttattgaggtggaagatgctggccccggcgtgcccgaggatttccagcgtcatatgtttgagccatttcaacgcggcacggcgggacgggcgataaacccagcgggatgtgggctgggtttatcggtcgcgaaggccattatgcaggcccacggtggcgacatcagttatcagacctcctctcagggcggttcactgtttttactgcgctggcccgttgccctttagcgtagatccaccgctgggctggaaggaaagcggtgggttttatggtacgcctgctgttgccacatcgcgccaagcttagcatcccattcctgaggcaggattttgagcttgccgcgctggggcgttaaggttatttcgctgaagtacaggctgtcgtctttgagcattatatccactctgcagtagtcaatgtcttttgccagcgcctgggcagcagagagtgcgcgatagaacagcgcaggttccggtatcgaagcaggatggttgggatactcaatctggaatggctgcagttcccattttctgttgtagacattcacatattccctgccctgctcatcggtgaagtcggcttcaataaaactcgcacaacccgcaaagcagtggatacgcaacatttcaggcgtcgtgcctctgtcccgcccctcgaacagctcaatatattcttcacaaagaagggttggcacgatgtctttgtattgccattctcgtgtgcagtaatacatatttttcttcatggccaaatccagcgttaataacgcggcttgcgtattgaacgtacctttatctttgcaaattatcgtgctgccactgtcgtggttacacttaataacgaagctatttggcaaggtgttaaaatcgatatctctggtgtttttgtaggtattaattaacggcgcaatcatcagttcatcggttcgactgagcacatattcacgcacggtgagtttatctgccagctgcgtataaagcgggtttctgtcataaatcagtcgatagcacattttttcattcagcgtgacaggatgaatcagattcggctctctgtttagcaacgtgcgcagtcgttgcgtatgaaaacgtgtgtcattgatgaggaaatacctcgcgactttgaggttatattccacatatttagcgatgtagttcagcgtattcatttcatcctccacgaaagtggcaggatgataagcagaatagattgctggagtttgtgtggatgatggagcagagatggagcagacgggccctgccgatagcgttgcggacgttgcccaggcagcagccaggtcatttggcgctgtacgcacctgcggccgggtcaacccgcgccccggaacgccctgccgtcgcgtttatcacgtttcatatggttaatattattttatctatcataaggttaatcatcaccaccttcacttctgcggattatttacgcccctgttttagctcaatgttatttatttctatagccactggtcaggttacgtctttttaatcactcaagttatttttatacatttcggcaaaaagataacccatttaataatgatttctatttacattttatgtctgataaaattcgccgcgccagaatgttaaaagcacgcagtctcattttattgatggacaaaacaaatgaaaaaaatgcttagcctgttgagttttattttcctgacgacgagttccgcctgggcaaccacttatcctctgacgattgaaaactgtggtcagaaagaaacctttactaaagcacccgaacgcgtggtggcgcttgggcagaataccgctgagattctgctgctgctgggactgcaggataaaatggttgccagcgcattctggccgaccaaagtcttaccccagttagcggaacaaaacgccaaagtgccggtactgacggtggagatccccacgctggagtccatcctggcgaagaatcccgactttgttgccgcacaaattcagttgctgatggggcctaacagcaaggtcgccaaacgtgaagactttgagtcagtggggatgaatacctatctgtctccgggcatgtgtgccaccaaacagaacaccggcgacatttacggtagccgtgccacgctgtggaatatgtcctacgtttatgaagagattgccgattttgccaaaatctttaacgtagaagatcgcggccagcaggtgatcaacgacttcaaagcccgcgaaagcgccctgagaaaagccttcccgaaaggcaagaaagatctctccttcctgttttggttctccagttcctcgccgtctgccgatgcttacgtgggcggtaaaaacggcgcatcgggttttattgccaatgtgttaggcggtcataacgcgattaccacggaaacagagtggcccaccgtgagctgggaaagcattattgccaccaatccggatgtcatcgtggtcaccagccttgaccgtaaccgctggaaactggataacgccgaagaaaagatcaagttcctgaaaagcgacccggcggtcagccagctggatgccgtgaagaaaggccatattgtggtgatggacggtcaggcgatgaacccgacgatccggacaatttatggtgcagaacaggttggcgaacagttacgtaagatgggcctgaattaatgcgtgaagaggttgtgctggtgcgacgtaatgtgagctttattgctatcgcgctcatcgccatcgtcgtgctgtttgtcgttatcgcgctgggcgtcagcgtgggcgaactgtcgataccgttgaaatcggtgatgtataccgtgaccaataaactgggtatgacggatgtgcccgttaatcgcattcatgaaagcgttatctgggatttccgtttaagccgggcattggttgcggcgctgagcggtgcgggcctggccatttgcggcgccgtcctgcagagcctgttgaaaaatgcgctggccgaaccctatgtgctgggcgtttcggctggcgcatcaacaggtgcggtgttgatcgtggtatcgggcgtcggggccggcgccatctcgctgtctctgggtgcctttaccggtgcctttgccgcttttgcgtttgttgctctgctgaccaacggcgcgcgcggcggaacagaacgtaccattctggccggtgtggcggcatcgcagctctttaatgccattaccgcttacactatcagtacctcggctaacgcccaacaggcacgtgacgtgatgttctggctgctgggcagctttagtggcgtgcgctggcctgagtttcagttggttctggtgattgtgctgatcggcttagcggtctgcctgtactactcccgcgcgctggatgcctttacctttggtgacgacgcagcggcctcgctgggtattccggtcggcgtggtccgtctggtgctgttcaccgcgaccgccctgatgaccgccacgattgtcagcatggcaggctcgatcggctttgtcggtttggtcgttccccatgtgatgcgcttcttttttgggccgctgcacagccggttgctggtggcctgtgccattgcgggcgcaattctgatggtgctggcggatatcgcatcacgcatgttgattgcgccacaaagcctgccggttggcgtagtcaccgcgctggtcggcgtgcctttctttgcaattattatttatcgctccaggacgcaataatgagcatcagcgcgcaaaaccttacctggaaggtagggaaaaaaattatcgttaacgatgtctccctggcggtgtcaccgggcgaaaccgtgggtttgctggggccgaacggctccggcaagtcgtcactgttgcgcctgctggctggcctgcgtaagcaacataaaggcaaggtactgctggatggcaaagatctgtcatccattgccagaaagcaacttgcccgtcgcgttgcctttgtggagcaacatgcgttaaccagcgccaatatgaccgtacgtgacgtcgtgaaactgggtcgaatcccgcatcattcgcctttttccagttggacgcatcaggacgacgagatagtcgaagccgcactgaagcgcgtggatatgtgctcacgctgcgatcagggctggcaaagtctttccggcggggagcggcagcgcgtgcatatcgccagagcgttagcgcaggcacccaatgaaattctgcttgatgaacccactaaccacctggatattcaccatcaactccagttgatgaagctgatcagcgaacttccggttaccagtattgttgccatccacgatctgaatcatgcggcactcttctgtgaccggctgatggtgatgctggagggggaactgattgcccagggatcgccagatgagatcctgaccgaatccctgctgtgggaggtgttcaaggtcagaactaaaattgtgtcatcgccagtacatggcaagaagcatattcattactatgcctgacgccgcactgcgtttttaaatctgtgtcaccgtttccgccgcgcccggcctcccgttgatgggcgccggttctgccagtcagccagtttgtctttgctatcggcttctatgcgcgggtgccctttctggcgctctttctgcgcaatgatatgcgcctgtcgggcagcctgagtggattgttcctggagctgcgcaccttctcgcaacaggagatgtttcaggtcgagggcgctgcgctggccggaaatgtcatgatgggcaacccgcttgatgctgtgctgacgccgtctccagaagccaccctggccgggttacagctggttggtttcacttttctgagtgctgtcgccctgctgattatttgtcgcctattaaagaataaaaagcaggccagatcgcaccgcgtattttataagaacagagataagatgtattaattattaaaggatgaaccatttgcaggatttacgtcctggctctttttttaataagccactgttttccagcttcagtaaccagtttctcgcggcataaatagacatatcacattcatccgcaacgtcccgggtcacaatgccttcagcctgacgtttaatcaggcacatcatcacgtctttcattttgggttttctttccgtttcctgaagctgattccatttcgcctcacactgaattttatatgctaaatttttcatcgctggctccgtataaaggtcaaaacctgacttcattaaagaaattaaacgcccggataagatcgcctgtctgtaacagcaacaaacctcactgacggcaatcttaccgacggcttaatttaacaatgacgccaaaggacaaccacaaacacttaaacgagaccaatattagatacaaaattctaattttataaataaatacaaaactatcatctgcacaagacaacatgaagctcgcgcaaggcgcatcagaaaagcaaaaaaagcgcgcactcaggcgaacgtgccgcgttttatgcagcccgctataacgtgcacggcgggtaaatcagttagcgtgtatggcagacaatgagcggcaaaacgcgcgtgccaattaataccgcatcatccatatcggttattttggtgatatagaggtaagaaaaatcagtattcaggacgttagcaggcacattatcccgcagcccccggtggacggtgaaatgattgagtttataaagaaactggatatagggagaatactggaactccgcattgcgtcttaatacgtaatctttaccgtttttatgcacggtgccatcaacagagaccattgcctcgcctgaataacgtagcgtcagcacaaagctggcatccagatgaaagtcggtcgtcgcatcgcgctgttgtaaattggccgcacaggtaaattcaaacatttcactgtgcgatttaacgtagtaatagctgatataaaccagcaagcccactaagacagttatcagacccagcaacgaggcaaggcgttttttacgggttgtcattgtccggcctccatcccagctctgtataatttgagcatgctatttttttgctctctgttctgacgcagtaagagacatacatgttgccagggtgtccggccataacattcctgtcggcataaaacatataccgaccgcccttctgacaggccatctggctactcgcaatcattttgtgccacaccgcttcagtcggaaacgtcgattcaccagggtgaaccggaagataaaacacatcacagccgttaagttggccgacgctgatgggcgtcatcgtcttttctcttatgagctgcgggagcagaaatccagcccccatcagcaccaggatgccgaaaaacacccagtaacgactcgcgctgcggcgtgtaaccggtaaggaggcggcaggaatgtcctccgtggaagactcaggctggatttccgttttttggatacggataaccggattaaaaacgaaccccactttgtagacggtggtgatcgcttcctgatcgatgccaagagaggacaacccacgccgtattgctgaaacgtaagcattcaggctgttagaagacggcgttgcgcccgtttcttgccagaagttatccagaatctgttcccgggacagcacgacgccggcgcttttcagaaacatttccagtaaatggttgcaggccggcgataacggcacgctggtttcgctggaatccaccagacacagcaaactctgagccggtatataccgaaccaactcatcaatcacatactctgtctgttgcattctgtcctccggcaacaaacagcgtggataacccataaaaaacacatacgtggcaacgaacctttgtctgctcagggaaagacgcgcaattattcactgtagagcaccatgcccgaacgataaatgcgtacaacatggattgttaacgacccacgcctactatggtggacgcggtatagcagatatcggcttacctgaagattccccgacactggggcgctgaattttttgcaaattgtatcagagaaatccggcgggagagagggaatgactaacggctggtttacatttatggcatcgcttttgataaattgatccataacaacgtgtgcaatgcagaaaaacgtggggattttgcgggaagacaggtggatgcctaggcaaagcgttgctgacatccacctgcggttaattaggttataggtttactgctcgctgggggattaataccaacgcccaaaacgtttgatataaaacattttcatgccctgcgccaccaggcagtagctcaacaacgtcagcaccagccaggggaaatagtgccatggcagcggcactaacccgaccatagcgccaagcgaagagaatggcagcagaataccggcggcggaaatccccacggtggtcaacagcacgggtaaccgggcacaactctgaataaacgggattttctgcgtacgtagcatgtgcaccaccagcgtctgtgacagtaagccttcaacaaaccagccggactggaacagcgactgtgcacccgcatgattcgcgccaaacacataccacatcaacgcaaaggtcgtgacatcgaaaatggaagacgttggccccatccacagcataaagcgtttgatgttaccggcatcccatttgcggggtttacgcagaaactcgcggtccattttatcccagggcaacgccaactgagagatgtcatacatcagattctgaatcaggagctgaacagacagcataggcagaaaaggaataaacgcactggcaatcagcacagagaacacattgccaaaatttgaactggccgtcatgttcaggtacttaatgatattgccaaaggtttcacgccctttcagcacgccctcgcccaataccgctaagtctttttccagcaaaataatgtccgatgactctttggcgatatcggtcgcgctgtcgaccgagatcccgacatccgcctcgcgcagtgcgggcgcatcgttgatcccgtcgccaagaaagccgacggtgtgtccattttgctgcagcagtttaagcacacgtgacttctgctgaggcgtgagtttggtaaaaatcatgcagcgttctacgtcccgacgcagttcgtcgtcactcatggcgtcgatgtcgttgccggtcagcatggcttctgaagccagcccgatttcctgacagacacgcattgtcactaacgggttatcgccagtaagcactttgaccttaatcccgctgtctttcagcgcctggattgccttgcccgcgctctctttcggtgggtccagaaacgtcagcatgccttcaagggttaattcgcactcatcatcgcggcacagcggcagcgatattccctcctcgcgcgtagcgaccagcagcacacgaaagccctgctgattgtaatgacgggtcagcgctaacaacgctgcacgcttttgctcgcacagtggaattgtcgcatcgccctggcgcaacgaggtcgccgctgccagcatttcttctaccgcgcctttgcagatcaacagcggacgatggttatgcagatcttccaccactaccgacacacgacggcggacaaagtcaaagggcagctcgtcgactttctgaaactgactgcacgcggctttagacaggctttgctcgccaaatttcagtaccgcgcgatccattaaattttttgccccactctggctgctgctgttaagccatgccagcagcaagactcgcgcatcttcttcgccgttgccgttaaggtgcgccgacagcaaaatattgtcctgtgtcagcgtgccggttttatcggtacagagcacatccattgctcccaggttctgaatggcgttcaggcgtttaacaatgaccttgcggcgtgacatggcaatggcgccttttgccagattggcactgacaatcatgggcagcatttccggcgtcaggcccaccgcgacggccagcgcaaacagcgtggcatccatccagtcacctttggtgaagccattaagcagtaagacgatcggcaccatcaccagcataaaacggatgaggagcctggaaacgctgttcacaccgcggtcaaatgacgtttgcggccggcgaccagataatgaagccgccagcgaaccaaaccaggtttcactgccggtggcgacgaccagcgctctggccgtgccgctggcaacattggtccccatcaggcagctgtttttgagttcaagtacgctgcgaccgggttgctcttcgatctccacgccagcgctgagatcgtttttttccacaggcaaggattcaccggtcaggatcgcctgactgataaacagatcgcgtgaggtcagcaggcgtacgtcagccggtaccagatcccccgcgctcagtaaaatgacatcgcctggcaccagttcgcgcatatcaatatcgtagcgacgggagatggcacagccctcttcccgacgcagcacggtgacctgagtgcgcaccagggatttcagtgcctgggccgcgcgattggtgcgaaactcctgccagaaacgcaacagcccgctgagcgtaaccatggtcagaataattatcacgccggaaagatcggtttcctcaccggcacgtaacggcagccagtaatccgttatcccgctcaccagcgccagcaccatcagcacataaataaacggattattgaatgccgtaatcaactggataaacgcagaaggcgctttctcgtgcacgacttcattccggccatagtcgccgagtcgcgctttggcttctgcgtgcgtcagtccttcatagctgctgtgcagattgctgagcgtcacatcggtgcgatggcgtgcttcgcgctcgatggcataaggtgtttttgatttttttactgaacgttgcgcgttataaacccttgcggcttgttcgattttcatgtcgctcatgtcgacatctccctgatttaaagcaacagatatcctgcatgcgtaataatgcatgcccggttttccggtgatgaccggtttatttaaggcgtccgcctttcaggacagatgaataattcccgccgcgcagccgtaatatcaggccgccataggtcggaccttgcgaaataaacgcaaagcaaaggaagacgaaaagtgaaagggtgcgcagcccgcagctacgcctgtcgaggcggaggaaaaagtgccagaatatacatcaacatagcgtgctctcgcggtgactacagcgtttattttaaggagagcaatcgaaacctacagaggggattgctgcccgccaggtggcaagcagcgaaatgcagttagcttgccggagttaaatcgtatttagggtgactgtccaatgtatgactcctgcaactattttgacgtagtataaacgccgcacccggcgggtaaagaaaaatagccgtttaaccggcgtttcgtttattaaccgtttctgttacgccctgcgattttcatttcgtcttataaccgtcctgcattggttataacttttttgcatatcattagcccataatggactattctttgcatgagccctttcgtacactcgcgttactttctcaggcaaggattttccatgaaaaaaataattccatcactactggccttgtcactggccaccgcctttagcgtaaacgctgccacaccgaaagacacgctggtcgtggttcagtcgaccgacgatgccgacagcttcgatccggctaaaggatttgaactcaccagcgtacaggcttttaccaacatttatcagcgcctcgttcagtccgatccgcaaaatccgaccgacttaaaaccgacgctggcaacctcctggcagccaggcagtgacaaccgcagcctgacgtttgcgttacgtaaaggcgcgacgttttccagcggtaacccgctgcgtccggaagatgtgatcttctcgctgggccgtgtcgtgaaactgaatcttgatccctcctttattcttacccagcttggctggaacaaagataacgtagatggcttccttaaaaaggtcgatgacgaccatgtgcaaatcagctggactgccgacgtcagcccggcctacgtactgagcctgctctccgccccggtctcctccattgtggatgaaaagaccgtgacggcacatgccaccaaaggcgattttggcaacggctggctggcgaccaactccgccggtagcggcccgtaccagatccgcaaggtagtcatgcaccaggctgttatcctgaccgccaacccgacgtcgccggcgggtgcgccaaagatcaaaaatattctgattaagaacgtgccggaaccggctgcccgtcgtttactgcttgagcagggtgatgcggacattgcccgtaatctgggcgcagaccagatcgcctcgctcaaaggcaaaagcggcgtgaccaccgaagcctttccgatggcctcgctgtattacatccagttcaacgtgggcaacaaaaacaatgccgcgcttaaaaaccccgccttctgggaagcggcacgttacctgttcgactataaaggcattgccggtcagttgctgaaaggacagttcgatgttcaccagacatttctgccgaaaggttttctcggtgcgctaaacgatacgccttacagttacgatcctgaaaaagcgaaagcgattctgaaaaaagcgggcctgaccaacgtcagcttcaccctgtccaccagcaatcagccaccttacctcgacatcgcgcaggccctgcagggcagctttgccaagggcggcgtgaaagtcgacgtgttaccggggctcagttctgaagtctcgacgcgcgtaaaagcgcataactacgaaggcacgctgaatgcctggggcgcggactactttgatcccaataccaacgccgcgtcctttgcctataacccggaagatggcagcaagacgattgcttaccgttccgactggcatatcccggagctgaacaagcaggttctggcggcaaccgccgagagcgatccgaaaaaacgcgttgcgctctaccaggccatgcagcgtgaagtgctgaaaagctccccttatgtgattggcctgcaggcgaaaaacctgatcgccctgcgcgacaatcttaagggctacgttcagggcatcaacccggacatggtttactattcgcaggttacgaagtaatggcacactctgcctcttctgccgggtcctcccggcatatttggcggcgcgttggccgcctttcatcaggcttactgtcgctggtgatcaccctgctggggttactggcgttcacctttatgctgtcgcatctgtcccctatcgatccggtacagcagatagcaggcgatcatgccagcgaagcgacctatgcgcaggtgcgtcacgaccttgggctggatcaaccggtactgatgcagttctggcactacgtcgagcacctgttgcgcggcgaccttggggtttcccgtctgaccaaccagccggtcagcagcgacctgctccagacgtttccggcaaccattgagctggccacctgcgcgatgatttttgccgtggtgtttggcgttttgctggcactgctggccgcctggaaacccggcagcgtgattgataacgtcgcccgttttatctccctgctgggttactccgtgccggtcttctggctgggcctgctgggcctgttgctgttttacgcggtgctgcactggtctgccgggccggggcgactggatgatatctgggcctatacgctggagccgaaaaccggcttcgtgctgattgacagctggctgtcaggtgatcgggagatattctggaacgccgtagcgcacttatggttaccggtagtgatcctgggtctgctggcgatggcaggcattacacggttgctgcgcgccgcgctgctggaagagagcagcaaagagtatgtggtgctggcgcgcgctaaaggcgcgggccgggtgcgtattctgctgcgtcatatcttccctaacgtgcttggtacgttgattaccgtgattgccctctcttacgccacgctgctggaaggctcggtcctgacggaaaccgtgtttgcctggcccggcgtgggacgctacatgaccaatgcgcttttctctggcgatgtgccggcgattttaggtgccaccttactgatcggcggctgctttatcctgattaacgcgctggcggatgcccttacctggttaaccgacccgagaacacgatgacgcaacaactcactgaacttgaaacggtgcgaccacgccgcagtcgccgccggattacctcgttaaccattgggttaacgctggtggctattgtcattctgatggcactgctggccccgctgatcgcgccgtacgatccgaatctgcaaaccatctccagccggttgctgccgccttcggctgcacactggtttggcaccgacggttttggccgcgacctgctgtcccgggtgatttatggcgcgcgtcctacgctgctgctggtctcgttaattctgatcctgaccattccggtcggcttactggtggggattaccgccggttatgtgggcggctggaccgagcgcgtgttaatgcgcattaccgatatttttctgtcgctgcccaatctggtgattgcgctggcgctggtcgcgataatggggccgggactaatgaacggcgcgctggcgctggcgctgaccagttggccgccgtttgcccgtcaggcgcgagccgaaacgctgtccctgcggcgcagtgactatctggccgccgcccgtatgcagggaattaccggttttcgcctgatgttcggccatattctgccactgtgcctgcccacggcggtggtgcgggccgcactcagcctgggcgggattatcctggccgcagccggactgggcttcctgggcatgggcgtgcaaccgcctaccgccgagtggggttccatggtggcagaaggcagtaaggtgatttttgaccagtggtgggtggctgccgcgcccggcgcggccattctgtttgccagcctggcctttaatctgacaggcgatggcctgcgtgaccgactggatacccgacatgcaaaataacattcttgtagagtcgctgagcatccgcagcgacgacgcgacgctggtggataatatcagcttcgccatcggacgtgagcgcgtggcgctggtcggtgagtccggttccggcaaatcactcactgcgcgcaccttgatgggattactgtcgccatcgctgcatctgcacgccagccagctgcaggtcgccggtgaaaatgccctgaccctgaatgaacgcagctggagtaagcttcgtggtgatcgcgtagccatggtgatgcaggaccccaagtatgcgctgaatccggcgcggacgatcggctggcaggttgaagaaccgctgattctgcaccgccgtctgagccgagcagaacggaaagaaaaagtctgcgatatgctcaacgcggtgggtttgccggacccgcgtgcgctgatgcagttttatccgcaccagctttcaggcggaatgggccagcgcgtgatgctggcgatcgccctgattaccgatcctgcctttttgattgccgatgagcctacctccgcgctggatcacgccatgcgcgatcaggtgctggcgctgatccgccaactggttgaatcccgtaatatgggcctgctgctgatcagccacgatctgcaacaggtgtcagaacactgcgagcgcgtgatggtgatgtacaaaggtcgggtgctggatacgctgcctgctgccgacctgcctcaggcgacacatccttacacccgcacgctgtggtcatgccgtcccagtaaagcgacacatggacaactgctgccggtgctggaccgtgcagcgctggaggccaataacgatgattaatctgcataacctcagcgtgtcacacaaacagggttacgatcttcgcaccgtggtgcacgacgtgaatcttcaggtgaacgccggtgagtgctttggcctggtcggcccgtccggctgtggtaaatcgtcgctgctgtgggtcatggcggggctgaatcctcactggcagggggagatgcagctggcgggacatccggtgctgccgggcaacacctttaccggtgcgctgcgtcaggaagtgcagatggtgtttcaggacccttacgcgtccctgcatcctcgccaccgcctgcgccgcacgctggctgagccgctaaaactgctgaagcgggataacattgcggatcgtattcatgacggatttcgccatgtgggtctggacccggcattagccgatcgttatcctcatcagctgtccggcggccagcgtcagcgcgtggcgattgttcgcgccctgctgctgcaacccaaaatactgctgctggatgagccgacgtcagcactggatatgtcaatacaggctgaaatcctcaatctgcttaacgatctcaagcgtcaggatggcctgaccatggttctggtcagccacgatcccgatgtgattgaccatatgtgtgaccgtgccgtacgcatggcgcaggggcggatcgttgagcacattgccgccccagcctaacgtaaggaaaaacgatgaccatcagactccgcccgctggaaagagaagatctgcactttgtacaccagttggataacaacgccagcgtcatgcgctactggttcgaagagccctatgaggcgtttgttgagctgtcagatctttacgacaagcacattcacgatcagaccgaacggcgttttgtcgtcgagcatgaggggcaaaaagcgggaatggtggaattggtggagatcaaccatgtccaccgccgcgccgagtttcagatcatcatcgatccgacacatcagggcaaaggcctggcgacgcaggccgcccggctggcgatggattatggtttctcggtactgaacctgtataagctctacctgattgtcgatcaggaaaacgagaaagcgatccacatctacagcaaactcggctttgagattgaaggcgtgttaaaacacgaattcttcatcaatggcgagtaccgcaatacgatccggatgtgtatcttccagcatcagtaccttgaacggcataaaacccagggcagcatggtcaaacccacggcccagtaatcagccgcgcgcgccaaccggattcatgtaaggacgaggatgctccggctccaggttgtacatccctccatagaacggatcgaccagtaaccagcccggtaagccaagcagtggaatgttccccagcaggtaccacaggttggcgcgggcctcgatcggtaccgtcaccggcacatagcccgggctttccagcatcagcaaatagtgcttcttgccaaagtagctgtggttggatttctccaggataacggttttgggcgtgtatccttccgcaaccggacggccgttttcatcctgcacggtaaaacgcgcgcccggcggctgcgaatcgatcaggaccgattgggtttcattgccaacaatggtggcgcagccgctcaggagcattgcggcggcgagagccaaaatgtgctgtttcatggaagggtccgataaaagtcaggaagcacagtgtaaaccgcccttcccaccttttcatctgtctcaatcgggctatcatcgcccgattctgctgctttattgcggttgacaatgccgggcaatagccgcgatgtctgcaggcgaggtacggcaacagccgccaattaaccgggcaccggactgctgccactcggtaaacttgtcatgcaaggtgcagccagagggggcagaatgccaggttttactgctggcatcgtactgctcacctgaattgggatacaccaccagcggtttgtctgtcaggcgctgtagctgttgcaaggccggcgtaacgctttccagcgcgatacagttgatccccatcgcgacaacctgcggctgcgcattcagatacgcggccacttcatgcagcggcgtaccatcgctgatgtgttcggcatcacgcagcgtaaacgagaaccaggcgctgctgtcagggaattcgcctaacagggcaaccagcgcgcgcgcttcagcaaaggagggcagcgtttcgcaggccagcacatccacgcccgccgccagtaaagcggtgatgcgtgggcgatgaaacgccatcatctcggcttcgggcagcgcatagtcaccccggtattccgaaccatcggccagaaacgcgccgtagggtccgacagagccggccaccagcaggatcgtttcatcggcctgcgtcgcgagataatcacgacgggcgcgggcggccagttcaacactttgtccgatcagcgccaaagactgttgttcgtccagaccacgcgccgcaaacccctgcggcgtcgcctgatagctggcggtaatcgcgcagcgcgcgcctgccgcaaaatagtcgtagtgcacctgataaatcagctcagggttttccatcaatacttttgcagaccacaaggtatccgccagatcacagcctcgggcctcaagctcggtcgccagcgccccatccagaatcaacggtgcagactgttgtagtgcgtgcgcaacaggattatgcgacatccctggcctccttagcctgtgtttttttgtgcgtgacatggtaagcggcatagcaaaacagcacaaacggaattccgcaccacagggcgatgcgctgcgaaggatcgaatgccagccccacacaggccagcaggcaaagcaggaagcccaggactggagtgagcggatacagcggcgcgcggtagaccaaatcttgcagcgatttcccctgttgcacatgacgcctgcggaaaacgtagtgcgatgcgcagatgcttagccacacggcgaccaccgcaaagccggagatagcagacagcgctacaaacacggtatccggcgcgataacactggagaacagcgccagcaggccgcctatcatactgaccgtgattgccagcagcggtacgccgcgtttgttgacccgggcgaaagcgcgcggcagggtcttttcattggccagcgaccacagcatacggcccgacgcatacaaacccgagttagcggccgacaggatggctgtcagtatcacaaagttaatgatatccgccgcccacggaatgccgatcttctcaaacaccaatacaaaggggcttttgacgataccggcctggtccattgggatcagcgccgccagcacgaagaccgtgccgacaaagaacaggatcaggcgcgcgacggtggtgcgaatcgccagcggcacgactttctgtggattttcggtttcacccgcggctataccaattaactcggtgccggaaaacgcaaagttcaccgcgaccatggtcatgagaatcggcaacacgccattgggcagccagccgtgagccgtgatattacttaatcccggcgcaggcgtgccgtccttcatggggataaagccaaacatcgccgcaccgcccagcacgataaaggcaacaatggtgatgactttgataatggaaaaccagaactccccttcggcaaagaagcgggtggaaatcacgttgagcagatagatggcaatacagaacaccaggcaccatatccacaccggcacgtgtggaaaccagtactgcatacagaaccctgccgccgtgaggctggagcccaacgccacggtccaggtcagccagtacagccaggcaacggtataacctgtcgccgggctcaggtagcgggcagcatacacgtgaaacgcccccgtttcaggcatggcgaccgacagctcacccagacaggccatgacgagccagaccaccagcgcgccaatcagataagccagcagcgtgcctgcagctcctgtcgtggaaataatgtagccggtattaaaaaacaggccggtgccaataacgccacccagcgataacatcaccaggtgacgaactttcatggttcgcttgaattgatcctgcgaagaagtcgtctgctcgctcatatactccatccgtatggacgtctaaacatctatatgcagcagatttatacgcgtcaccgcgttgaaatgcaacgggcgaagcggtaacgcgtcgtcgggaaggggtcgttgccccgcgttaacggggcgggatgcgctagtcgaacacgctctgtatgtagcgttccagcgccattcgggaactgaatccgtggggaataccgtaatgttcctgagaatcacccgccagatagagagggaactgcgtgtagtgatcacaggttttcatttcggaagccgggtcggcaaacggctgacttttttctttcaacgttgggtggattatcagcgccgtgcgccccatgcgggcttcgcggttaacataaacatagttgtcgccacgacggtagccataggcacgtggggtaatttcatcgacttcaaagcctactttttccaggacgcgcgctacctcatctggtcgtaaatacatgcttgatcctctcctcttcaaaagccacgcaaccttacatcagcatggctgcacgggcattcggaattttccctaaagggccattccgcgcctcgttacgcaaaacgtggtctacactaagtattacgtgttaattacaagggagccaaaaatgtttaatcgaacgcaaaaaaacgatgacattgatatcaatcaggatgtgaacgagctggctgattcacttgaagcgctgcttaaatcttacggcagtgaagcgaaagatgaggttaattctgcacgcagtcaggcggaagccttactgaagcaaacccgcgcgaaactcaatggcggcggtaaccgtgtctcacaggttgcccgcgacgcaggttatcaggttgatgcctatgtgcatgacaaaccctggtatggcgtaggtatcggcgctgccgtggggattgttctgggcgcgttgctggtttcacgccgctaatccctgccttatcgttatcatcggcctcgctcactgagcggggcttttttgtgcctgttttttgcacaaccggctttacaaatttttttttcgcgttgcagaccgcgccgcgactgacttaccgccctcaccccgattaaccctatatatagtacgcttgaccgccaaaggcactacatctagtattcatttcattgtcatcccacaagatgtttgcaaggacgaagcctgattcagggaaatacacttcgttatccgcagcggcaccgcaatgagagaggaatacgaatcatgcgcattattatttacactaaaaacaactgtgtccagtgtaatgccacgaaaaatgcaatggatcgccacggcattgactaccacctgatcaaccttgattcacaacctgaggcggttgataacctcaaagcgctgggctaccgccaggtgccggtcgtgatgaccagtgacgatcactggagcggattccgaccggacaagatagcccgcctgtctcagtctgttgcgatcggcgggtagccacatgtttccactggtctatttttccagccagtcggaaaacacccatcggtttattacccgtctgggtctgcctgcgtaccgcataccgattgatggtaagcaacagctgcatctccaccagccctatatcctggtggtgccgagctacggcggcggcagtcatcgcggggccgtgcccagacaagtgattcagtttctcaatgatgacgttaaccgcagcggactgcgcggcgttatcgctgccggtaaccgtaattttggtgaaggttactgcctggcgggcgacatcattgctaagaaatgtcaggttccctacctgtatcggtttgaactgatgggaacccccgacgatatcgccaatgtgaaagcgggagtaacccaattttggcaacgacagataccctcaacaacgtagcgctggactaccatgcgctgaacgccatgctgaacctgtatgacgccgatggccgcatccagtttgagaaggatcagcaggccgcgcgtcagtttcttattcagcacgtgcaacctaatactcagcacttcgccagcgttgccgagcgcctgcgctatctggtggccgaaggctactacgaagctgccgtgctcaatcagtatgattttaacttcctgtgcgcgctgcacgatgaagccgaggcatggggctttgagttcaaaacgtttttaggtgcgtggaagtactacaccagctataccctaaaaacctttgatggaaagcgttacctggaaaccttcgagcaacgtgcctgtatggtggcgctgacgctggcacaaggggatgaagcgctggcacgatcggtgctggaggccatcctgagtgggcgttttcagcccgcgacgccgacgttcctcaacagcggcaagcaacagcgcggcgagctggtctcctgcttcctgctgcgtattgaagacaatatggagtcgattggccgggcggtgaattctgccctgcagctgtcaaaacgcggcggcggcgtggcgtttctgctgtcgaacctgcgcgagtccggcgcgccgattaagcgcattgaaaatcagtcttccggcgtcattccggtgatgaagatgctggaggacgcgttttcctatgccaatcagcttggcgcacgtcagggtgccggggcggtctggctcaatgcgcaccatccagacattttgcgctttcttgatactaagcgcgaaaacgcggacgagaaaatccgcattaaaacgctgtcgttgggcgtggtgatccctgacattacgttccagctcgccaaagagaatcagccgatggcgctgttctcgccctacgatgttgagcggatatacggtcaggcgtttggggatatcagcatcagcgaaaaataccaggcgatgctggcggacgacagaatccgtaaaacctatatccagccgcgcgatttctttcagacgctggcggaaatccagtttgaatcgggctatccctacatcatgtatgaggacagcgtcaaccgggataacccgattgccggtcgcatcaatatgagcaacctttgctcagagattttgcaggtgaacagcgccagtgaattcaatgaggatctcagctatcgccggatgggaaaagacatctcctgtaaccttggttcgctgaatattgcccatgcgatggactctggcgatttggcgcacacggtggagacggcaatacgtgcgctaacggcggtgtcagatatgagtgatatcggttcggttccctccgtggcagaaggcaatcgccgctcccatgctattggcctgggccagatgaatctgcatggctatctggcccgcgaaggcatcgcctatggttcaccggaagcgctggatttcaccaacctctatttttactgtgtgacctattatgcgctgcgcgcctcaaatcagctggcaaaagagcgccaacaggcctttgatggctttgcggcgtcaacctatgccaccggtgcctattttgacaaatatctgcagtgtgactggcaaccgcgtacgccccgcatcgctgccctgtttgccagtgcgggcatcaccttacccacgcaggatgactggttggcactgcgggactcggtgatggcgtccggtttgtacaatcagaatttgcaggcgataccgcccaccggttcgatctcttacatcaatcacgccacgtccagtattcatccgattgtgtcgcgaatagagatccgcaaagagggtaaaaccggccgtgtttactatccggcgccctttatgaccaatgacaatctggaactctatcaggatgcttaccagattgggccggaagccattattgatacctacgctgaggcgacccggcatgtggatcagggcctgtcattaacgcttttcttccgggatgacgtgaccacgcgcgacataaataaagcgcagatttacgcctggaaaaaagggatcaaaacgctttactacattcgactgcgccagatggccctgcaaggcactgaagttcagggctgcgtctcctgcgcactgtgagaacacattatgcaactcagacaaattcaagccattaactggaaccgtattcaggatgagaaagatcttgaggtatggaaccgtctgaccagcaacttctggttaccggaaaaagtgccgctgtccaacgatctgcctgcctggcagacgctggataaacagcagcagcagctgactattcgcgtgtttactggcctgacgctgctggacaccattcagaacgtgctgggtgcaccgggattaatgcccgatgcgctgacgccgcatgaagaggcggtgctgtcgaatatcagctttatggaggcggtacatgcccgctcatacagctcgattttttcgacattgtgtaacaccagcgatgtggatgccgcttatcagtggagcgaagagaatcaggcgctgcaaaacaaagccgagatcatcctcacccattaccgtgctgacgatccgttgaagaaaaaaattgccagcgtttttctggagtcattcctgttctattcgggattctggctgccgatgtactggtccagtcgtggcaaactgaccaataccgccgacctgattcggctcatcatccgtgatgaagcggtacacggctactatatcggctacaagtaccagaaagcccttgagcaggttgatgaaggtcgccgcgaagccttgcagcagttcgccattgatttgctgctggcgctgtatgaaaacgaggtggtttataccgaagcgctttatggcgatgtcggctgggcggaagaggtcaaaaccttcctgcactacaacgccaacaaggccttgatgaacctgggctacgaagcgctgttcccggcagaaatgaccaacgtcaacccggcgattttgtctgccctgtcccctaacgcagatgaaaaccatgatttcttttcgggctcgggttcttcctatgtgatgggaaaagcggtagaaaccgaagacgaagactggagtttttagtgaaccctgtgccgtgattctgcggcacagtcattaatcattaatgacactgatttataatccgttatttcagccttatcgctatcattatttcttatccctttcctctgatcctcacgccattctggcaattcccttcgtctgagcaggctaattatctgctatttctcaaataaatcacaaaaaattcatcttccctcatcccttgtgagcgctggaaattatcgccatgacgggtaatttttagccatggatatttcacgtcagggttgacagataatctgagtatgtcaggttatagcctgcttaaattcgaccaggacacgtcatttcacattaaaataatttaatcagggcttcactatcgcatgacaattaaattagaagtaaaaaatctttataaggtatttggcgataatccacagagggcatttaaatatattgataagggctgtggcaaagaggagatactcgcaaagacaggcttgtcgttgggtgtcaaaaatgccagtctggccattgaagaaggcgagatattcgtcatcatggggttatccggttcaggaaaatccaccatggttcgccttctcaatcgtctgatagagccgacacgcggccaggtgattattgacggtgtcgatattgcgaaaatatcggacagcgaactgcgggaggttcgccgaaataagatcagcatggtgtttcagtcattcgcattaatgccgcatcttaacgtgttaaataatgccgcgtttggtatggaattagccggaacgcccctggtggaacggcaggaaaaagcccttgaggcattgcgtcaggttgggctgggaaattatgctcatgcttatcctgatgagctgtcaggcggaatgcgtcaacgtgtaggtctggctcgtgctttagccattaatcccgatattttattaatggatgaagccttctctgcgctcgatcccttaattcgtaccgaaatgcaggatgagctggtgaaattacaggccagacatcagcgcaccatcgtgtttatttcacacgatctggatgaagccatgcgcattggcgaccgcattgccattatgcaaaatggcgaagtcgtccaggtgggttcacctgacgaaatcctgaataatccggccaatgattacgtccgtacgttcttccgcggtgtcgatatcagccacgttttcagcgctaacgatattgcacgccgtaatgctggcgcgctgatccgtaaagcggccggtttaggcccgcgctcggccataaaactgctgcaggatgaagatcgtgagttcggctacgtgctggaaaaacagaaattcatcggtgtagtgtcaaccgactctcttaaagcggcgctggcggcaggacaagggctggaaagcgccctgctcgacgcgcccacggcggttcctgccacgacctcgttaaatgaactgctctcacacgtggcgcaggcaccctgtgccgttccggtggtgggagaagaaaatcaatacgtcggcgtgatatccaaaagcacgctcttacgtgctttagatcgtgaaggagccagcaatgagtaaagagacatcaaccccatgggataacgcggcggcaacggatacacagcgcagccagagtagcgatccctggtctggtgccgcagaccagagcagtgccgccgacagcagccatcatgcagccaccggcggtgcagatgcatggggcacaccggatggcagtgccgcgacaggctccaccagcagcaccgactggttgaacaacgcgcccgcgccccaggctgaccatttctcgctcattgaccccttccataaaacctggattccgctggatcactgggtaaccgaagggatcgactgggtggtgaatcatttccgcccggtctttcaaagtattcgcgtgccggtggattatatcctcagcgcgtttcaacagctgttgctgggtatgcccgcgcccgttgctatcgcgctgtttgcgttaatcgcctggcaaatcgccagtccggcaatgggcattgccacgctgatttcgctgatcgccattggcgctattggtgcctagtcgcaggccatgattaccctggcgctggtgctcacggccctgctgttttgcatcatcattggcttgccgatggggatctggctggcgcgcagtgaacgcgcggcaagaattgtgcgcccgctgctggacgcgatgcagaccacaccggccttcgtttatctggttccgattgtcatgctgtttggtattggtaatgtgccgggcgttgtcgtcaccattatctttgccctgccgccgattgtcaggctgaccattctggggattaagcaggttcctgccgacctgatcgaagccagtgagtcctttggtgccagcccgcatcagctgctgttcaaagtccagttgccgttggcgatgccaaccattatggccggcgtgaatcagacgctgatgctggcgctgtcgatggtggtgattgcctccatgattgccgtcggtggactgggccagatggtgctacgcggcattggtcgtctggacatgggcctggcctccgtgggcggtgtcggcatcgtgattctggccatcatccttgaccgcctgacccaatcggtggcgcgtgacaaacgcagccgtggcagccgccactggtatcacaccgggccaattggcctgctgacacgtcccttccgtaaatcctgaacagtaaaggcggccgttatctgccgcctttaacgcgacaacaaaaacgaggaataaccatgcgcaagacgatccctgccgtagttgccattctggcggccttatccgcttctcagacgttcgccgccgatcagcccggtaaaggcattacggttaaaccggtacagagtacgattgctgaagaaacgtttcagacgctgctggtgagccgtggcctggagaaactgggttataccgtcgagaaacccagtgaagtggattacaacgttgcctataccaccattgcgtctggcgatgcgaccttcctggcgaccaactggcagcctctgcatgacgatatgtataaagccgcaggcggtagcaataagttttatcgccagggaacctacgtctccggtgcggctcaaggctatctcatcgacaagaaaaccgctgagaagtatcacatcaccaatatcgcccagctaaaagatccgaaaattgcccagctgtttgatagcaatggggatggtaaagcggatatgaccggctgtacgccaggctggggctgtgaggcggtgattaatcaccagaatgaggcttatggtctgagtaaaacagtcaccgctaacatgggcaactactcggcaatggtggcggacaccctggcgcgctttaaacagggaaaacctattctgtactacacctggacgccttactggctgagtgatgtgcttaaaccgggccgcgacgtcgtttggctccaggtgccgttctcctcattaccgggcgaacaaaaaggcgtggataccaaactggctaacggcgcgaactatggtttcccggtcaacacgatgcacatcgttgccaacaaagcctgggcggaaaaaaatccggccgcagccaaactgtttgccgacatgaaactgccgattaatgatatcaatgcggaaaatgcagccatgcatgccgggcaaaactcggaagaggatatcaatcgtcacgtagacggttggatcaaaggccatcaggcacagtttgatcagtggattagcgacgcccgcgctgccgctaaataaggcacaactgactgacgaagggcggacggtggttcgcccttttttttcgccatcacctgtccatccacgcaccacataaacatagccctcaaataattttttaggttattattaacgtcacattattaatttttacctctgcctccctatgacaacctcacgtcctggtttaacgcccgccctggtgggactgatgtccgttgccaccggcctgtgtgtcgccagcaattattatattcagccactgctccacaccattgcgcagcacttcgacttatctgtcgcgctcgccgggttcattgtgaccaccgcacagcttggctatgcttgtgggctgctgttactggtcccgctcggcgacatgctggaacggcgcggcctgattgttggcatgatcgtgatggctgcggttggcatggtgatcattgccctctcttcatccttcccctttctgctgctgggaacggtgatcaccgggctcttttccgtcgcggcacagattctggtgccgttggccgcaacgctggccgcgccggaaaaacggggaaaagtcactggcacggtgatgagcgtactgctgctgggcatcctgttggcacgaaccgtttcgggcggcctggcacagttgggtggctggcaaaccgtctactgggtcgccagcgtcttgatgctgctgatggcactggccctgtggcgcactctgccgcgcattacgccgtctgtctcgctaaattaccgccagcttctggtttccatctttcagttgtatgcggccgatccggtgctgcgtacccgggcttatagcggctgcctgacctttgcgaatttcagcatcctgtggacatccatggcgttcctgctctcctccgcaccctatgggttcacggaaggggaaatcggactgctggggctggtcggtgcagccggtgcgctggccgccagaaaggcaggctcgctggcggataaaggtaaggccggactcaccaccagcgcaggcttgctgattatgctgttgtcatgggcagctatcgcctggggcgcgcagaatcttgtggcgctgattatcggcattttgttgctggatcttgccgttcaggccgtgcacatcaccaaccagagcgtcatttatgcgcgtctgcctgaagcacgcaatcgcctgaatgccggttatatgaccagctactttattggcggtgcgctaggctcattgttgtcggcaaatgcctaccatctggcaggctggtatggcgtctgtgtggccggggcgatattgacttccctgaatttgatcatctggtggcggaatcgtggtctggaacaggcgaatagcccgaatagtgtgatttagcctgttcagcagagtgtgagtttgctatcgttggcccaaagttattcacgtaagttattttttctttcgtaatcatttgatgtcgtaccgtttcactgtacgaccaacgcgtatggaatcgatgcgcaaaacctttaccctggggtcaaggacagatcgtgaatcaccacagtgcgacagcctgaggatggggtttcagaacccggtcactcacccatatgctgccaccgtggttactataaaagttgaaattagtgaggttttttctaatggaaagttcgtttacgcccattgagcagatgttaaatatccgtgcaaatcgtcatgcagattttcccttccaggagattctcctgacgcgtctttgcatgcacatgcagggtaagttgctggacaatcgcaacaaaatgcttaaagaacagggcattaatgaaaccctgtttatggcgttactgacgcttgatgcgcaggaagatcagagcatccagccctctgaactgagcaccgcgctgggttcatcacggacgaatgcaacacgtatcgctgatgagctggaaaagcgcggctggattgaacgtcgtgagagcgctcaggatcgtcgttgcctgcatcttcatttgaccgacaaaggcaatgcgtttctgcaacaggtgctgccacctcagcatcagagcctgcaatacctgtggtcttctctgaccggcgatgagaaatcgcagttggaaaacatcacccgcaagctgcttacccgtctggataaaatggaagaagataaactaactgcttccctttcacggtaatagcaagatctgcgacacaatcacctgacgaaatcgttattttaaccctcttttatccggccagcgcttagtcgctggcttttttggctcgggcgaaggtgaaaacggagtttaacccgccgacatagtggaaaacgtggagaaataaatgagtgcaacagaggcgcaaagcccgcatcaaccagtcaataacaagaagaaaaagcgcaaaggtgcgctgatattactggcgctggtggtcatactgcttggcattgcgtggggcgtttactggtatttagtgttgcgccactatcaggaaacggatgatgcttatgtcgccggtaaccaggtgcaggtcatggcccaggtatcaggcagcgtgaataaagtctggtttgatgataccgattacgtcaaaaaaggtgatgtgctggtgtcgctggataaaaccgacgcacagcaggcgtttgaaaaagcgcagaccgggctggcaaccagcgtgcgtcaggtgcaccaacagatgatcaatgcaaagcaatatcaggcgacgattaatctccgtcagaccgcgttagatcaggcacaggccgatctgaaacgtcgcgagccgttgggtgcctctaacctgattgggcgtgaagaactgcaacacgcgcgcgatgccgtggcttcagcgaaagcggagttggatgtggcggttcagcagtacaacgccaatcaggcggtgatcctgaatacgtctctggaaaaccaacccgcagtgaagcaaagtgcggcagaactgcgtgacgcctggctggcgctgcaacgtactgagattcgcagtccgatggatggctatgtgtctcgccgcagcgtgcaggtcggttcacagatcagcaccagcaccccattgatggcggtcgtacccgcaaccaacctgtgggtggacgctaacttcaaagagacacagctggctggcgtgcgtatcggccaatcggccaccgtggtggcggacatttacggtgacgatgtggtgtaccacggtaaagtcgtgggtctggatatgggcaccgggagcgcgttctcgctgttaccggcgcagaacgccactggtaactggatcaaagtggttcagcgactgccggtccgtattgagttgaaccaggacgaagtggctaaacatcctctgcgtatcgggctgtcaacattggtagaaattgataccgataataaagacggcagcgcactggctaccagcgttcgtcagcaggctgcctacagcagcaacgccctggccattgaccttgcaccggtcaataagctgattaccgatatcgtccacgcgaacgccggatgatgacccggaggctgtaatggcacaagcaccgctcaaagggatgccgctggtcttaatgaccattgcgctatccctggcgacgttcatgcaggttctggattccaccattgctaacgttgctataccgaccattgcgggtaatctgggggcctcaaactcccagggcacctgggtcatcacgtctttcggggtggcaaacgccatctcgattccgataacgggttggctggccaaacgcatcggtgaagtcaaactttttacctggtcgaccatcctgtttgcgctggcttcctgggcctgcggcatgtcgaaaagcctggaaatgctgattttcttcaggataattcaggggatcgttgcaggcccattgatcccgctgtcgcaaagcctgttgctgaataactatccgcccgcaaaacgcagtatcgccctgtcactctgggcgatgacggtgattgtggcccccatatgcggccccattctcggcggctggatcagtgataactatcactggggctggatcttctttatcaacgtgccgattggtgtagtggtcattatgctcacgctgcaaaccctgcgcggtcgtgaaaccgctacccagattcgccccattgataccgttggcctggtgctgctggttgtcggggttggctcgttgcaggtgatgctggatcgcggtaaagagctggactggtttaactccacagaaattatcgtcctgacgattgcggcggtgttggcgctggtgatgttactgatttgggagctgacagacgatcaccctatcgtcgatctggccctgtttaaatcgcgcaacttcaccataggctgtttgtcccttagcctggcctacatgctctattttggatcgatcgttctcttgccgcagctgctacaggaggtctacggttacaccgccacctgggcagggctggcctccgcgccagtcgggattattcctgtcatcctgtcgcccattattggtcggttctcccataagcttgatatgcggaaactggtcaccttcagtttcatcatgtatgccgtttgtttctactggcgcgcttacacgtttgaaccgggcatggattttggtgcatcagcctggccgcaatttattcagggcttcgcggtcgcctgcttctttatgccacttaccacgattacgctgtcgggtttgacacccgaccggatggcggcggcatccagtttgtcaaactttgtgcgtacgctggcgggttcaatagggacctcgatcaccaccacgatgtggacggatcgtgaggcaatgcaccacagtactctcagcgaatcggtgacgccttataacgtcaatgcgcagcagacgtacagtcagttggaggggatgggcatgacgcatcagcaagcctcggcgtacattgcgcagcagatcaccaatcagggattgatcatctctgccaacgagattttttgggcctcggcaggcgtgtttctgatactgctggtgctgatctggtttgcccgtccaccctttaccgccggtggcggtgcgggtggcgcgcactagtcgcaacagcgcgtagccttgtagcaggttctggcgtggcggtgatgcacgccagaacctgtattggctaccagcgcgtcgctttcatatcaatcacgaaacggtacttcacgtcacctttcagcattcgcgtgaaggcctcttcgacgtgctctccgcgaatcatctcaatgtccgccgtgatattctgctcgccgcaaaaatccagcatctcctgcgtttctttaatgctgccaatcgatgagccgctaatgcttaagcgacggaacaccatcggcgtcacgtccggtgaaacgtgcggactgtccgggatacccaccagcaccaggcgaccattggttttaagcgtcgccaggtaaggatcaagatcgtgaggggccgccacacagtcaaggataagatccagcccattccggctggcttgcatcgccgaggcatcgcgtgacaccaccacatgacgggcaccgagacgctgggcgtcctcggctttgtctggcgacgtggtgaaaagcgtgacctcagcgcccagggcacgtgccagcttcacggccatatgccctaacccgcctaagccaatgacgccaaccttatcgcccgctttaacgttaaaatggcgcagcggtgaccacacggttacgccagcgcacaacaatggcgcaacgccagccagtggcaggtgctgtggcaccgacaccacgaagtcctgatcgaccaccacgtgctcggcataaccgccccatgtccggtcaccggtgtatttatccgtaccgttataggtggcagtgaagccggcctcacaatattgttcttcctgatgctggcaaaaatggcatgtgcggcaggaatccaccattacgcccacccccacaatatcaccaggcgcaaaccgactggcagcgtgaccagtttcaaccacccgtcccacaatttcatgtcccggcaccaggggataatggcttgccgcccattcgttgcgtgccatgtgcaaatctgagtggcaaacgccacagtaaagaatctcgattctgacatcctgcggctgaagcgggcgcagcgctattagcccggacgtaagcggctgggttgcatcctgggcgactagtgcattaattttcatcgtgcctctcatagtgactggctttatataactgagggcggcaaactctacttaaacgggttcattattgatagtagttaccatttggtgaccataaaaggagtgcgctgacgatgcctgcctgggtagaaggtaaactggttttttatgtggattcgccaccgcgccgactgatggatcttttttctgccaagtggaatccgatggtgctgcatgccttgtaccactggcctggcggacgggcgcgcacgggcgaattacagcggagcctgcagggaatatcgaaaaagatgctgtttcagacgctgaaggagcttgagcagcgagggttaatcgcccgtcatgtttatgacgtgatcccacccaaagtggagtaccagttaaccgccctgggcaaccgttttgcaaaaccggtggaacagctttatcagtgggggctggataatcagcgggcgcttgatgagatggatgaacaggttcagcgcgcggcgtctggcgctgaaaaagatgcgggctgacgcggaagatgtttcccggacagcgccgggaaacagacaacggatggcgcgtttaacggcgccatcatttaatagtacggtcaggcgttctgacgccaccattcggcaagcagtacgcctgttgccaccgacacgttcaggctttcaacattaccggtgccgccaattgacaggctcatatcaccctgctggaaggtgctgtcggacaaaccttcacgctcctgtcccagcaccagtaccattttggcaggcaactcagctttagacagcggcgttccctgatggcttgaggtggtcactatggtgtaacccgctttgcggaacgcttccaggccttcattgaaggtggtaccgctgatggcctgaacatgttcggctccgccttcagccgtgcgaaccgccgcacccgattccagcagcgaggcatcgttgaccagcaggcctttcacaccgaagtgcgcgcagctgcgcatgatagcgccaagattatggggattgctgacatcttcaagcgccagcacgcagtctttggtttcggccttgctgagccactcggccacgtccatgcccatgcgttttttaatcaggaagcagacgccgccgtggtgctcagtaccggaagctttggtgatctctgcgtcatccaccacgtggtaagctttgcggttagccgccagccagcgcagcgcatcgcgaaaacgcggcgtcacactttgcacaaaccatgcacggacgatgcattcaggacggctctggaacagtgcctgacaggcgttttcgccataaacacgggtttcttccagacgctgacgacgaatctgctctacgtcaaccacgcctttaccgccaatcccaggattttcgggtttggtatcttcggctaccggtgggcgggatacggtgcgccagggtgaatcgctgctgccgtaggcatcacgattgtcgctgccacgatcgttgcgacgcggtgcgctgtcactgcggcgtggtgcgctgtcgctgcgacggcccgtactgcgtccgccgtcttcactacgctcagtacgcgggccagatgaacgacgattgtcttcacggcgagctgcaggacggccacctttgcctgtacgaggattcggcgcacgcgcgctttgctcatcttcgccacgcacgtacatgactttgaccttaccacttttgcctttaaattcgtcgttcatttcttcctcctgcattgagagcgcgaagattacctgatgtgactgcgcttagctatcaactattgaacctatagagcaatccacattgagccgatcttatcaccctttcataatgggtaatattgagcaaagtgctctacatcattatcagaggtttttatgaatacggtatgcacgtcttgccaggcaaccaatcgcgttcccgaagaacggcttgccgagggtgccaaatgtggtcgctgcggtgaagccttgttttcgggcgatgtcattaacgcgacggccgcaacgctggacagctatctgcgggacgatctgccggtcgtggtggatttttgggccccgtggtgcggaccctgcgttaacttcgccccggtgtttaaagatgtcgctcaggagcgcagcggtaaagtccgctttatcaaagtgaatacagaggcagaaccggctctgagcagtcgtttccgcattcgcagcatcccgaccatcatggtgtttaagaacggcgagatggtggatgtcttaaacggtgccatgccgaaagcccctttcaacgagtggctcgacgaatccctgtaagcacgacaggccagcctggctggccttttccctttgttcgacgcttcgattacactacgctttttcctgtcctgaataatcatgtctgataatgccgttttgcgtttacgagcccaacgcctggcccgtgccacgcgtccctttctggcacgcgggaatcgtgtgctccgctgccagggatgcctgttgcctgaaataaattgtctgtgcgccagcatccaggtgcagtctgctcgcagtcgcttttgcctggtgatgtttgataccgaacccatgaagccgagtaatacgggccggttgattgccgatgtgttaccggacacccaggcatttggctggtcacgtaccgagcccgatcccgcattgctggaagccgttgccgatgaggcttatcaaccgctagtggtttttcctgcctcgtatgcggatgaaggccgcgaggttatccactcgccgccgcttgcgggtaaaccgccgctgtttattatgctggatggcacctggaacgaagcgcggaagatgtttcgtaaaagcccctggcttgaccgctttccgctgatctcgctcaatgttacgaccccttctcgctaccggctgcgcgaagcgcatggcgaaggccagcactgtaccgcagagatcgcggcggcgcttctggagcaggcgggcgatacgggggcggcacaggcattaacccagcattttgagcagttccgtcaggcttaccttgcgggtaagccgcatcatcccggccaggcgcggtaatgcgcgccctggcaggctgattgtcgttattcaggctgggatctgcccgacggtaaaaaagtctaaaagcgtttacactcacctaaatctcgatgaatggagaaggtgatgagtcaacgtgggctggaagcgctgttacgacccaaatcgattgcggtaatcggcgcctcggtcaagccgggacgggcaggctattttatgatgcgtaatctgctggcgggtggctttagcggcccggtgctgccggtgacgccaaaatataaagcggttagcggtgtgctggcctggcctgacattgacagcctgcccttcgccccggacctggcggtgatctgtacccatcacaaaagaaaccttgagctgttacagcagctcggcgagaaagggtgtaaagcctgtattatcctctccgcgcccgccagtcagttagccgagttaaaacaatgtgccagccgctggcagattcgtctgctgggtcccaacagtctgggattactggccccatggcagggccttaacgccagcttttctcctgttcctatcgccaaaggccgcatcgcgtttatttcgcagtcgtcagccgtatccaacaccatccttgactgggcgcagcagcgtaaccttggtttttcgtggtttatcgccttgggtgacagcctggataccgatgtggacgacctgctggattttcttgcccgcgacggtaaaaccagcgcgattctgctttatcttgaacacctcagtgatgcccgtcgctttgtttcagcatcccgcagcgcgtcccgtaacaagcctattctgatcatcaaaagcggacgcagccgtcaggcgcaggcgctgctcggcacacacagcggtctggatgccgcctgggatgcggctatccagcgcgcgggcttattacgtgtacaggatacgcacgagctgtttacggcggtggagtcgttaagccatatgcgtccaccacgcgggcatcggctaatgattatcagcaatggcgcggcacccgctgcactggcgctggatgaactctatgcccgcaacgggaagctcgccacgctgagtgagccaacggtacagcagctcaatgccgtgctgccagaaggcgttggccacggcaatccggttgatttaaaagatgatgcaacgccggaacgctacctggcctgtctgaccgctctgctcgacagccacgatttagatgccctgatgattattcatgcccccagtgccgtcgctccggcgactgaaaccgcagagaaaatcatccagctgatccatcagcatccgcgcggcaaacagcttacgctgttgaccaactggtgcggcgaatactcttctctggcggcacgacgggcttttacccaggccggcattcccacctggcgtacgccggaagggaccgtcaccgcgtttatgcatcaggttgaataccggcgtaaccagaagttattgcgggaaacccctgccttgccggtaaacctgacgcaggatagcgctcaggctcaccaactgctgtcccaggcgctggacaagggcattgtgtctctggacacgcatgaagtgcagcccgtcctcaaagcctacggtctggcgacgctaccgacctggattgccaaagacagtgaggacgcggtcactatcgccgaacaaatcggttatccggtggcactgaagctgcgttcgcccgatgtggcgcataagtctgaggtacagggcgtaatgctctatctgcgtaacgccgcggaagtaaagcgagcggctgacgctatcgttgaccgggtaacacaaacgctgccgcacgcacggattgaagggctggtcgtacagagcatggccaaccgggccggtgctcaggaactgcgggtcgtggtggagcaggatgccctgtttggccccatcatcatgctgggtgaaggcggcgtggagtggcaggccgagaagcaggccgccgtggccttaccaccgctcaatatgacgctggcgcgttatctggtgattcaggcaatcaaaagcggcaagatccgcagccggagtgccctgatcccgctggatgtcgctggcctgagccaactgctggtgcaggtctctaacctggtggtggattgcccggaaatacaacgcctggatattcatccgctgctggcggcgggcagtgatttcaccttactggacgtcacgctgacgcttgcgccttttaccggtgacagtgaaacgcgtctggccatacgtccttatcctcagcatctggaagagcaggtagaactgaaggacggtcagcactgtttattccgccccatcctgcccgaagatgaaccgcttctgcgcgacttcatcagtcaggtcaccaaagaagatctctactaccgctatttcagtgaaattaatgagttcacccatgaggatctggccaatatgacgcagattgattacgaccgggaaatggcaattgttgcggttcgtcagcatcaggggcaaccggaaattatcggtgtcactcgcgccatttctgatgcagacaacattgacgcggagttttcggtgctggtgcgctcggatctcaaagggctgggaatgggacgacgtttacttgaaaaaatgattcgttacacacgcgcccatggtctgcaacaactgaatggcattaccatgcccggcaaccgcggcatggtcacactggcgaaaaaactcaactttagcgtagatgtgcaaatggacgatggcatcgtcagcctgaagcttttgttacaggataatgtcactttgccgtgtagagaaaagtaaaaatcgccccgcccgccgtggttgatgttattatttagcgttatgaccctgatttggtggcaaaaggccatacaatgaaccgagaagaagtgcactgtgatgttgtctaaatttaaacgcaataaacaccaacaacacctcgcacagctgcctaaactgtcacaatctgttgcggatgtgtcgacgttatattcgcctgccgaatttcgcgagacgcttttggaaaagattgcgtcagcgcaatcgcgcatttgtatcgtcgcactctatctggaaaatgacgatgcgggtcgggccgttatggatgcattatatgccgcgaaaatggctcgtccacagctggatatcagtatcttagtcgactggcaccgcgcgcaacggggtcgcattggtgccgcacgtggtgttactaatgccgactggtattgcgagatggcccagctacatcctgataacgtgattccagtctatggcattccggttaatactcgcgaagcaatgggcgtactgcatctgaaaggtttcattatcgatgataccttgctctacagcggcgccagcattaatgacgtttacctgcatcagcacgacaaataccgctacgaccgctatcaactcatccgtaatgccgcgctgaccgataccatgttcgaatggatgaatgtgcatttgaaagatgcagaggcggtcaatcgcctggactatgctgaccgtccatccagcccggaaatcaaaaatgaaacgcgtcagtttcgtcaggacttacgcggctttaactatcagtttgaaggtaatgccggtaacgatgaactcgcggtcacaccgctggtcgggttaggtaagcgcagcctgctgaataagaccatttttcatttaatgccgtgcgccgaaaagaagctcaccatctgcaccccctatttcaacctgccagcactgctggtgcgcaatatcattgcccttttacgccagggtaaagaagttgagattatcgtgggggataaaacggcgaatgacttctatatcgcgcccgatcagccgtttaaaatcatcggtgccttgccctatctctacgaaattaacctgcgtcgttttttaagccgcctgcagtattacgtcagcaacggtcaactgaccgtgcgtctctggaaagacggtgaaaacagctatcacctgaaaggcatgtgggttgacgatgagtggcagcttattacgggcaacaatcttaatccgcgcgcatggcgactggatctggagaatgcggtcctgattcacgatcctctgcagcagttgaccgagcagcgacagcatgagctgatgctgattcgtcaacacaccagggttgttgggcacttccgtgagttggaaagcattgctgactacccggcgaaggtgcgtaagctgattcgccgtctgcgccgtattcgtatcgatcggctcatcagccgtatcctgtgaagatccagaatgccgcagcctgactgcggcattctgtctgtctgccctgttacaacttaatgccttttccgtgccggtgtagcagcagcgacaccaggaacgccaacgctcccatgacggaaacgtaccagaagaacgtggtctccataccgttgtgcttcatcagtaacgccacgtactctgcagatccaccgaagattgcatttgccaccgcataagagagcccaacgccgagcgttcgaacctccggcgggaacatctctgctttcaaaatcccactgattgaggtgtaaaagctggtaatcagtaacgccagcataatcagggcaaaggcaataccgggactttgtacgttttgcagtagcgtcaggacaggtaccgtacaaatcgccgcaccagcaccaaaaatcatcatggaggtgcgtcggccaatcctatcggaaaggccgccaataatgggctgtagcagcatgtaaaccagtaaagcgccggtcatcaatccactggcggttttggcatccatgcctgaagtgttcaccaggtacttctgcatataggtggtaaaggtgtagaagctcaacgaaccgcccgccgtaaaacccagcaccatcaggaaaggtttcgtgtggttacgtaataagccaatgacactgccggcatcgcgatgctcacggctctgtttatcggaagtttcgtccagagagcgacgcagccacagcgctaccacggccagcatcgcccccaggaagaacggaatgcgccagccccatgtacgtagctcctgatcggttaacataaactgcagcactaccaccgtcagcacagcagctaattgtccgccaattaatgtcacgtactggaacgatgcgtaaaagcctttccgcccttccagcgccacttcactcatatacgttgcgcttgtaccgtactctccgcccactgacagtccctgaaacatacgcgccagcaataacaggatcggtgcggcgatcccgatactgtcatagcccggcaggcaggcaatcaccagggagccgaaacacatcatacagacagagatcaacatcgattttttgcgcccgtggcggtcaccgatatagccaaataaccagccgccaattggcctcattaaaaagcctgcggcaaatacgcctgccgtttgcaataactgggttgtggtatcaccttgtgggaagaaaatgtgggcgaagtagagtgagaaaaacgagtacacataaaagtcgaaccattcgacaagattacctgaagatgcgcctacgatggcccagatacgtttttttcggtcaagcacctgcgcttgttgattcttgatcacgtctgacatgctatgcctcggctccttgctgataagcagcgttaaagcgttgagtaaagcacggtcatggcggaaacggaaagatgtgttgtctgaatatgacaaaatgtgacatgcgttgttaattccctgaaacaactgaaatcttcagttgcgcaggcaggggaggccagcggcctcttcccgtccacatgcacatcaatgacgaggaagaggtcgtgttaacccgttaaaacgcggtgactaccgttacccccggcgattcaaacttatccatattcattaacgcttctatggattgctcaaggttaatggttctgccaatgagcttttcagggcggagttttcccgccgctatcatattcatcatgacgtcatagcggtgagcctgcatgccatgactgccaataatttccagttcattagcaatcaccctggccattgggataggcggtgcactgtgttcacccgccatcaggccgatctggatgtgcctgcctctttttcttagcgagttaatggagttcacgcaggtgaccgtatgaccgagtgcatccagggaaacatgcgctccaccctgggtaatgtctttgatggcttccgccacattgtgcacacgtgcagcattcacgacggcgacggcacccaaatcccgggccagctgcaatttatcctccgcgatatcaatcgctaccacgtttgccccaagtgcattcgcaatcatgatggcggagaggccaaccccaccacaaccgtggacggcaagccactgccctgcagacgttcttccctgatcgaccactgccctgaacgaggtgatgaaacggcatccgaggctcgctgcggtagtgaagttaagtgtgtccggcagcgcgatgaggttcaagtccgcctgctgtaccgccacatattctgcgaaagatccccagtgggtgaaacctggctggaactgacgatcgcaaacctgctgattgcctgagtgacactcgtgacaaaaaccacagcccgacacgaagggtaccgtgacattatcgccaggccgccattttgtcaccgcgctgccaacggcttctatcgtgcccgcaaattcatgtcctggcacatgcggcaaagggatatcgagatcgtgccccacccagccatgccagtcacttcggcaaaccccggtcgctttgacccgaatcaccacgccgtggggctcgggagtggggtccggaaccgttttcagtagtggtggcgacagaaatgactcgtatatgacagctttcatcagtaaaccctcatcgtaggtgtctttaaaattatacctttcgatcaggaaattacttttcagctattgcagctgaataattaattatgaaattatccttcattaaatacgctaatagtgagtggatatatcagtgagcattctggataagaaagatctggcgctgctgcgttatctccagcaggacggcagagtatcgagccttaagctttctcaggatttggacgtgagcccagcctcggcatggcgacgactgaaacggcttgaagatgaggaatttattgagggctatcaggcggtgattaaccgcagaaaggtgggctttggcgtgatggcatttgtccgtctggtttgcagtcagcacagtgaggcagcaacccgggactttgaagaacggatcacggccaatccttacgtactttcctgtcacaacatcaccggtgaagccgattttctcttacaggtcgtggcgcgggatttagaccattacagtctgtttattgaaaaggaattgcgtaaattacccggaattctgagtattaattcttctatatcactgagagaagtaaaaaaaacgcatccgttgccggtctagcggtggtgcaggtttatgccaggtgctgtgcgtgatgaccagcctgacgccctgcttttcacagattacgcacgtaaaaaagccctgaactttcgttcagggcttcttcacttattgtagggagtgagagcgtctgtgagtaagttttttacgttatgacggacacgccatccggctttctcacgcgccattttatcccggcccggcggttttaatgacgcggacggcgctcgcgcagtcccggccgcgcagcataaccgtcctgacgccccgctttccgcaggttacggacgtaaaaaagccctgaactttcgttcagggcttcttcacttgtttgatgcctggcagttccctactctcgcatggggagaccccacactaccatcggcgctacggcgtttcacttctgagttcggcatggggtcaggtgggaccaccgcgctacagccgccaggcaaattctttgtgcacgaaacgactcttttacgccatgaacgcgttgcattcgctctgccgcaacggtcacatacttcagtatgctcccgctgacgtcatcgctctgcgccttctcatgccgcaaaatctgtcgtttccgcaaattcttttccggtaaacaatgctgaaaatttaattcgtctctcaaccaaaacgcctctggcgttgtaaggttaagcctcacgggtcattagtaccggtaagctcaacgcatcgctgcgcttacacacccggcctatcaacgtcgtcgtcttcaacgtcccttcaggacccttaaagggtcagggagaactcatctcggggcaagtttcgtgcttagatgctttcagcacttatcttttccgcacttagctaccgggcagtgccactggcgtgacaacccggacaccagcggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagctggcttatgccattgcactaacctcctgatgtccgaccaggattagccaaccttcgtgctcctccgttactctttaggaggagaccgccccagtcaaactacccaccagacactgtccgcagcccggatcacgggcctacgttagaacatcaaacattaaagggtggtatttcaaggttggctccacgcagactggcgtccacgcttcaaagcctcccacctatcctacacatcaaggctcagtgttcagtgtcaagctgtagtaaaggttcacggggtctttccgtcttgccgcgggtacactgcatcttcacagcgatttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcagcttgcgcttaaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtcccttcacctacgcgccagcgtgccttctcccgaagttacggcaccattttgcctagttccttcacccgagttctctcaagcgccttggtattctctacctgaccacctgtgtcggtttggggtacgattttgtgttacctgatgcttagaggcttttcctggaagcagggcatttatcacttcagcaccgtagtgcctcgtcgtcacgcctcagtgtaaagtgaaccggatttgcctggaacacacacctacacgcttaaaccgggacaaccgtcgcccggctgatatagccttctccgtccccccttcgcagtaacaccaagtacaggaatattaacctgtttcccatcgactacgcctttcggcctcgccttaggggtcgactcaccctgctccgattaacgttgaacaggaacccttggtcttccggcgacaaggtttttcaccttgtttatcgttacttatgtcagcattcgcacttctgatacctccagcatgcctcacagcacaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgaactcacagcctgtgcacctttgtgtacgggagtatcaccctgtaccctgcgactttccagacgcttccactgatgcacaagctgatgatggttctgggctcctccccgttcgctcgccgctactgggggaatctcggttgatttcttttcctcggggtacttagatgtttcagttcccccggttcgcctcatgcagctatgtattcactgcatgatagtgtgacgagtcacactgggtttccccattcgggtatcgccggttattgcggttcatatcaccttaccggcgcttatcgcagattagcacgcccttcatcgcctctgactgccagggcatccaccgtgtacgcttagtcgcttaacctcacaacccacaggcgtttatctgtaataccgtaacggctgcgcgtaaagaatgcgtcgttgcgcggtgctcgccatgctcacgtacttcagtacgctccgctggctgtgcgccgacgcgccttgctttcttcactgctcgcgcgctactgcataacagttagcttgtaagctgtaagcttttgagagactcgaacgcgttgtgctgtgttccttattacggaggaacacgacaatgcgtcgtttcaaattttcagcttgttccggattgttaaagagcaaaatcttaaacacgactcgtaagtcatctttaagatatgtgggcaacacctttcacctgtcaccaagcaagtggcgtcccctaggggattcgaacccctgttgccgccgtgaaagggcggagtcctaaccgctagacgaaggggacacggacgtgtctcgacttcgcagccgtcttgcttctttatctttctatcagacaatctgtgtgagcacttcgcgggaaggtatcttcaggtaaggaggtgatccaaccgcaggttcccctacggttaccttgttacgacttcaccccagtcatgaatcacaaagtggtaagcgccctcccggaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcactgcggttattaaccacaatgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccgttaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccgagagcaagctctctgtgctaccgtccgacttgcatgtgttaggcctgccgccagcgttcaatctgagccatgatcaaactcttcaatttaagtttgatttgctgaaaccagttcagcggtgctcatctgtaaaacgtcataatgaatttcattatgtgttcactcgtgagacttgatattttttacgtccggagacgctgatatcaatcctgcgagtgcccacacagattgtctgataaattgttaaagagcagtgcgaacagcgggttaaccgtctgtcgcgaggtggcgtatattacgctttcctccttcagagtcaacctctttttcagaagtttttctccggcggctcagtttcctgaacctctcaacaccgcattccgtaagccgttgtgccgtgtcagtggaggcgcattatagggaaatattttaggctgacaagcgctaattcaaataaatctttcgagtgctcactttccaggcaatgcgctttaaaaaccacccaaaccgcaactagcaggtacaaaaaacgggcattacgcccgtttttacagagatgatcttactgatgcgccgtaatgacgtcgtcttttacatccatctcaatcactttgcccggaaccagcgcaccagaaagaatctgctgtgccagtgggttttctatctgctgctggatagcgcgtttcaatggacgcgcaccgtaaaccgggtcataaccgttttcacccagcagtttgattgcggcttcagagatatgcagctgatagcctcggtcttccagacgtttatacaaccgctgtagctgaatctgagcaatagaagcaatatgctgctcacccaacggatggaacaccaccacttcatcaatacggttcacaaactccggacggaaatgctgacccacaacgcccatgaccagccctttcatttcggcataattcagattaccgaaacgttcctgaatcaaatctgaacccaggttagacgtcatgatcacaaccgtattgcggaaatcaacagtgcgtccttgtccgtccgtcaaccggccatcatccagcacctgcagcaggatattgaagacatcgggatgtgccttctcaatctcatcaagcaggatcaccgaataaggacgacggcgaaccgcttcagtcagataaccaccctcttcatagccgacataacccggaggtgcacccaccagccgcgatacggagtgtttctccataaattcggacatgtcgatacgaaccatcgcatcgtcactatcaaacaggaagttagccagtgatttacacaattccgttttacctaccccggttggccccagaaacaggaacgacccgacaggacgatttggatcggccagacctgcgcggctacggcgaatggcattagaaaccgcttcaaccgcttcatcctgtccaatcacgcgtgagtgaagcgactgctccatacgcagaagtttgtcacgctccccttccatcatgcgagcgaccggaatacccgtccagcgcgccaggacatcggcaatctctacatctgttacgcggttgcgcagcagcttcatggtcttgccttcagcctgtgtagcggaagccaactgtttttccagcgccgggatcttgccatactgcagttctgacatctgcgccagatcgccggaacgacgagcctgctcaagcgtaagccgtgcctgctccagttccgctttaatattctgcgtacccgttaacgaggctttttccgctttccactcttcttccagctcggcatattcacgctctttctggtttagctcggcttccagcatatccagacgcttgacgctggcatcgtcagactctttcttcaacgcctgctgttccagcttcaactggataatgcggcgttccagccgatccagcgcttcaggtttggagtcaatctgcatacggatgctcgatgctgcctcgtcaatcaggtcaattgccttgtccggcaactggcggtcggcgatgtagcggtgtgaaagcgtggcggctgcgacgatagccgggtcagtgatctgcacgtggtggtgcagctcatagcgctctttcaaaccacgcaaaatcgcgatggtatcttcaacgcttggctctgccacaaacactttctggaaacgacgctccagggcggcatctttttctatgtactggcgatactcgtccagcgtggtggcaccaacgcagtgcagctcaccacgagccagcgcaggcttgagcatattaccggcatccatcgcaccgtctgctttacccgcaccaaccatcgtatgcagttcgtcgataaacagaatgacattgccttcctgttttgacaggtcgctaagtacccctttcaggcgctcttcgaattcaccacggtatttcgcccccgccaccagcgctcccatatccagtgcgagtacgcggcggcctttcagcccttccggtacttcaccattgataatgcgctgtgccagcccttcaacgatggcggttttacctacacctggctcaccgattaacaccgggttgtttttagtacgacgctgcaacacctggatggtgcggcgaatctcttcgtcacgcccaatcaccgggtccaacttgcctttttcggcgcgttcggtgagatcaatcgtgtatttttttaaagcctgacgctgatcttcagcaccttgatcgttcacgttgtcgcctccacgaagttgttcaatcgcttgggtgagcttttcgttggtggcacctgcggatttcaaaatatccgccagcgagccacgtgaatccagggctgccaaaacaaataattcagatgagataaagttgtcgttgcgcttctgtgccagcttgtcgcacaggttaagcactcggatgagatcggcagaaggttgcacatcgccgtcgctgccttcaacctgaggcagacggtcaatagcctgatcaatctgcgtacgtaacgctgcgacgtcagcaccggctgaggacaacagcggcgcaatagaaccgccctcctgtttgagcaacgcactcatcaggtgtaaaggttcaatgaactggttgtcgtgtcccagagccaaagactgcgcgtcggagagagcgagttgaaatttattagtaagacgatccagacgcataattcctcccattacaggtcaaatgctactggagattaagatgaggtcattcctcaaattttcaaggttaatgacctgagataggagtaaaaaatgcgctgtctggatcgtcttatgggctaagactataacagccaaattaaagttgccatacggccggtgacaccatcgcgacgataggagaagaaatcctcctgctcgtgaaaggtgcagcgtgagtccgcgctaacggatttcactcctgcggcgtgcagccgctgacgggccagcagccagatgtcggcgtagaatttctcgcccgctggacgaaaagcggcggcggcctgtgggtctttctccacaaacgcacgacggacttccgcaccgacttcaaatgcatcagggccaattgccggaccgagccaggcgtggatataagcgggagcagcctgaaactgggccagcgtattttccaggacgccgccacacagcccacgccatccggcatgagccgcagctacttcgctgccgtcatccgaacagaacaacacgggcaaacagtcagccgtcattaccgcacacaccacgcccgtatcacgggtgatacaggcatctgcctgtagcaacaggtttccgcctgcgctgaggcgttcaacgtcggttgaatggacctgctcaagccactgtggcatcgccggcaacgccgcaagcgagaccagccgctctcggttagccgccacatgctgcggcttgtcacccacatggctgcccaaattcagcgaacgccagttgccctcactgaccccgccctgacgtaaggttgaggcggcgcgcacccgatcaggcgcaggccattgtggaataatcaggctcatagccagtccagttgatccttgaacatctctgtatccgctttcagcgcatcaatcagatcgatcatgtcctgaggtatcgcagcatgaaactccatttcaatacccgagataggatggtaaagacgaagcatcgtagcgtgcagcgcctgacgatcaaatccgcgcagcgtggtaatgaagtcttcagatgccccttttggcggacgcggacgaccaccataaagcggatcgcccaccagaggatgattaatatgcgacatatgcacacgaatctggtgcgtacggccggtctccagtcgtaaacgtaaccgcgtatgggcacggaaatgctccatgatgcgataatgggttacagccggtttccccattgggtgcacagacatatgagtacgttttgtcgagtgacggctaatcggttcatctaccgtcccgccagctgtcatcgtaccaattgccacggcttcatattcgcgtgtaatttcgcgacgctgcagtgaatctacaaggtgcgtttgcgccggtacggttttcgccactaccattagcccggtcgtgtctttgtccagacgatggacaatacctgcgcgcggtacatccataatggccggatagtgatgcagcagtgcattgagtacggtgccatcgggatttcccgcgcccgggtgcaccacaaagtcacgtggtttattgatgacgatgatatcttcatcttcgtaaacgatatccagcgggatgttttgcggttcccagcgctgctcttcttcgatctctgcatcgatagatacgcgctcgccgccaagcactttttcttttggcttatcaataacagtgccgttaacactgacgcgctggtcgagaatccattcttttatgcgagaacgtgaataatcagggaacaattccgccaaagtttgatctaaacgttgtccgagttgtgactcggataccgttgcggtgagttgaacttgttgtgccatatacagcttcttcgttaacgttgggttttacggcgatgccgtttaatataatgtgctatcgtacctggtcattaccgggagctatacggacagcttccgccataacattttgaggataatcacttcgtcatgacgcgtatgaaatatctggtggctgcagccacactgagcctggcacttgttggttgttccggctcaaatgacgcggtaccggacaacccgccttctgaaatctatgctacagcgcaacaaaagctgcaggacggtaactttaaagcggcgattaagcaactggaagcgctggataatcgttatcccttcggtccctattcgcagcaggttcagttggatttgatctacgcgtactataaaaatgccgatctgcccatggcacaagctgccatcagccgcttcatgcgtttgaatccaacgcatcctaatatcgattacgtcatctatatgaaagggctgacggatatggcgctggacgattcggcattacagggctttttcggtatcgaccgttccgatcgcgatcctactcatgctcgtgatgcatttcgcgactttgcacagctgctgcgcagttatccaaacagccagtatgcggctgatgcatacaagcgtcaggtctacctgaaagatcgtctggctaaatatgagctttcggtggcgcaattctataccaagcgtgaggcttatgtcgcggttgttaaccgtgttgagggcatgatgcgcgattatccggatacgcaggctacgcatgacgcgctgccactgatggaaaacgcctatcgccagctgcaactgaatgccgaggcggaaagagtcgcaaaaattatcgccgccaataacggctgatacgtttgcgcttttagccacaaaaaaaagcagcctttagggctgcttttttatgcttgcagaacaagtgaaatgttcactttcctgccgagctaactcatcaagaatgccttgataatgctttggcttcaaggcttttcagccacattctcgccctttctcacaatttgctgtagttgacaaaaagtgacatttttttgtgatcaaaatcacacatctataggcatatcgcgctatgctggatccattcagacggcaatcacagagaggtaagaataatgatcgtgaatattaccagtaagcaaatggaaatcactccagccatccgtgaacacgtcgaagaccgtctcgccaagttagaaaaatggcaaaccgacctgattaacccacatatcgttctgtcgaaagagtccaaagaatttgtggcggacgccaccattaacacacccaacgggacactggtcgccagtgccaagcacgacgatatgtataccgctatcaacgacctgattagtaaacttgagcgccaactcaacaaagttcagcacaaatctgaagcgcgccgtgcggccaccagcgtcaaagactttacgcccgccgcagaagaataagttctgctccagccttacagacgcgcctacgggcgcgttttttgttgacagcttttcatctgtgcggttactctcagttcagcttatttttcggaacctgtcatgaaaacactgtcgtttttcttcgctttcttttttaccttcccctgattgggaggccattcgtcgtgtaaaaagaaagcgaagacgaacaacaaagcctcccaatcgggaggcttttttattggatagcttacaggtgagccttatgaccccggacaatccgcttctggcactgcgtgaaaaaatcagcgccgttgacgaaaaactactgacgttactcgccgaacggcgtttgctggctgtggaggtggcacaggcgaaactggcaacgcaccgccctgtccgcgacgttgaacgtgaacgcgcgctgattgagcaccttatcgtgctgggcaaaaaacatcagttggatgcccactacatcactcgtcttttccagttggtcattgaagattcggttctgacacagcaggcgttgctgcaaaaaaaccttaaccatcctcatgctcacgcggcccgcatcgccttcttaggcccgaaaggctcctattctcatctggcggcgcgtcagtatgctgcacgccatttcagtaatatggtggagtgcggttgcctgaaatttcacgacatcattaaacaggtcgaaaacaacgcggcagattacgccgtcttaccgattgagaacaccagctccggttctatcaacgacgtttacgacctgctgcaacagaccaatttatcgattgtgggtgagctgacgctgccgattgaacactgcatgttggtcagcagtcagagcgatctggaacagattgaaacggtctacagtcatccgcagccttttcagcagaccagccacttcattaaccgcttcccacactggaagattgtctataccgaaagcaccgccgcggccatggaaaaagtcgccgcactgaactcacctaaggtcgcggcgattggtagcgaagccggtggcgagctgtatcagttacaggtgcttgagcgcaatctggcaaaccaacagcagaatcacacgcgctttattgtcctggcccgaaaatccatcgaggtatccgatcagatttcggcgaaaaccacgctgattatggcaaccggtcagcaggcgggtgcgctggttgacgcgctgttggtattacgtcagcacaatctgattatgagcaagctggaatcccgtccgattaacggtaacccatgggaagagatgttttatctggatgtgcagggcaatctgcagtctgaaaaaatgcagcaggcactggaagagctgcgtgcgatgacgcgttcattgaaagtgcttggttgttatcccagtgaaaatgtcattcctgtcgaacccgagaagtagccagaaaaaaggcatccatctggatgcctttttacattacggacggctgtcgttagccgagcgaagcaagcttctgctctcaaccaaaaagcgtttggcgtgatcgccaaaccagtcttcgacccgattaaagctggcgataaaggcgtgtttatcaccttgctccagcagcgcaatggcttcaccaaaccgctgataatagcgcttgataaggttcaggttattttcagacgacatgatgatatccgcataaagctgcggatcctgcgcgaacaagcgccccaccattgccagctcaagccggtaaatgggcgaggataatgccagcagttgatcaagattgacgttctcttcagccaggtgaaggccataagcaaaagtggcaaaatggcgcagcgcctggataaacgccatgttctgatcgtgctcttccgccccaatgcggtgcaggcgagctccccagacctgtatttgctccagcagccactgataggcttcgggctgccgcccatcgcaccagaccacaacctgtttggccaggctgccgctgtcaggtccgaacatgggatgcaaacccactaccggtccgcgatgcgccgccagcatcgcctgtaaaggccgattcttgacggaagcaagatccacaaggatgcagtcatccggcagtggaggaagctgttcaatgacctgttcagtcagatgaatgggcacgctgataatcaccataccagcatcgcttaacagcgcatcggcccgatcccagtcgtctttatccagcgttttcacctggtaacccgacagcgtcagcattttagtaaacagccgccccatctggccattaccgccgacgataaccaccggacgaagatcgggacgcagcgttttaaagcctttatcgttttcgctggtataggattctcgcatcacacggcgcaatatgtcttcgatcaaatcggcaggcacacccagtgcttccgcctctttgcgacgggacgccagcatggaagcctcccgttccgggacatagataggtagaccatgacgactttttacttcgcccacttccgctaccagttccagacgttttgccagtagatccagtaacgctttatctaccgtatcaatttgttcgcgtaatgcgtttagttcagccaccattgcccactacacctcgtgtgaaagacgcgccgacagcacctcgtgtagctcatcatgcatttcacgcagtaatgcctccgtgacgctccagttgacgcaggcatcggtaacagaaacgccgtacttcatatcgctgcgcggctgctccgaagactggttgccttcgttaatgtggctttccagcatcaggccaataatcgaacggttgcctttcttgatctggtcaacggccgactgagcaacaccaggctgacggcggtaatctttgtcagaattaccgtggctgcaatctatcattaaggctggacggagtcccgctttaagcatggcagtttcacattgtgctacgtcttccggactgtaattcggcgctttgccgccgcgtaaaatcacatgcccatcgggattgccctgggtttgcagcaggcaaacctggccggactgattgatgcccacaaagcggtgaggcatggctgcagcgcgcatagcgttgatcgccgtccccaaacttccgtccgtgccgtttttaaagcccaccggcatcgacagacccgacgccatttcacggtgggtttgcgattccgtggtacgtgcaccgatcgccgaccagctaaacagatcgcctaaatattgcgggctgtttgggtccagcgcttcagtagctaaaggtaagcccatatcgaccaggttaaccagtaattcacgggcaatatgtaaacccgcttccatatcgaatgagttatccatgtaaggatcgttgattaaccctttccagccaacggtggtgcggggtttctcaaagtagacgcgcataacaagatacaggcgatcttttacctgttcagagagactttgcagacgacgggcataatccagagcagcttccgtatcgtgaattgagcaggggccacagaccactaacaggcgcggatcacggcctgcaatgatatcggcaatcgtctggcgcgaagcggcgatttgcgcctgctgcgcgttgctcaaggggaatttgtttttcagctcttccggagtaatcaacacttgctcattggcgatatgaacattgtttaacgcgtctttttgcatcgtcctgtcctttactctcatttatacggtcaaagggtcctcatggaggaggtgcttaactgtatcataagtggtacatctggcaatcctttgtgtacactttatttaccacattaaaaatgcaccgccaataaccttaattaaatcataaataacagaaacttaattaatatcacaaaaagccccagctattttttagtgtaaattaaaatgtacactaaatttattccccggtgcaaaattgcttgttaacataaagggggaaacgtacaaggatgagagcatgacaccgatgatttcgacacttcgcctgcgccctttcgatttacatgatattgaggctttcacggaagccgttaacgactctctggacacattgttgccctggatgagttgggcacatcaggattatcagccgcatgaagccgaaagctggattcgctttacacacttacaacgcgcacttaaagaagcggaagaatttgccatcgtggatgccgagaaccgcctgttaggtggtgcaggctttcgctttgctaaaaaaccgggagagttttgcgctttggggtactgggttcgacgtgacgcgcaatgtcagggcgttgccacgcaggcggtaaagttgttgctggattttggcttcgcgcgtccggaggtgcaaaccattgaactgctggcggttgaaaacaactatgccagcagacgcgtcgcggaaaaaagtggaggccgctttattgattaccgctatggcgtaattatcttagacagcggcccggttaacgcggcaatctatcattttcaacggccatgatcctggatatcaacgtgccatccctgctgccaactggccgcatttacaggctataagcctcagcgtaggcaataaaccagctattaacgtccatagtttttcctacgttgcgcagtgtgatgctgccgtattcgatgcgtgccagttcgaatgcgcgcatctttctgtggaaatggcaatagcccttaataaacatgccatcacaggattcaacgtccacacgtcggtaagcgaccctgccctcaaaatcaaaataactgaagccgatctctttcagatctaaccagggcatatcaacctcgacaaccggaacgtgctccgcaacagctgtagcttttctgttcttgcgcgccagctcctttctgtgctcgcgtcctgcccagacaataatcacgttagccgccacaaagataagggccggaccatacaatcccagcgcaagaaaaaggggaaacaacaccaatcccatgcttacccagactgccgtcaggcagcggcaaagccacttatgcttgttaccttccagtgcatatcgggctgaataaaatgaggctagcgaaagcattaaaccggaaactaaaaaaacggcgtccttcaaaacctgtccttatggcaatgagaatgaatcaggtaacgatcatatcagttcagcctcagccctacgctatgcgactgatatgccagttaatgtcgtgtgtcgcagcaaaacgatggcgatctcgcagcaccggcagccggccgggatcttgacgcacatccacggtaacagcgtgacgtttccactctgccccatgttattttcaacaagacagaacgtattatcctggcctgtctcttttagcctgaagacgacggcaaaaaaatcgttataggcactggcataaaaaaaggggctggcacattgccaaccccttgtttgctattaacttttagatgtcgcgttagcgataccttagttaagacgctctttgatacgagcagacttaccagtacgctcacgcaggtagtacagtttggctttacgcacagcgccacgacgtttaacagcgatgctgtcaattaccggagagtgagtctggaagacacgctcaacgccttcgccgttagaaattttgcgaacagtgaatgcagagtgcagaccgcggttacggatagcgataaccacgccctcgaatgcctgcagacgttttttagaaccttcaacgacccatactttcacttccacggtatcacccggacggaaggaaggtacgtcctgtttcatctgctcttgttcaatttgcttaataatgttgctcataattaaatctcttatcctgggtaaactgatagtcagggaagatcactctcccgcatcatcgttttgtcgctggtgttcctgttggaacgccttaagcaaccttgcttgctcttcagtcagagccaggttttccagaagttcaggtcttctcagccaggtacggcctagcgactgtttcagacgccactggcgaatatcggcatggttgcccgacagtaaaactggcggaacctccatcccgtctaacacttcaggtcgggtatagtgcggacaatccagcaatccctccgagaacgaatcctcatcggctgacgcctgcttgccgaggactcccgggataaaccgggcgactgcgtcaatcatcgtcatcgctggcagttccccgccgctgagaacgtaatcaccaattgaccattcttcatcaatttcggtctggattacgcgctcatcaatcccttcatagcgaccacagacaaggatgagcttgtcacgtgacgccagttcgcaaacgccctgttggtccagtttgcgtccctgaggtgaaagatatatcaccctggcaccctctcccgccgctgctttcgctgcggagatggcatcccgtaaaggttgtaccatcatcagcattcccggtccgccaccataaggacgttcgtccacagtacggtgccggtcgtgcgtgaagtcacgaggactccagctttgaacgctgagcaggccattttttactgcccggccagttaccccgtaatcggtaatagcgcgaaacatctctggaaacaggctaattacaccaatccacatcgtcttcgccgttacgttaccgtttgattcggagatcaaaaaccaggatcccaatctacttcaataaggccagtagagagatcgactttcttgataacctgttcatcaagaaacggaattaaccgctcctgtacaccaaacgcatctttcaggtttgccttcacgacgagaacgtcgttcgaaccggtttccatcatatcgatgactttacccagctcgtagccttcaacgttgactaccttgcaacccatcaggtctttccagtaataatcaccgttttccagcgcaggcagttgcgtcgagtcgacctggatttcgcaattggtcaactgtgccgccgcatcccgatcgtcaatgcctttgactttgatgatcaggtcctgattgtggtgcttccaaccatccagttctacctgctgccatttaccggcgcgctggataaaccagggttggtagtcaaagatgctttcagcgtcttcagtggaggaaaacactttgagccagccgcgaatgccgtatgccgcacccattttacccagaacaatcgggttaacaggtgcctgtgcggcaagttgtctgctcatgctcaccaccgtgacagattaagctgctttctttgcttctttgatcagcgcgttaacgcgatcagaaagcgttgcgccctggccaacccagtgctcgatacgatccagatccagacgcagaccttctgcctgaccagatgcgatcgggttgaagaaacctacgcgctcgatgaagcgaccgttgcgtgcattgcggctgtcagtgacgacgacctgatagaacggacgctttttagcgccgtgacgtgccaaacgaattgttaccataacatcctcttcagttaataaaacacccggcccccatcgaggaacggggtccgggtgctgtataaaaagcccgaaaattttactcattttggcgcaaaaagcaacctaaaccgagtaatcccaggcttttttgtggaacccattagcgtcctgggaaacctggcggcatcatacctttcatgccgcgcatcattttcgccattccgcccttcttcattttcttcatcatgcgttgcatgtcgtcgaactgcttcaataagcggttaacgtcctgcacctgcattcctgaacctgtggcaatgcggcgtttgcgcgagcctttaataatttcaggtttctcacgttctttacgcgtcatcgaattgatgatggcttccatgcgcaccagcactttgtcatccatttgcgattttacgttgtctggcagttgccccatgcctggcagcttgcccatcaggctcgccatgccgcccatgttacgcatctgctttaactgctcaaggaagtcattgagatcaaaaccgtcgccggttttcagtttcttcgccagtttttctgcttgtgcgcggtcaactttgctttcgatatcttcgataagcgacagcacgtcgcccatgccgagaatgcgcgaggcaatgcggtctggatagaacgcttccaacgcatcggtcttctcgcccatccccataaatttgatcggcttgccggtgatatggcgaatcgacagagcagcaccgccgcgagcgtcaccatccacctttgtcagaataaccccagtcagcggcagcgcttcattaaaggctttagcggtattcgccgcatcctgaccggtcatggcatccacgacaaacagcgtttcaaccggattaatcgcggcatgaacctgtttgatttcgtccatcatcgcttcgtctacgtgcagacgacccgcggtatccaccagcaatacatcataaaacttgagtttggcttcacgcagcgcgttattaacgatatcaacgggcttctggctcacatccgatgggcagaaatccacaccgacctgctgcgccagcgtttcgagctgtttaatcgccgccgggcgatacacgtccgcagacacgaccagcacttttttcttgtgcttttcacgcaggaatttacccagcttacctacactggtggttttacccgcaccctgcagaccggccatcagcacaacggccggcggctgtgcggcaagatccagcgcgttgttttcagcacccatcgccgtaaccagttcgttacggacgattttgataaattcctggcccggcgtcaggcttttgttgacgtcgtggcctaccgcgctctctttgacgcgattaatgaagtcacgcaccaccggcagcgcaacgtcagcttccagcagcgccatgcgaacttcgcgcagcgtgtctttaatgttgtcttcagtcagccttccgcggccgctgatattgcgcagggtttgcgacaaacgatcggttaaattgtcaaacattgtctctcacttaaaaaaatcgcgaggcgccatatcggcagaatgcggcggattataacacgaagcagtggcgatctcttcaattccacctcagatcgtttggagcctgctcctgctggcgctatactgcccttttcctttatctgactgatgcctgaaaggaactatgtccgttttcgcgattgtggcgctgttcgcctactccctgagtcttgcactcattatccccagcctgttgaagcgtcaaagcggctggcgcagattagctgtgctgtcggcctgtgtggcgttagtgacacatgctgtcgccctgcagcaacgtatttttgctgtcgatggcggacaaaatctcagcctgctcaatattggctcccttgtcagcctgctgatctgttcgatcatgaccattgttgcctcgcgaaatcgcggctggctgctgctgccgattgtctatagctttgcgttaatcaatctggcctttgccacctttgtgccaaatgcgtttattacgcatcttgaaaccacgcctggcatcatgattcacattggcctgtcgctgtttgcctatgcgacactgattattgcggcgttgtacgcgttgcagctcgcgtggatcgattaccagttaaaaaacaaaaagctggctttcactcaggatatgccgccgctgcttaccattgaacgtaagatgttccacattacgcaggttggcgttgtattgctgacgttggtgttgtgcaccggcctgttctacatgcacgacctgttcagcgccgaaaacgtggataaggccgtgttgtcaattattgcctggtttgtctacatcgttttgctgtggggccactatcatgaaggctggcgcggtcgtcgcgtagtgtggtttaactgcagcggcgcactgctgctcacgatggcttactttggcagtcgcgtacttcagcacctgcttgttcacagttcttaataaaaaggaagttttgcggtggaacatgtttcgaccacgaccctgattgtcacactcatcattatggtgctggtttcagcctacttttccggttctgaaaccggcatgatgacactcaatcgttataaattgcgccatcaggctaagcatggccatcgcgcagcccgccgcgtcgaaaaattgttaaagcgtccggatcgtcttatcagtctggtcctgatcggtaataacctggtcaacattctggcatccgccattgggaccattgtgggaatgcgtctgtatggcgatgcaggcgttgccatcgcgaccggtatcctgacatttgtcgtgctggtctttgccgaagtcctgccaaaaacggttgccgcgctttatccagaaaaagtcgcttatcccagtagttttctgctcggtccgctgcaatacgtcatgctgccgctggtctggttgctgaataccattacccgcctgttgatgcgcctggtgggcatccgggcggatggtgcgattagttcagccctcagcaaagaagaactgcgtaccattgtctatgagtcgcgtacgcacatgtcgcgccgtaatcaggatatgttgctgtccgtactcgacctggagaaggtcagtgtggacgacatcatggtgccgcgtaatgaaattgtcggtattaacatcaatgatgactggaagtcggtgattcgtcagttaagccattcaccgcacggccgcattgtcctgttccgtgattcgctggatgactgtgtcggaatgctgcgcgtgcgcgaagcctggcgcatgatgaccgagaaaaaagagtttacgaaagagatgctgctgcgtgccgctgacgagatctactacattcccgaaggcacgccgctcaacatccaactggtgaagtttcagcgtaacaagaaaaaaacgggcctggtggtggatgaatacggcgacattaagggcctgatttcgatagaagatattctggaagagatcgtcggcgatttcacgacgtcgatgtccccttcactggctgaagaagtgatgccgcaaaacgatggctcggtgctgattgaaggcagcgccaatattcgtgagattaataaagtctttaactggcaactgccggagcaggaagctcgcaccattaacggtatgttgctggaagcgctggaagagatccccaccgttaacacgcgcgtccgggtgaatcactatgatgtcgatatcctggatgtgcaggataatatgattaagcaggttcgcattaccccgcggacaccgcttaagcaatcagtaggttcctgatgccgacaaaccgcctctaaaggcggtttttcttttcgtcacaacctgcgccacttcatggctggcaacagtacgtgacaccgttgttttagctgcgcaataaaaaacgccgctaacaggcggcgttttactgtcagaacagccgaagccagactagatgtgcagttctttcagtttttcggcaggcagtttcagatcgtcgttatggttcacgccgatatcctgcgccagcacgttgcgggcaatttgttgcgcttcatccagtgagtgcagcttatagctaccacactgatattcattcagctcagggatctggttctgatctttcaccttcagaacgtcctccatcgcgcctttccaggcttgtgccacacgctgctcgtctggtgtgccaatcaggctcatatagaaacctgtacggcaacccataggcgaaatatcgacaatctccacaccgttaccgttgagatggttacgcataaagcctgcaaacaggtgctccagcgtgtgaataccgcgttccgtcaggatgtcgatattcgggcgacaaaagcgcaggtcgaaaacagtaatcgtatcgccatggggagtcttcatggtttttgcaacacgaaccgcaggcgcggccatgatggtgtgatcaacagtaaaactatccagtaatggcatacgtcacctcttagtctgaaaaatttttttaggaacgatgaaacttttccgatcgcccagcgtctgaatatatgaaagacgcgcatttgttatcatccatccctgacaacagagatgttaatttggccacattgatgtggcctttttcttttctacccttcccggccagccagataggtttcaaaatctaacgtatcattcgcttcaagctgctgctgcgcggcgacggattcctgcgcctgacgcgcgaagtcttccggcttcagcacttccagtggctcgttgataagcaactgccagtactgttctgccagggcaatccccgtaccggtcacgccgttttctttcatcgcatgaagaatacgcgccgaataggttagctcaggatcgtcaaaggatgctactagttcgtcgcagacttgctgatattctgtagtcccctgattactgtccaatgcttctgcaacgcggcgcaaatcggcaaacagggttttccccatctcgaccagcgagtactctgcttcaccacagccaacggcgattttaaggtctggtttacgcccttcaagcaccacacggttccagttctgccgactgcactgtaattcatcagcgctcatttctggcgcgtctgccagcgtacaccaaatcaggaacagatcgaggaaccgcacctggttttcatccacaccgatgggtgaaaagggattgatgtccattgaacgcacttctatgtactcaatgccgccacgaagcagggcatcagaaggcgcttctccggaccgggtaacgcgctttggtcgaatcggggcgtagagttcgttttcaatctgcagaacgttggtgttcagctgtaaccagttccccgctgcatcctgggtgcccatcttcacgaagtcttccgagggcgttttaatcgcttttttcagggcgctgacatagccctcaagtgagttaaacgtaatacccaatgagctttgcgacttattggtataacccaggtcgctcaggcgcaacgaggttgcatagggcagccacagcgtacctttcttatccgtatcaaacggtagcgcgctttttttgccctgcaggaagctggagcaaatcgcaggcgatgcaccaaacagataaggaatgatccagccaaagcgataatagtttcggatcagccgcaggtagccggcagaaatggtgtctttcccgctctcgtaatcttttacgtccgcccatgcctgccagaatgacagtggcagcgagaaattataatgaatcccggagatggtttgcatcagcgcaccatagcggtttttcagcccctggcgataaagggttttcatacgaccaatgttggatttgccatactgcgccagcgtaatgttatccgcatcctcaatcaggcaaggcatgctgaaaggccacatgcgctcttcaccgagctcgctggcaacatgacgatggacatcacgcaaaaatgcgagcatatggtcgatgctgtgatcaaccggggtgataaactccagcagcgtttcagcaaagtcggtggtaatccagtcatgcttaagggccgaacccagcgactcaggatgagccgtcgtcgcaagatgaccatctggctgcacacgcagcgtttcacgctcaatgccacgaccaatgcctttcagtgcatcaggatgcgcttccagccaggacaacgcttttgatacgtcggggatcacattaacctcccgctgtgtgaataatttatttttgttcagcatagtgttaaccctagccccgaatctgtacgaatcaatgccaccattccatgccctgtaatgtggcggtcgcaataacgatgtaacgcagcgttttaccgatagccagaaacagcaccgaaggtaaccaggcaaagcgtaaccagcctgcgaggacgcagagcagatcgcctataaccggtagccaactcaacaacagcgctgccggccccagccgttgcaaccacgtcattgctgtctcatgccatcgcccctgacgttttaacggcaataagcgacccaaaattatgttggtcaagccacccagggtattccctaacgatgcgactaaaatcaacccgtaaactgatgcgcttttcgcgatcagtaatgcaaccaacagcgcctcagagctacctggaaggagcgttgcactgagaaagctgctgctaaataaagatacataagccagcgtttcgctcacagctggcgaacatcaaccacggccatacctgcggcctttgctgcctgcacgccaaaatcagcgtcttcgaataccacacaacgtgtcggttcaacgcccagtaacgccgcacagcgcaagaacgtttcaggctcaggcttatgatgttcgacgtcatccgcccccaccaccgccgagaaaagcgccctgacgcccagatgattaagaagtgcatctgccatggcgcgctggctaccggttccgacagccatgggtcgacggccatgataagccttaacgatgtccattagcggaagcggctggacgttatccagcagcatcgctttgaccgctgccgttttttccgcggcgagcgcataaggatcgtgatctgactgattggtttcgacaattaactgcgccagccgccatgacggcgcaccattgaaatccatcatgcgcgcttcatcgaacgccagttcataacgtgccagcacctgacgccacgcttttcgatgtgtcggttcagtatcaagaatagtaccgtccatatcgaaaatcagggcgtcgtattgatcgtagattgtcacagaggacctccaacaaatgagccactactttagctgaatgtgcgtaggttgtcgccaggcgggatgaacagcaaatgctttgaaagcattagcaattttagttttcggataaaggtgagcgggttggaaagcctgtaaggtcgcgaattcccagtgattttgtgaggtaagctgaagatcagcgttgcgctaagaaacgcataagaaattaacggaagagcgtagaaaacttaacacagcgctaaatgttgacctgcctgaaaacggctatcgcacggatgaatttgaaccgggacagttcagacggtgtaaaacgggcctgtgaagagaaaaaggaagactggcgaagatatgtctgtcatgccgctaacgggcgctgaggagctaaagagataacgatctgtttgtcctgcatgatacgaaaggggggaaggttgtttgttatctggctggctgtacgcacatccggtcaggacagagagagaaggagaaggagaagggtttcgctttagaagtgcagaagatggtgcatccgggaggatgactcggctgtagcctcgccctgcgggccgtcgctgaagcaacgttatcctccctggtatttgctgtaaatacgtcaggacaggacagaaggatttcgctttagaagtctagaatatggtgcatccgggaggattcgaacctccgaccgctcggttcgtagccgagtactctatccagctgagctacggatgcattgaaaatcttttatggactgacagaaatcaacctgggggtaatacgaagaatggtgcatccgggaggattaccaggcttgcgccttgccctgtgggcagttgctgaagcaacgttatcctcactggttctgactgacaaatcgatgatgtcttacagaccaggaacacacgtccatactctaaagtatggtgcatccgggaggattcgaacctccgaccgctcggttcgtagccgagtactctatccagctgagctacggatgcattatgaaattcttgtacaacgcagggtgctaacgactcaccatgaaggaattgctagttcactttacaactctgttccgacgatgttgtctgctggcgcgtcgcctgacatcaacatatccaacaatatggtgcatccgggaggattattcggctgacgcctcaccctatgggccgttgctaaagcaacgttatcttcccttgttctgactggcatatcgacgatgccttacagaacactcatacacgtccatatcgaaaaacatggtgcatccgggaggattcgaacctccgaccgctcggttcgtagccgagtactctatccagctgagctacggatgcatcggaaatggcggtgagggagggattcgaaccctcgatacagcttttgaccgtatactcccttagcaggggagcgccttcagcctctcggccacctcaccttacgcgttcttccgaactgtgcttctgaactttgtttctgctcatcggcactgcgtggcgcacatattactttcccgcacttataagtcaaacaatttttcggaaggttttttccgtttgcacaaatgacaggcaattgggacaaaatgacggcaaaaagagtgaataatcaacaatgaaagatgatgaagttaacaaaaatgggagatgaggagtaaaaagaaaacgaagaggcagagaaacaagggtagcgtctcgcacaggtgcgagacgctgaatctgtcaaacgttggtttgttgcgttttttcggcctggatgcgctgatagatctcttcgcgatgcacagacacttcttttggtgcgttaacaccaatgcggacctggttacctttgacacccagtaccgttacagtcacctcatcgccaatcatgagggtttcaccaactcgacgagttagaataagcattctttgctccttgaaagattaaaagagtcgggcttatgaagcttcccggcgttatccatcacttaacgctgcacacaggctatgagaaatacaccattgcacatcaacgcgccaatacattctgctgataaatagtttagccgaaatacgctacatcaacccgactttgtcactagcaaatttaacatcgtattaaaaagcgccggaacatcagttctggcgcttgctacgatgaattattttatttcattacagacggctcgaaacccatccttcaacgcctgccagcgcacctttcagtgcagtagcatcactgccacctgcctgcgccatgtccggtcggccaccgcccttacctcctactttaggtgcaagttcggcaatcagctccccggcttttacgcggtcggttaaatctttcgttacgccagcaatcagtgacactttgccatccgctaccgtagccaacacaataatcgctgagcccagttggtttttaagatcatccaccatggttctcaacattttcggatcggtattgctcaactcagtcaccagcagcttaacgcctttgacgtcaaccgcatgattacccagttgtgcactttcctgcgctgcctgctgatcgcgtaactgctgtaactctttctccagcgaacgcagatgatcaaccagaccgcgcactttttcattcaggttactgctgttggctttcaccaggtgggcaatgtcctgcagttggctactctgagcgtacacctgcgccagcgccgcttcacctgttatcgcctctatacggcgaatccctgcggcagtcccggactcggcctgaatgcggaacaggccgatatcacccgtacgcgcagcgtgcgtaccgccacacagctcaaccgagaaatcccccatggtcagaacgcgtacgcgctgatcgtatttttcaccgaacagggccatcgcgcccttggcttttgccgcctcaagatccatcacattggtttcaacgggcaaattgcgacggatctgggcgttaacaatgtcttcgacctgacgaatctcctgaggtttcatggcctcaaagtgtgagaagtcaaaacgcaggtatttatcgtttaccagggagcctttctgggcgacatgttcacccagaacctgacgcagtgctgcatgcagcaggtgagtggcggagtggttcagacgaatacgcgcacgacgcgcctcatcaaccacagcctcaagacggtcaccaatgcgtaattgtccgctgctcagtttgccaatatgaccaatagcctgaccatatttttgcgtgtcctgtacgctaaacagcgcgttgctgcctttcagctcacccgtatcgccgacctggccgccagattcgccgtaaaaaggggtttcatccagtacaaccactgcatcctgaccggcagtcacggcgtcaacggcttcacccgcgacgaacagtgccttaacggtcgccgacaggtcgagttggtcatagcctttaaacgatgaggcggcatcgatacgaatgacattgctgtaatcggcgccaaagccactggcttcacgtgcgcgctgacgctgctgttccatcgcctgttcaaaaccggcttcatcgattttgagattgcgctcacggcagacatcggccgtcaaatcagcagggaaaccaaaggtatcgtacaagcggaagacggtttcaccatccagcgtatcaccctgcagtttcgccagttcgtcgtccagaagcgccagaccacgctcaagcgttttagcaaactgctcttcttcacttttcagaacgttctcaacctgagcctgttgccgctgtagctcttcccctgctgctcccatcacctcaaccagtggcgcaaccagcttgtagaagaacgcgtctttagcccccagcatattgccgtgacgcaccgcgcgacgaatgatacgacgcaggacatagccacggttttcattcgaagggatcacgccatcagcgataaggaatgcacaggaacgaatatggtcggcaatcacgcgcagcgatttgttgttcaggtcggttgcaccggtaacctgtgcgaccgcttcaatcaacttctggaacaggtcgatctcatagttcgaattaacatgttgcagcaccgccgtgatgcgttccagccccatcccggtatcaaccgatggcttaggtaatggcagcatggtgccgtcagcctgacggttaaactgcatgaagacgatattccagatctcaatgtagcgatcgccatcctcttcagggctgcctggcggtccaccccagatatgatcgccgtgatcgtagaaaatttcgctgcagggaccgcaagggccggtatcgcccatctgccagaagttatccgacgcgtaggcgctgcccttattatcaccgatacggataatacgctcacggggaacgccaatctcgttggcccagatatcgtaagcttcgtcatcggtttcatacacggtgacccacaaacgctctttaggcagcttaaaccactgctcgccggtcaggagttcccaggcaaatgcgatagcttcctttttgaagtagtcgccaaagctgaagttgcccagcatttcaaagaaagtgtgatggcgcgctgtgtagccgacgttttcaaggtcattgtgtttcccgccagcacgtacgcaacgttgtgacgtcgttgctcgtgtgtagtcgcgcttgtcctgaccgagaaacacgtctttaaactggttcatgccggcgttagtaaacagcaacgtcggatcgttgttaggcaccagggagctgcttgctacaacctgatgtcccttactattgaaaaagtcgagaaacgcttgacggatctcagcagtgctcttgctcatatatatcctggaatcacgctaacgaaaggtccttctttatcaggcgtgccgcatcgttacggcagcaagcttgaggaaccaaaaggggtaagataaatattcttcggggggaagtaaaatcacatcggctattcgtcgtcaaaatttctgaaaacctgctgaatatcttcactcaggaagcctttagcatgcaggaagcgctgtactttcgctttttctttccattcagtcggcaaaggatggccaaacttcttttctgcaagttcagccgcacaggccgaccagtcaatctcggtctcttccatggcaagatcgatcgcctcgcggccgatgcccttttgcgccagctcaagcctgatgcgttgcgagccaaatcccttacggcttcggctctggataaaccgcgcggtaaagcgctcatcatttaaccagccgttttcactgcaccagttcagcaccttttccaacagctcgggcgtaatgatttcgggatctttttgttttatccacgcactacgctgcgcagacagctggagtttctgtttaagttcttcgcggctgtggtcacgttggcccagcaggcgcatcgcgcgatccaacaggcgtgaaaatgagatgacttgtggctgaggttgttcagacatactgcgcaccttttacaaacggagtgagagtatggcgggagatggggacagaggaaaggcaagtgaggctttaatgtcaaacaggagcggatttttccgctcctgtctcaggctttaatagtcttcgttggcttcgcttgccgcgttctcaacttcattggctgaagcgccggctgcgatattttgatcgccaccgttaagcagcatctcgcgcagtttcacatccagctcgtcggctatcgccgcgttttctttcaggaaattgcctgcgtttgccttgccctgaccaatcttatcgcctttgtagctgtaccatgcaccggctttttcaatcagcttgtgcttcacgccaagatccaccagttcaccgaaggtgttgataccttcaccgtacataatctggaactcggcttgcttaaatggcgcagcaattttgttcttaacgaccttaacgcgtgtttcgctacccacaacgttatccccctctttaatcgccccaatgcggcgaatatcaaggcgaacagaggcgtagaatttcagcgcgttaccaccagtagtggtttcagggttaccaaacatcacaccgattttcatacgaatctggttgatgaagatcagcagcgtatttgactgtttcaggttacctgccagcttacgcattgcctggctcatcatacgtgccgccaggcccatatgtgagtcaccgatttcaccttcgatttcggcttttggcgtcagcgctgctacggagtcaacgataatcacgtcaacggcgccagagcgggccagcgcatcacaaatttcgagcgcctgctcgccggtatccggctgcgaacacaacaggttgtcgatatcaacgcccagcttcttggcataaatcggatccagtgcgtgctcggcatcgataaaggcacaggttttgcctttacgttgcgcagcggcaataacctgaagcgtcaacgtggttttacctgaagcctcaggcccgtagatctcaacgatacggcccatgggcaagccacccgcacctaacgcaatatccagtgacagtgaacccgtcgagatcgtttccacatccattgagcggtcttcacccaagcgcatgatggagcctttaccaaattgcttctcaatctggccgagcgcggcagctaaagccttctgtttgttttcatcaattgccatttctactcctaatcatgccgggtaaacacgcacgcatggtgcctgtgcactttctgttgcgagtaattatactgtatagtcatacagtatcaagtttaatttttcagaaattgactggataacgtttgtagcgcccagccaacagactgacggcgcacggcatcacgatcgccgtcaaactgctgacgaaaagccatgacaacaccaccctgtgccgcaaagccaaaccagaccgtccctacaggtttatcttcactgccgccatccggaccggcaatgccgctgacggaaatggcgtaatcagcacgtgcccgctgctgggctccctgcgccatttcacgcaccaccgcctcgctgacggcaccgtattccgtgagcgacgcggcactgacgccaaccagctcctgcttggcatcattactgtaagtgacaaagccccgctcaaaccaggccgagctcccgctcacgtcagtaaacactttcgctatccagccgccggtgcaagattctgcacaggtgaccgtggcgttacgctgcttaagcgcttcacctatctgcgcactcagcgcctgcaactgctggtcattcatttttttgctccctgtcgccgttgactgaacatggtgcaatcctcgctctttttcaagcgctcagggccagccagtgaagaaattgcggtttactgtccagttttagcctgtacgcgtcgccaccataaacagtcgtgggaaagccagcagcaccctgccgtcctggcgcgctggataggcggtaatcaggcactggtgataggccgccagaaactgctcctgttcagacacgtcaagaggcgcaagaaacggacgcaacccggtggccttcagccagtggataattgcctgcgcatcgtccataacgtggtaataggtggttcgccagatatccacggcacatcccgccttcgccagcacatcataatagtgctctgttgagggtaatcttttgcgttctgcagcctgtgcgctgatcttctcgcgccagggcccggctgtcgccacctcacgcattaactgatgtgaaggttcatccagattatccggcatctgaatcgctaacgcgcccgacggtgccagttggttaactaactgcggtaacagtgcgggatgatcgccaagccactgcagagaagcattggcataaatcacctgctgcgggatatcggttttccaactgcctatgtccgcctgaataaactggcactggggcaagcgctcacgcgcctgcgctaacatggcggttgaactatcaaggccgataacctgcgcctgcggccaggcatcgtaaagcagttcggtgctgtttccggggccacagcccagatcggtgacaaaccggacatcttcaaccttaattctcgccagtaattcatgggcgggccgtgtcctttccgcctcaaatttacgatacaacgccggatcccagtcttgcatagtgcgtctcctcttgatggctaccgattcacagaagatgagacgcgtaaataccgataaagtgcccagccggacagcaaaatgcgtggaaaaacacggcaggccgaaagaagagagtcagcggtttaaaagcagatgagcccgaacagactggcgggaataagatcgggcgcagcctgcgcccggcagaatcagttctttttcacaaactcagatttgagcttcatcgggccaaatccatcaatcttgcaatcaatgttgtgatcgccttcgaccaggcggatgctcttgacgcgggtaccaatcttgagcacagaagagctgcctttgaccttcagatccttaaccaccgtcacgctatcgccatcggcaagtaaattgccgttggcatcacgaacgaccctatcctggccgctgtcgtcaccgtcagcctgcgtccagatatgaccgcacgacgggcagttaagattttcagcatcttgccaggtgtaatcagcatggcaaacggggcaagcaggtaacgacataacggctccagaaaataaaggcggcacgacataaagggccgccatcatatatccttacagttgctaagggtagaattaaaacagcgatccctggcgcgccttgctgaccgcctcacccagttgccacaccgtcatcgcgtaatgtgtgctgttgttgtaacgcgtgatggcgtagaagttaggcagaccgtaccagtactggtagctggtgcctaaatccagtctgagcagactgacctcgtcatgcccatccagcgatccctgtggagaaagtcctgatgcagccagcatgctgacgctgtaacgggttttaaaaccgttatcaagcatgggcgcctgtccactggccgggacggcaacattttcacctggacgccagccgttctgctggaaatagtgcgcgacactgcctatcgcatcgacgggatcccacaagttgatatggccatcaccgttaaaatccaccgcataggatttataggacgacggcataaactgaccgtagcccatcgcgcccgcaaaggagcctttgagatcgagcggatcgtctttctcatcacgcgccatcagcaggaaggtttccagctcgccgctgaagtaagcagaacggcgtggataatcaaatgagagcgttgccagcgcatccagaatacgggttttccccatgatacggccccagcgcgtttcgacgccgataatgccgacaataatctcgggtggaacaccgtaaacctgctgagcgcgctgtagcgcatcctgatattggttccaaaaggccacgccattttgcacgttatccggcgtaataaatttattgcgataacgtatccaggcaccgttaggcccacttggcggtgtatacgaaggcgcctgacgatccatcaagcgcaagacatagtccagtcgctttgcctggccaataatggcatgcagttgctggcgattgaagccatgcttcgccaccattttatcaatgaactgttctgcgacaggattactggcgaaatcgccaaacatcggttggacggcatgggacggctccagcaaaaaaccgcctttaggcgcaacaagctcagcgggcggctgcgaagagtgtggcttactgctacaggcggcaagcaggacaaaaagcggaaggaaagcaagcttaaaacgcatcagatatccatataacaggccagaccagggattctaatgttaatcgttcaggacgaatacatacaaacgagatcgtaaaaaaaacgcatttttaacgatctgtccggctgtttttgtgaaaggcctcgatgacgttaactctggtcaaaaaaaacattcagtcggcggccgggctttgctaagttcaatacccgctgcggtaacccggatgatgcagacgccgtaaaatggtaatatttctgcatggtctgtacagcacgatagcagctgtatatctccctcgttaaaccccagcgtcaaccgtgacgggaaaaggaagcgtcaaccttgagtaagaatgagatgaacaaagcagcgcacatggacttgagtacccacaccccaatgatgcagcaatacttacgcctcaaggctgagcaccctgacattctgctgttttatcgcatgggtgatttctatgaactattttatgacgatgccaaacgcgcctctcagctgttagacatttccttgaccaaacgcggtgcctcggcgggtgaaccgatccccatggccggtgtgccgcatcacgccgttgaaaactatttggcccgactggtgcagttaggtgaatcggtcgccatttgtgagcaaatcggcgaccctgcgctgagtaaaggtccggttgagcgcaaagtcgtgcgtattgttacccccggcaccatcagtgatgaagccctgttgcaggaacggcaagacaacctgctggccgcaattgtccagggtgcgcgcggctatggttatgccacgctggatatcagttcagggcgctttcgcctgagtgaacccgccgatctggaaaccatggcagcggaactgcagcggactaatcctgccgagctgctttatccggaagacttttctgagatgtcgcttatcgatcagcgtcgtggtttacgtcgccgtccactgtgggaatttgaaatcgatacagcgcgccagcagctcaacatgcaatttggcacgcgggatttaaacggttttggcgttgagcaggcccatttggggctgcgcgcggcgggttgcctgctgcagtacgttaaagatacccagcgcaccagcctgccccatattcgctccctcagcatggagcgtcagcaggacagcatcattatggatgcagccacgcgccgtaatcttgaaattacgcaaaaccttgcgggcggtacagaaaacaccctggctgccgtgctggataaaaccgtcacgccgatgggcagccggatgttaaagcgctggctgcatatgcccttacgtgacagcagcaccatcgcgaagcggcaggaatcgattgctgaactgcagcctctgagcgaatctctacaacctgtattacgtcaggtaggtgacttagagcgtatcctggcacgcctggcgctgcgtaccgcacgtccgcgcgatctggcgcgcatgcgtcatgcttttcaacagctaccggcgctgaatgacctgctggccaacgtcgacgcggcgcagctgaaaaacctgcgcgcgcagatgggcgactttagcgaactccgcaccctgctggagcagtccgtggtcgaatccccgccggttctgataagagacggtggcgtgattgcgccgggttataacgccgagcttgatgagtggcgggcgctggccgatggcgcgacggattacctggatcggctggaggtgcgcgagcgtgaaaaactcggtctggacagtttaaaagtgggctttaatggcgtgcatggctattacattcaagtcagtcgtggtcaaagccatcaggtacctatccactatgtgcgccgtcagaccttaaaaaacgccgaacgctacatcattcctgagctgaaagagtacgaagataaagtcctcacctcaaaaggcaaagcgctggcgctggagaaaagcctgtatgaaggcctgtttgatcagttgctgccgcaccttgaagcactgcagttaagtgccgctgcgctggcggaactggatgtcttaagtaatctggccgaacgcgcctggacgcttaactactgtcgcccaacgctgcaggataaacccggcattaaaatcaccgctggtcgtcatccggtggtagagcaggtgcttaaagagccctttattgccaacccgctctccctggccccccagcgccgaatgctgatcattactggcccgaacatgggcggtaaaagtacttatatgcgtcaggcggcattgattgccctgatggcgtggatcggcagctttgtaccggctgaagacgttgtcatcggcccgctggatcgcatctttacccgcgttggcgcagcagatgacctggcatccggacgatcgacctttatggtggaaatgacagaaacggccaatatcctgcacaacgcgactgaaaacagcctggtactgatggatgaaatcggccgcggcacttcgacatacgatgggttatctctggcctgggcttgtgcagagagtctggctaatcgcattaaagccatgacgttgtttgcaacccattactttgagctaaccaccttgcctgaaaagcttgaaggcgtcgtgaatgtccatctggatgcggttgaacacggggaaactatcgcattcatgcacagcgtgcaggatggcgcggccagcaaaagctacggattggcggttgcagcgctggccggtgtacctaaagacgtcatcaaacgtgcacgtaataagctgaaagagctggaaacggtatcgaatcagtcagccacctcaaatatcgacggttcgcaactgcctctgctggtggaagaaacctcccccgccatggaagcgcttgaagccctggacccggatacactgacgccacgtcaggctctggactggatttatcgccttaagtcgctggtctgatcccctccgccctttcaccggggcggataaaacgcccccgcagtgaatgatgtttttgccagcatgtggcctgcatgctggttcatggtttagcctgttgttaccggcgaaagcggtgtcataatgctgtcgtgtccctgtcgtgcggcggtcgtgttcctgaccgcacgtcccggcgatgcttcttaccgattgttcactctttcggagactgcactatgcctaacctgaataaagtcagagagtatcgtcttgcccgcgcctggtcacaggaacaactggccgaaatggccggactcagcacccgaaccgtgcagcgtattgaaaacggtgagcaacccagcctggaaacgctaagcgcgttggccgccgtctttgaaatcaaggtcaccgacctgacggcagaaacccacgtagaaagtagccaggcgctagatgatcacatttctgatgcccgcctgcagctggcactcgaaactcagttctttcgttcactgctcaccgcggtcgtggtgtgcctcatgctgtattgcctcaaccgcgtcaccgaacccggtagtaactggtcgctctgggtcgccgtcatctggggaagcgtgctcgtgataagagcgctgcgcctgtttgttttcaaacagtggatcaaccgctggcagcaaaagcgcctgcaaaaaatattacgtaaacaggactagcccgaccggtcagccccgttctgacaacctggaggaacacccatgcactggtacagtcagcaggcatataacatccgtctggaatggggcattcccgccgttgagcatctcgccggagaagtggatgccgtggtgattattgatgtgatgtccttttctacctgcgtcagcctggcggttgaaaatggcgctcgcgtttatccctatccctggaaagatcactcagttacccactatgcgctgtcggtgggggcaatcgcggcaaacagtgaccgacgattcagtggagaaggctacagcctgtcgccccataccttgctgcatgtccgcaaaggtgaaaagctggtgcttccctcccctaatggctccgcagcctgcttcagggcaagagaatggggcgtgccgatctttacgggctgcttcaggaatctgtccgcaacggcggctgcctgccgcctgttcgaacgtcttctgattgtgccttgtggtgaacgctggccggatggcagccttcgtccctgcattgaagattatgttgcagctggcggcatcattgccgcgctgggccgtagcggactgtcacctgaggcggaaaccgccgtcgcggcatggcaatatcatcaggcaactaacgttgcatcgctgcacgactgttcatcggcgaagaagttgattcagagaggttttgtggacgatgtgacactttgcctggcgctggataccgccacacaggcatgttatctcacgggcgatttttttgagagcagaccgttctcatcttgatggaacggagagaacaggtaaaaaaaaagcgatggggttagccatcgctttctgttgacgtgcaaagttctgtttactcacggaacaatgcttcaatgctgaggccctgaccttgcaggatttcacgcagacggcgtaaaccttcaacctgaatctggcgcacacgctcgcgagttaaaccgatttcacggccaacatcttcaagcgttgccgcttcatagcctaacaggccgaaacgacgagccaacacttcgcgctgcttggcattcagttcgaacagccatttaacgatactttgcttcatatcgtcgtcctgagtggtatcttctggtccgttgtctttttcatcggccaggatatccaacagcgctttctcggaatcaccacctaatggtgtatcaaccgaggtaatacgttcattgagacgcaacatacggctgacgtcatcaacgggcttatccagttgttctgcaatctcttccgcactcggctcatggtcgagcttatgagaaagttcacgcgcagtacgcagataaacgttcaattctttaacaatgtgaattggcagacgaattgtacgggtctggttcatgattgcccgttcaatggtctgacgaatccaccaggtggcatacgttgagaagcggaatccgcgttccggatcaaacttctcaacggcgcgaatcaggccgaggttaccttcttcaatcaggtccagcagagccagaccgcgattgctgtaacgtcgggcaatcttcaccaccaggcgtaagttactttcgatcatgcggcgacgagaaggaatatcacctcgtaatgcgcggcgagcaaagagaacttcttcctcagccgtcagcaatggagaatagccaatctccccaagatagagttgagtagcatcgagtacacgttgcgtcgcaccctgcgccagcaactcttcttcagctacttcattgtcgccagattcattttcgacgagagccttctcatcaaaaatttctgctccattctcttcgaattccgcgttctcatgtaactcgtttactttcagcgtattctggctcattaagtggctcctacccgtgattccagggcagattcctgaggactctgccggattatcgctgcggcaaataacgcaacgggtttacggatttccccttgtaacgaatttcaaagtgtaatctaactgaactggttccggtgctacccatggtagcgattttttgcccagccttaacttcctgttgttcccggaccagcattgtatcgttatgggcgtaggcactcaggtaatcatcattatgtttgatgatgattaaattaccgtaaccgcgaagcgcgttgcctgcgtacaccacccttcctgaagcagtggccacgattggctgtccgcgcgaacctgagatatcgatccctttattgccaccttctgcggcagagaagttatcgatgatcttcccttcggtcggccaacgccagcttcctacaggtgtagagctgtcagttgtgctgctaaccgtcggcggtgcggtaacggctggagctgtcgtcgatgcaacatttgctcccttcgatggcaacaatttactgccattcgagttacccgaatcatcagaatacgtaataacaggctgctgtgcaacaggggcctgttttatttgtggtgcgctgacgacaccgctctgcgttgcatctgccgcggtgatggcattgccgccggtaatcggctggcctgagccattgtcaacctgcaacgtctgcccaacattcaggctgtaaggcgcctggacgttgttacgctgcgccaaatcgcggaagtcgtttccggtaatccaggcaatatagaacagcgtatcgccacgttttacggtgtaggtctgaccagaatagctacctttaggaatattctgataactcctgttgtacacaattcgtccgttttcggtttgcacattactgttactggcgcccacattactattactggtactaatgattccggaattgttctgtggcaacggcgtgcttcgacttaacattccgccctgcggtggcactgagggcacaccgccagccgctggcgcagtgccagaactcgccatattactattatcattaacgctgttactgtccccgatattgcttatcggagcctgggtattatcgcctgaactacagcctgccagccaaaaactcaccagtgaaagcgccgccaaacggcgtaactgaaaaattgtgcttcccgtgctcattaatcccccgtggtggcaacctttaaaaaactgacttattcgtctcaccagcacaatacactgtgcggcacgttatacgctggattttcgttgaatgaaccggatagtagcaatatcaactacctgattccatgaaacagttatgaagaaatgctaacaagacaatcaggccagatcgccctgaactaatgggacgaaacgaaccggctcaatggtttcttctgtaatctcactaccacggcggcgcagacgctttaagacctgctgctcctcgccgacgggcagcaccataatgccgccctctgccagctgtgctatcagcgcaatcggaatctcaggcggcgcagcagtgacaataatcgcatcaaaaggcccacgagccggccagccctgccagccatcaccgtgtcgggtggacacattatgcaaatcaagctgtttcagacgacgtttggcctgccactgaaggcctttgatgcgttctaccgagtaaacatgttcgaccagatgagcgaggatggcggtctgataaccggagccggtgccaatctccagcacgcgtgagcgctcgttgagttccagcaacgcggtcatacgcgcgaccatatagggctgagagatggtttgcccggacccaatcggcagcgccatattgtcccaggctttatgttcgaaggcttcatcaataaagcgttcgcgcggtacatcggcaatcgcctttaacaggtgttcatcttcaatgccctgtcgacgcagctgtgacagcaatgtctcgatacgccgactcaccatgccagatttacctcagctttatcgagccaactgctgagaacgtcctgcgcattgtgagcagtaagatcaacatggagagcggtcactgacacatagccttcatccaccgcggcaaagtccgtgtcggggccggcatccagtttttcaccgggcgggccaatccagtagaggggattaccgcgtggatcggtctgtgcaatcacctgatcggcgggatgacggctgccgcagcgcgtcacgcgaatcccttttatttccgccaacggcaggtcaggcacgttgatattcagtatacgtccggtgcgcaagggctgttgcgtcagcgctttaagaatcgcacaggttaccgccgcggcggtggcgtagtgctgatgaccatgtagcgataccgccacggcaggtaatccaagatgacggccttccattgcggccgccaccgtaccggaatagatgacatcatcccccagattggggccagcattaatgcccgacaccacaatgtctggccggggttgcatcagcgcgtttacacccaaatagacacaatcggtgggcgtgcccatctgcaccgcgatatccccattttcatgggtaaaagtgcgcaatggggtttccagcgtcaatgagttagaggcaccgctgcgattgcgatccggtgccacgacctgcacctcggcaaattgacgcaaagcctttgccagcgtctgaataccaggcgcatggataccatcatcgttgctgagcaatatccgcatttaattctgaccttttctgttcaaccaggccgccgttatatggacctgttttgaggcatggcaacaagttaagagtggacagcgactgttgcattctagcggtgagcgagaggaagtggtaggcgaaaataaacgagtgggcaggaaaagggcaggtacttgccgatatcgaaacgattcagggcgacgacatgcacagatgaggcagccaacgggccgggaaaaaccaccagaagcaggccatgcggcttcccctgtggtgagggacaagggaagcagcggcttattcgtcaagcatttcaagagactcggtgctgtttaacagctctctgacgacactggtggcaaagctgcctgcgggcagccaaaattgcatctccagcgtggcatcatcctgccagcaccagcgcaggtcgcgtggcacaaccagcatggcacgccgtccggcatctacgcgctcgcgctcaagcagacctcgcagctcgccggcatcggccaggcactgctgctcaaacgccagcgcatcggcctgcgggccgggatcgccctgccccggtaacggggccgtaatacgaagcgcatgctgattcacccgcgcctgcagctcagccagctcttccggctgtgcgacgaaccaactgccacgaccggcaagttgcagagcatccccgttcatcacctgagtcagtccaccctgctgctgcaaacgcatgctggtgacctgattaaacaacgcactgcgcgccgcagaaagcatcaggccgcgcttgttgcgatcgcgaatctgaatctcgttgcgcgccagcctgaccgccgtcaccaggttgttgccattgcgaccaaagcgttgctcgccaaaatagttgggtacgccgctgtcgcgaaggcgcaccaggcgcgcgtctgtttcctcgcgatggctgacctggcgaatcaccagccggaaggcgtttcccgccagcgcgccaatgcgaagcttgcgtttatgacgcacgacctcaaggatttccacgccttccaacgcaaaacccgccagcacaggcatggcattgccgggaacgcgaaagcacagcgtctgttcggtgaccgcatgacgatctttcatacctgcatagctcagatcgcgaacgttcactttcataaatttcgccagcgcttcggcaacaaaacgggtgttagcaccgcttttgcggatacgcaccagcacatgttcaccgtcgccatcaggctgatagcccaaatcctccacgaccacgaaatcgtccgctgtcgctttgatcacgcccgtcgctgtaggcttgccataaaggtaatgcagcgtcatgccggttccgctttcagcagtagcgcgaccgcttcacaggcaatgccttcaccccggccggtaaaacccagtttctccgtggtggtagctttgacgttgacctggtccatatggcaacccagatcttcggcaatattaatgcgcatttgcggtacgtgcggcagcatcttaggtgcctgggcaatcagggtgacgtcgacattgccaatacagtagcctttggcctcaatacggcgccaggcttcccgcagcagtccgcgactgtccgcgcctttaaacgccggatcggtatccggaaacagcttaccaatgtcgcccatggccaccgcgcccaacagcgcatcggtgagggcatgcagcgctacatcgccatcagaatgggcgataaaaccatactcaaatgggattcgcacaccgccaatcaccagcggaccttctccaccgaaggcatgaacgtcaaaaccgtgaccgatacgcatcatgtgctctcctttgactgaatctgactaagataaaaagccgccagggctaagtcttccgggcgggtaactttgatgttatcgctacgacctgttaccagctcaggatggtagccacagtactccagcgcggaggcttcatcggtgatggtcgccccttcgttcagggctcgcgtcaggctggcggtaagtaaggcccggggaaagaactggggcgttaacgcgtgccacaggttgtcgcgatcgacagtgtgcgcaatcgccgccttaccgggttccccgcgtttcatggtgtcacagaccggggcagccagaatgccgcccgttttgctggtctcccgtaaccgcagcaggcgctgtaagtcatcaggatgcaggcaaggtcgcgcagcatcatggaccagcacccagccggcaccttgcgcagcctgaaggccagccagtaccgattcagcacgcgtatcgcccccggtcacgcgaatcacgcgcggatcgcttgccagaggcaaagtggcaaaatgccgatcgtcagggcttaaggcgacaataacctgcatgacagcaggatgggaaaacaggcgggcaatgctgtgttccagaagtgtgtgctgaccaatcgtcagatactgtttcggacaggttgcctgcatgcggctgccgataccggcagcgggcacaacggcaatcacatccgcagagtgggactgattgttcatgttttatcgttgttggttttgcgcagcttgttgcgcgttgcgtttgttctggtcaggtaccagacgatagaaggtttcacccggcttaatcatgcctaattcgctgcgtgcgcgttcctcaatcgcttcagagccgccattgagatcgtcaatttcagcaaagagttgatcgttacgcattttcaatttggcgttattcgccttttgtaccgcaacgtcgtcgtcgacgcgcgaaaagtcatggatgccattcttacccagccacaatgaatattgcagccaacctaacagcaccaacagcagtaacgtcagttttcccatcccgccccctaaaaacggcccaatcatcccataactttactcaggactccacactggcagtaaaaatgccgtgtaatgccgttcacgcaggcaaaaaagggaagaaaagatcgggcgcaacgcaggaaaacttttgtaacctgctgctgcgtttagacatcagtctggctaccagcgagacagaaacaggaacagtaaccagaactgacaagcgacggcaacgacgcatatcagagaggtccagagcaactgcccacgcagccatgtattcaataccatgcctgtcaggacagaaaccggaaacagcgccaggaaaaatggccaggtgtagagaaagaaaaacagggtgcttgagccgtacaacaggaaaggtatggcaagcgcacaccagtaacatacaaagccaatgacgccgcccggaaggacagagcgaggctcatccggtgtgccgtggtctttgcgtgccagcatgggagtaatattctgcataaatatcctgtcaacgcgaaggcggcaaaacgataggcgctttgccgctgtctgttcaggaactgataatatcgcgctgacgcagcagatctaacaattgggccgtcagttttgtaaccaattgttccccattaagcgagatttctggctggtccggcgcttcataaacgctatctataccggtgaaattttgtagttcacctgcccgggcctttttgtataaccctttaggatctcgcgcttcacagaccgccagcggcgtatcaacgtaaacctcgataaaccggccgctgtccagcagatcgcgcaccatttggcgctcggcacgatgaggcgagataaacgcggtaagaaccactaaacccgcatccaccatcagtttagccacctcaccaacacggcggatattctctttgcggtgctcatcgctaaagcccaggtcgcgacacagtccgtgacgaacattatccccgtccagcagataggtgctgacaccgaggcggtgaagcgcctgttccagcgcccccgctacggtcgatttccctgaccccgacaggccggtaaaccacagcaccacgccctgatggccgtgctgctgttcacgcgcctggcgcgtcaccggatggtcatgccacacgacgttttcatcatgctgggccattactgaccgcccaaaagatcgcgcgcattccagtgtgggaagtggcgacgcaccagcgcattaagttcaagttcgaacgcgctgaattcgccgttttgctgcggccgatcgctcagtggctcattgatcagcccggcacccacggtaacgttactgaggcgatcgataatgatcatgccgccggtcacggggttttgctgatagctgtcgagcaccagcggttcatcaaacgtaaactcagccagaccaatcccgttcagtggcaggctgtccacctggcgtttctccagtgaattaatctcaacctgatgaatgaccttttctactcgcccacgggctttcttgccggcaattttaacatcgtagctctgaccggcctgaagcggctgctcagccatccagacgacatccactgtggcggactgaacggcacgcagctcagcgctggcgtccactaacagatcgccacgactgatatcaatttcgtcgttcaggacaagagtaatggcttctccggcaccggcttcctgcagatcgccgtcaaaggttacgatgcgggcgatggtggattcgacgccagaaggcagcactttaacctgttgccccactttcaccacaccggatgccagcgtaccggcataaccccggaaatcgagattagggcgattcacatactgcaccgggaagcgcatcggttggttagccaccaccgcgtttaactccacggtttccagcacatcaagcaacgtcggaccgctgtaccatggcatgctctggctctgcgacgcgacgttttcgccttccagcgccgacatcggcacaaagcgaatatccaggtcttcaggcaattgcccggcaaagtcgaggtaatcctgcttgatctgctcatacacagcctgctgataatccaccaggtccattttattgattgccacgaccaggtgtttaatccccagcagcgtcgaaataaaactgtgtcgacgcgtctgatccagcacgcctttacgggcatcaattaacaggatcgccagatcacaggtcgatgcgcccgtggccatatttcgggtgtactgctcgtgccccggcgtgtcggcaataatgaacttacgcttttcggtagagaaatagcggtaagccacatcaatggtaatgccctgctcgcgctcggcctgtaaaccatcgaccagcagtgccagatccagtttctcgccctgcgtaccatggcgtttgctgtcgctctgtaacgaagacagctgatcttcataaatctggcgggtgtcatgcagcaggcggccaatcagcgtacttttgccgtcgtccacgctgccgcaggtcagaaaacgcagcaggcttttatgttgttgtgcggtcagccaggcttcaacgccgccctgttcggcaatctgttgtgcaattacggtattcatctggcgtctccttagaaataaccctgacgttttttcagttccatcgaaccggactgatcgcggtcaatcacacggccctgacgctcgctggtggtagaaaccagcatctcttcaataatctcaggcaaggtttgcgcttcagattccaccgcgccagtcagcggccagcacccaagggtacggaaacggaccatacgctgtttaatgacttcacctggctggaggttgatacgatcgtcatcgatcatcatcagcatgccatcacgttccagcacggggcgcggcgcagcaagatagagcggcacaatctcaatgttttccaggaagatgtactgccagatatccagctcggtccagttagacagggggaagacgcggatgctctcgcccttgttaatctgaccgttatagttgtgccacaactccggacgctggttttttgggtcccagcggtgaaaacggtcacggaaagagtaaatacgctctttagcacgtgacttctcttcgtcacgacgtgcgccgccaaaagccgcatcaaaaccgtacttattcagcgcctgcttcaggccttcggttttcatgatgtcagtgtgtttggcactgccgtgcacaaagggattaatccccatcgccacgccttccgggttgcgatgcaccagcagttcggcgcccatggctttcaccgtgcgatcgcggaactcgtacatttcacgaaacttccagccggtatcgacatgcagtaacgggaacggcagcgtgcccgggtagaaggctttacgcgccagatgcagcatgactgaagaatccttgccgatggaatacatcatgaccggattgccgaattcggctgccacttcgcggataatatggatactctccgcctccagttgacgcagatgagtgagtcgtttttggtccatcgtttttcctctcaagccagattgacaacggcggactcgcgagccccctgctgtgccgaatgctgaaaccaggcaagttgcccatgtaaattaaccacttccccaatcaccaacagggccggggaaggcgctgacgctgccagcgtctcaagatgttcaagcgtgccggtcaacacctgttggtcagaccgggtaccgcgaccaatcaccgcgaccggcgttgacgcggcgcgcccatgaagaatgagctgtttgctgatgtgagccgccttcacggcgcccatataaatcgccagcgtctgacgcgcacgcgccagggatggccagtcaatatcatcgctatccggacgacagtgaccggtaataaacagcacgctctgcgcatagtcacggtgggtcagtggaataccggcgtacgcggtggcaccggccgcagccgtgacacctggcacaacctgaaacggaatacccgcctgctgcgccgcctgcagctcctcgccaccgcggccaaaaataaagggatcaccgcctttcaggcgcaccacgcgtttgcctttttgggccagttgcaccatcaactggttaatctcgtcctgcggcagcagatgcgcgctggcacgtttgcccacgcagatacggtcggcatcgcgccgcaccagatcgaggacctcctcactgaccaaatggtcgtagagcaccacgtcagccagttgcataacctgtagaccgcgcagcgtcagcaggccgctgtcgccaggccccgcacccaccagaataatttcaccctgtcggggtggctgatcgcccagttcgctgtcgagcgtctgtttcgcggcctcaacgtcacctgttgccatctgactggcaaaacggccgttaaatattctttcccagtaacgacggcggtcagacatacggctgaaacgtgctttgaccttgtcacgccactgccccgccagttcggccatttggcccagatgagacggcaacagcgtttcgagtttctcgcggagcatgcgggcaagaaccggcgcggttccgctggaggagatagccacgaccagtggagaacgatcaacgatagaagggaagataaagctgcatttaggctgatcatccaccacattgaccagcttgtgacgggcattcgcctcgtcgtagacctgcgcattcagcgcattgtcatcggtggcggcaataaccagaaagaccttgtcgagctgagcgggttcaaaggaggttgccagccattcaagctgttgctcatccagtaaagcctgcagctccgggcagagttcgcgtgaggcgatttgaatgcgcgcgccagcacgacgcagcagttcgatcttgcgcgccgcgatatctccaccgccaacgaccagtacgggtcggcctgcgagatcggcaaaaagaggcaaataatccacgttaaccctagtgttgttacgatgcgttatcgcgactatacgttccctggtttattgagatgaaattacgaattggaatgagttgttactgaatggaataacgcccggcaaaagctcagaacaaaatgtgcttagcaaatgatcttatgggcctttccggacgattcaaattgtgtaatcaccgtcacagtttcatactatgggtgaaaaaatatgaccgtccttatagggaatgagccacaaggaacccgacatgtctgcctttcttcgcctggcgacgctgcttgttggcagcgttattttcagcgctcaggccgtgaccgacgtcaccggacactttgctgaacaacaggttcgacacatttctacttactttcccggtcgcatgagcgggagtccggctgagttgatggcggccgactatctgcaacagcagttcaccgaactcggttttgcaaccaatacccgacagtttaataccggctacagctggcatgaaaatgacggcacgtcgcgctggcataaaatcacggccacctcagtcatcgccgcgcgtgaaggcagcgcacctcaggagattctggttgttgccagcctggatacctggattccactcagccgcagcgaaacgacgcgcagcctgggcggattgcgtttgcagggcgttgatgacaacgcatccgggcttggcgtaatgctggaactggcaaaacagctcagccatcagccacttcattacggcgtgcgctttgtcgcgctcagcgccagtgagtcacagctgcacggcatggacgactacgtggcgcgcatgagtgagaaagagaaaaagaatacgctgctggttatcgatctcaacagcctgattacgggcgatcatctctatttcaacagcggcatcaacacgccgcgtgccgtgcgtaaacagaccagcgaacgcgccctgctgctggcgcgccgctatggcatttctgccgccagccgtcagatgcaagaaaaggattttcagggcatcaatcctttcgatgcggcagggtttcccctgctggatgtcaccgcgcgaaactggaacctgggcagcaaggatggcgaacagcagcgcagccgttcccggcattttcccgacggcaccacctggcatcagaccgatcgcgacaatctcgactttttagaccactggctacccggccgcattggcctgcgtacccatgacagcgtgaaagtcctgctgccgttactgagtgagctaaccaatcccaaagtgtgaggacagacaatgtatgtggtgtacctgaactattttcggccgatcgaggaagtagaagccctgctggcaccgcacattacgtggctggatcgctattttaacagcggcgtatttattgctgcgggacgtaaagatccccgcacgggcggcatgataatggtgaaagatattgcgcgcacacggctggatgcgattctggcggaagacccttttatcgctgttgcccattatgaggttacaaaggtcaacgtgacgcgcgcagccgatgcgcttgcggtgctgaaagacctgtagcccttttaccctgagccgacagcccgggtttaaccccattgctcgtcggttcaggtaaagtcggacagcttctgacctgcattgatcaaggttttcagcaacatttgacgccgttcttcgggtgtatcccgactgaccataaaacagatggctgccaccgccagatcgttacgggcacgaatcggcgcagccatacagcaggtaaaactctctgacagcccttccgtcatggagtagccaagatgtcccgcccgatgaatgtcggccagaaaatcctgcttatttagcacctttccgttcgccagccgataatcctcttccgggatcagggacagaattgcctcatcactccagttgctcagcagcaagcgaccggtggccgtccagggaataggaattttaacgccaatatccgaggttatcttgaacggatgtgcattgctctctgacagcaccaccgtatatttattgccttccagcatacacagctgcacggtttcaccatgctcggcaaccatctcgatcattaactgatgcgcccgacgaatcaggggattgtgcgcgatgtaatccgcaccgtagtagtgcatttcacgcccaaaatagatactgccttccgaatcgatttcgaccagtcccgcttcactcaacagattaaccagttcatacacgcttgagcggggcgcgcctgtcgcctcgatcagttcacgcatcgccatgggctgacgggcaacgtgtagctgacgaaaaatagcgatcacacggtccacgccgcgcgctctggcgggtttatcttcctgcatacccttcttctcctaccgggatcgtcacgttgaggttaattgaatacatcatacacagcccactttgttttacctacgggcgtgcacgataactgtcgttttcttttttcgcttcatgctatttatcggggcactaaaagagagcatgccataattataaaaagagatcctgatcactatttatttaaaacatttatcattaataacaaatattcgtgaagccgattgtaaagcatcaaaataatccccgagcagcctattgcaaaaaaaatagcattgtgcaaatctcaacctatccggtattgcagatttaattccggtataccagacaagttgcagtgatgatgttaagggcataagcatgacaattaagcgctatggcacagaaggcggtgtcggtaccggaggacagaaactgcctttcgctcgcgccgtagaagccgacggctggctgtatatctccgggcagacaccgatgacaggcggtgaagtggtcgaaggcggcatcattgagcagacgcgcctggcctttgaaaactgtctgaccattatgcgggaagcgggatatcagattcaggacgtggtgcatgtgacggcggtgctgaccgatgcccgctactttagctcatttaataaagtctttagtgagctattccatgaaaatccgccagcacgcatttgcagcgtgcaagacctggtggtggattgcaaagtcgaagtcgatatgaggtgttttaattcaggccggaaataaccttctcttcatgtataacaggtgaaaacgcattcacccgtcagaataaattgataattaaaaaaagtcccatccacattatttattgatgttggtgataccacacttttatttgagataataaacatgaacacgacttcacaccaaaaggtattgaccctgctgtttccggccttactgacggttgccgctcttgccggttgtacgccgacagaaaagaaaacggaagccggtgccgcgccgcagtctacgctgcaaaccgtactgcagcgtggcacgttgcgggtcggtgactgcctgagctttgcgcccttcggcttttacgataaagccggtaatcccgacggctacgatgtggatctggcaaaatccttagcgaaatcgatgggcgtaaaactggaagtggttaacaccaccagcgcgaaccgtattcctaatctgcaaaccaataaagtggatgtcgtgttctgtaatttcacgcgtaacctggaacgcgccaaagagattggtttcactcagccttacgtggtggccagcgaagcgatgttggtccgcaaagtaagcgggatcaagtcggcccacgatatggcaggaaaaaccattgctaccgtgaaaggctcaaccaacggtgacgaagtgcgcagcatggggatcgatgtgaagatccaggaatacgattcctctcaggcggcgatcctggccgttaagcaggggcaggccgatgccatgattgaagataataacttccttgcctaccaggccaaactcgaccccacgcttgaggtcaccaacgaagcgctggttccgctggaatacaacgcgttcggtgtgaagcaaggggatcaggtgtggacgaactatctcaacgaattcctgtttgaaataaacgcgtcaggtgagaacgctcagctctaccagaaatggtttggcagtaagcctcgctatccgctgaacccgcagttctgacaggcgaggacgcaggtcatgcctgcgtcctgttgaggaggctttctatgagctatcaatggctgacactctggcagtatgctgacacctttctcgccgccacctggttaacgcttcaggtgacgctgctggcttttatgctggcgctggtgctgggattgctggccgcactggcaaaatctgcgccttttgcccccctgcgctggctaagccacggctacgttgaatttattcgtaatactcccgtgctgctgcaaatttttattgtgttcttcggacttccctcactgggcatcaccatgagtgcctttacagcgggcgtactggcgctggggattaacgtcggtgcctatctggccgaaatctttcgcgccggtattcagtcggtgccaaaaggtcagctggaagccgcctggattcttggcatcagtcgccgccagcggtttttaaacgtggtgatgccgcaggccgcgcgcgccgtctggcctgccattatcaacaatctgattcagttgctgttgggcacctcactgctgtcagccatcgcgctgccggagctgacgggaaccgccaccgtcatcaatgcgcgtacgctgctctacatccagacatttagcgtggtggcgttggtctatctgtttctcagcaacctgttttcctggctgggcaacgtcgtggaacgccgtctgtttatgccgccgctggtggtatcggtcaaacggcccctctggtcgcaggcgaaaaaaatgtggtcccacacggttaaacgggagcctgcccaatgagcgaactgattctcagcagcctgccgctgttatggcgtggtctggttattacgttattgctgtcggtggccgccattgtgggcagtaccctgcttggcctgttggctgccattttgcgcaccagccgcctgcctgtcgcccgacaaattgccgtgatctataccgagctgtttcgcggcacgcccgtacttattacgctcatgtttatctactttggcgtggcctatttcggctatgacatcaacctgtttgccgcgggcattttgggattgagcatttatcagggtgcctacattgccgagatttttcgtggcggtattgaagccgtcccaaaaggccagtgggaagtctcgtggatacttgggctctccaggcggcagacctttaccagcgtgattctgccgcaaacccgcggcatcgttttacccccgctggtcggtcagtacctgtcgctgattaaagatacctctattgtcagcatgataggcatgtcagagctgatgcatcagggtcaggcgatcgtcgaccgtatcggacaacccgtcgtggtttatggcctggtcgccctgctctatttcgttatctgttttccgctttcccgctgggtccagcaccagcaaaccaggaacccgttatcatgaaaaacgcagccattaccctgagtcggattagcaagtcatttggcgcgacgcaagtcctgaaagagatcagccttgatgtctcgcccggagaggtactggtgctgatcggcgcatccggttccggtaaaagtaccgtattacggatcatgagcggtctggaaaaggccgacggcggagagatttgggttaacggcgttccgctgcatgaccaaaaacgtaatcgtgatatttgtggtcaggtgggaatggtgtttcagcagttcaacctgtttccccacaagacggcgctcggtaatgtcaccctggcactgataaaagcgcagaagctgtcaacggcagaggcaaacgcacgcggaatggcgacgctggaacgcgtcggactggctgaccgcgccgatcactatccttctcagctctccggtggtcagcaacaacgtgtggccatcgcgcgtgcgctggcggtacagcccaaaatcatgttctttgatgaagccacatccgctctcgatcccgaattagttggcgaagtgatggaggtgatgcgcgggctggcgcgtgagggcatgaccatggtggtggtgacgcacgaaatggggtttgcccgcaaaacagccgatcgcgttgtttttatggatcagggtgtgattgctgagcaaggcacgccggacgacatttttgtccatccgcagaatccgcgcactcagcaatttctgtcacgcgttcttgagcactaaggagccgctatgtctttacgtttcccgctagtcgcagacgcgaagctggatcgcgcgcagccctcgccccgttttaaatcggttgctggcgcgggcgatgccccgctcgaggccggcaccgccgtgttgagcagcgggtcggtgttttcgcccgtcatggtgatgaaacagtccgcactggacaataacctgcagcagttggcgcaattttgtcaggagaaaggcgtcatgctggccgcccatggcaaaacctcaatggcaccagcggtcttacgccgggccgtgacacagggcggtgcctgggggatcagcgcagcgacgcccgctcaggtgcgcgccctgcgtcattttggtatccgtaacgtgtttctggctaacgaattagtcgatcctgccgggattcgctggattggcgagtggcagcgccagcatcccgatcatggctttctctgctacgttgactcactggcgggcatcacattgctggagcaaaacctgggcgatacggcgattgccgtagtgattgaagtgtccatccccggcggcagaacgggctgcagaaccgccgaggaggcgctggccattgctgaacgcgtcgcccaaagccgccatcttcatcttgtcggtgtggcaggctatgaaggtgcgctcggtgccgcgcgggacgccgctggcgtggcattagttcggcactactgccatgtgatgctggagtgcgccagaaggctggctgaacgccagttgttccacagcgatacgattctgctcagcgccggtggtggagcatggtttgatgtggtgaccgaatgctttacccaggccgtcctgccgctgccggttcagcccttaattcgctcgggtgcctacatggcacacgatagcgggctttatgcgcgtattgcgccttttgcccagcccggcgctgaccaccattttgcggcggcgctggagatctggggacgcgttctttcccgtcctgaacccggtctggcgctgctggatttcggcagacgagatgtccctttcgatcaggatttaccgatccccttgtggattcgccaggctgatggcaccgcgccgcgatccggcacccatttgcacatcagtgaggttaacgatcaacatgcctatttacgcttacccaatgatgagccgctgatgccaggcgactgggtgggatgcggcatttctcatccgtgcacggcgtttgataaatggcgttatcttcccttggtggatgatgaataccgggtggtggacagtgtagagacggcgttctgactgccacggacacctgtggctattgcacgtttgtccctggggttttgacgtcagcggtggccccatcgcaaaacgggcgacccataaggatcgcccgttgataccgctacgccgcgtgcgttagccttcgtgcaggccgcactcacgtttcaggccaaagaagcgcgtttcttcttctgccatgcctggctcccacttgcgcgtggtgtgcgtatcgcctaccgacaaataaccctcatcccacagcggatggtatttcaggttgtgggtttgcagatactgatgaatctgacggttgtcccagtcaataatcggcagcactttaaacacgccgcgctgcacgcccagtaccggcaggctggcacggctgcctgactgatcgcggcgcaggcccgcaaaccaggtttgtgcgcccagcgtttccagcgcccggttcatcggttcaactttgttgatctggttgtactgctcaatgccatcaaccccttgctcccacagcttaccgtagcgagcctcttgccacgcgggcgaggtttctgcccggaacacctgcagattaagcttaagctggtcggccagctcatcaataaagcggtaggtttctggaaacagatagccggtatcggtgaggatgaccggaatatcgggttgcacgcgcgtcaccagatgcagcgataccgcagcctgaatgccaaagctggaggagagcacataggcacccggcaggttttccagcgcccaactcacccgctcttctgcggtggctttttccagttgagcgtttgtcgcggccagcgccatcgcgcgctggactttcgacatttcattcagtgctgccagatcgatactcattttgcctcctgccagaagtcgcgcgcagggtccagtaccggcgtaacgatgcccgcacggataacaaagtcaccaaagccttctgcggcctcgcgctcttttgcccagcgacctaccagctcatcaagtgtggcgagaatgtcactttctgtaatattttcgcgatacatacgtggaatgcgcgttccaatacggttacccccgatgtgcaggttgtaacgacccggcgctttccccaccaggcccacttctgccagcatcgcacgcccacaaccgttcggacaaccggtaacgcgtaacactatgtgctcttcgcctacgccatggttgtgcatgatctcttcgactttcgtcacgaaagacggaaggaaacgttcagcctccgccatcgccagcggacaggttggaaacgacacacaggccatcgagttttcgcgctgggccgtcacgttttccatcaggccatgttcgcgggcaatcgcttcaatctgtgctttttggctttccggcacgcctgccacaatcaggttctgattggcggtcagacggaaatcgccctgatgaatgttggcgatttcggctacgccgctttttaacggacggcccggataatccagcagacgaccgttttcgataaacagcgtcagatgccacttgttatcgatgcccttgatccagccaatgcgatcgccacgagtcgtaaattcgtaagggcgcgttggcgcaaacgttacgccagcgcgtttttcgacttccgccttaaacgtctctacgcccacgcgttccagggtgtatttggttttggcgtttttacgatcggtacggttaccccagtcacgctgtgtcgtcaccacggccgccgccacgtccaggatcttatccaccgggaagtagccaaattcgctggcggtgcgggcataggtggctttgttaccgtgctcaatggacaaaccaccgcccaccagcaggttaaagccgaccagcttgccgttttccgcaatcgcgatgaagttcagatcgttagcgtgcagatccacatcgttatgtggcgggatcaccaccgtggttttaaacttacgcggcaaataggtttcacccaggatcggttcctggtcggtggttgcgactttttcctgatcccaccagatctctgcataggcgcgggtttgcggcagcagatgttctgacagtttttttgcccactcgtaggcttcctgatgcaactcagactccacggggttcgaggtgcacagaacgttacggttaacgtcgttcgcggtcgccagcgcatccagccccacttcgtgcagcatctggtgcgttggcttcacgttcttcttcagaataccgtgaaactggaaagtctgacggttggtcaagcggatgctgccgtaaagggttttatcggtggcaaatttatcgatcgccagccactgtgttggcgtgataatcccgcccggcaggcggcagcgcaacatcatcgcatgacgaggctcaagcttttgctccgcacgttcagcgcgaatatcgcggtcatcctgctggtacatgccgtgaaaacggattagcagaaagttatcgccgctgaaccctccggtcagaccatcatcaagatcttcaacgatagtaccgcgcaggtagttgctctctttttttaatcgctcagcgtcagtcagtttgccttcaaccaccagcggtccagggtatttttcagtcattagtaaacgtctcgctgataacggcgctcaatgcgcagctcacttaaaaattcatcagccgtttcacgatccatagcaccgtgctcgaccaccacatccagtaatgcctgctctacgtcttttgccatacggttggcatcaccacagacgtaaaggtgcgcgccttcttcaatccagcgccacacttccgcaccacgggcgcggattttatcttgtacgtatatcttctctgcctgatcgcgcgaccacgccagatcgatatgggttaacaggccatctttgacatatttctgccattcaacctgatacaggaaatcatcggtaaagtgtgggttaccaaagaatagccagtttttaccgccggcaccgtcattatcgcgctgctgcataaaggcgcggaacggggcaatcccggtgcccggcccaatcatgatgaccggcgcatccgggttggcgggcaggcggaagttatcattgtgttcgatgaacacgcgcacctcgccctcttcttcaatgcgatccgccagccaggtggacgcgccgccgccgcgctgacgtccttcaatatcaaagcgaacggcaccgacggtgatatgtacttcggtatcggtttcggcctgagaagaggcaatagaatagagacgcggcgttaacggacgcagtaagccggataactgttctgcactcagctgcgcgggtgccaggcgaaccatatcaacaatcggatagcgttgcgcatactgctgcagtttggctttgtcatccaccagcgacagcagttcgtcgttacgtgctaaggctgcgtactgcgccacgatttgcgcggtgttaaccgttagctcaaaatgtttctgcagcgcctctgccaatggcagcgtctggccctgcacctcaaccggctcatcgcctttcaaccacaccagttcaagcaactcgttaaccagtgcggcgtcattttcataccagacgcccagcgcatcaccgggctgatagcgtaatcctgaatcacccagatcgatttcgatatgacgcacgtctttatccgaatcgcgcccggtaattttctggttcaccgccaggctggcactaagcggctgctctttggtgtaagggctggtgaagacttcattcacactgccggcaacggtggccgcactctgcgccggggacgcggtcgggacgcgttctttcagtaccgcagtgattgccgtacgccaggcgctggcctgctcagcatattcgacatcggcatcgacccggtccagcaggcgctcagcgcccagctcagccaggcggctgtcaaaatctttgcccgctttgctgaagaattcatacgatgtgtcgccaagaccaaacacggcaaaggcagcgccgtccagtttgggcgcttttttagacatcaggaatttgtgcagcgcaacggcctcttccggcggttcgccttcgccctgggtcgatgtcacgacgatcaggattttttcctgaccaatctgcttgaatttaaaatcgcccgcgttgaccagattcacggtcagttttgccgcctgcaggtcatcgcgaagctgctcggccacccggcgggcattacccgtttgtgaggcagaaagcagcgtaatggccggagcttcagcctgcgcaggggcgctggcaaccgcctgacccggcgtttgattgaccatgccccagaaatagccggagagccaggccagctgggtggtggaaaaatctgtcgttgctgcctgtaaacgagcaagttgctccggagagagcggaagcattgaacctggtgcctgagtcgtcatcgcgataaaaattccagtagcagaagtccgaaccgaatagtagcggaagagaagaaagggtacagggagctatattaacgattaaatacgccttcgacatatcaaataaccaaaatgactaaatggtttttcagataaaattaatcgttaaaagtggtaacgacagggtgagttaacaaacttagctaatcatactgtcggtaggacgttccgactggttatcgtgctaaagggatggcataaagacaggaaaaccgccacggagtgacgacagatgccagacagtatcacagcattaccggctgcattggcagagcagagtctggaaaaacttggcttcagctcgcctcctgcccctgacgaggccggactgagcacgctttatcgcgcctggtgccagtccgtgccctttgataaccttcgccgacgtctcatcacagaagacgaccgcgcccttcccctgcctggtagcacggccagcgactttttcactcactggttaacctttggcacaggcggtacatgctgggctggccacggcgcgttgtatgccctgctcgcgtatttggggtttcacgtgcagtttggcctttccaccatgctgtcttcgcgtccggcacccgtgggttctcccggtcatggcatgttgattgtcaagctggatggacgcacgctggtggttgacagcacgctgctccacggcgatccgcttccgctggaggcccggctgaacccgcatcccgtctggggcacccgcgtccatcagcatgatggcagctggtgcatacactggaagccgctgggtcgggcatggctcgactgtaaaattctggaaaccgacctctccgctgacgcgttccagtcacgtcatcaacaaagccgtagcaacagtcgctttgacggtgccctgctgattcgccgcgctaacggcgaggcgatcacgggaatcgtgaagggagagcaggtcatccgggatcgccagggaaaagaaagcgttacgccgctgtcacgttcagagcagcaccggctgctgattgaggagtacggcatcgcggaagccctcgtcgcgcgacttccggctgacgatccggtatatcgctgagcgctttttaaggaaagtgggggacgcgttttaccattctggcttaatcgtcgttaaacggcgcttagcggatgcgaaaaaccgccttttcaggtagaattcagcggtttttaatgcctgagagcgattatgtctaccacgttatttaaagagttccagttcgaagccgcgcaccatttacccaatgtgccggcaggacacaaatgcggccgtttgcacggtcactcattccttgttcgtctggaaattaccggtgaagtggatgcgcataccggctgggtcatggattttgcagagctgaaagcggcgttcaaacccctctatgacaggcttgatcactactatcttaatgagatccctgggctggagaatcccaccagtgaagttctggcgaaatggatttgggatcacatgaagcctcgtctgccgctgctgagcgcggtgatgattaaagaaacctgcaccgcaggctgcacctatcgcggttaatccgcttcgctacggccgctcagggtcgatcgcccgtatcttcacctgttgatcggcctgctgccgcctttccagcgcggcgtcatgttaacggtctggcggccaaaggccgccagcgttttatcaggcaatattcagatatttatgggtctgcatcgacagtcgccagttgcgcgcaatgcaggtttcaatacacagctttgttgcctcatctttgcgactaattggctgcagcgcaatgatacgtgctttgctgtcgtggatgcctgccagcaaatcgtttaacgcatccacatcacgttgccgggcaaccgggtgcttaatttcatccgcacggctcagggcctgtgccaggacgtcataaccgccacgcatgtttaccttgggtgaaacggtcacccaggtggcatcagcgcagtggatttcgtgggtcccgctggtttcaatctgacactggaatcccgcagcctcaagtgatgcagtcagcggacgcaaatcatagatagccggttcaccgccggtgatcaccacatggcgagccgtccagccctgttgttgtatgctgctcagaagcgtcgccgcatcggcattgccccaggcatcgctttccaccgttttgaccagaatatcgcctaatgatgtttcccgatccgcctgtttttcccaggtgtgcttggtgtcgcaccaactgcatcctaccggacatccctgtaagcggatgaaaatagccggcacgccggtgtaataaccttcgccttgcagcgtctggaacatttcgttaatcgggtactgcataatggtctctttggttttttcaaaacgcgattatcgcagaacaccgggttgagatcatgtcaggtgatgcgaaagggcgcgagctgttcggcacgcgccagcacgcaggtcagcagagggctgtgttcagcagcccgttcagacggacagatccacccagaccgccgcatgatccgaggcggcattaacctcttttttcagttcgggataggtttcccactttaccggacgcacgccaggccacatccctttgcgccatacaccgcccttctctacctttttccacagcgcgggcgacagcaaaatatagtcaatcttgttgctggcagtgcagccgccccaggtccctggatagccgccgttatcaaacttttcatgggtgaagatatctttcaggtcggtttctttcagcagcggcgacaatgcatcactgtccggcgtatcgttaaagtcgccggtgatggcaatcaacgtttgcccctctttgatgcgttgctgataaatcgctttcacccgttcggcctgctgcttgcggcgggcatcggaactggctttagcgccgtagcctttactcttaaaatggttaaccagcacgtgcagagtttggccatcggccagcggaatcgcaaattcgggacagtcgcgagagaaaatcaggttgccctgtttatctttatcatcaacgtggctgcggatggtgtcgatggcaaagcctgccgcggtcatcagtccgacatcgattccccgctcatcgttgccgtcaatcaccatgacatgatcaaaaggcgttccctggcgggccggcagcatggcgttgttgaattccagcaaggcgggacggctttctgcctccaccacggtcaggatatccgcgtgaaggtcaatcatgacctgtgccgttagccccatggcaatttcgtctaccggcgcgcggcgcaactccagcgaacccacccaatcggcacggcctgcggcaataatttttattccgctgttgtctgtcggtcgggtcaacagtttgccccggttacgccggagaataacaaagggcccggtgtcggacgtttgcaagccaagtgcatccatcaattcgaccatctgttttttgtccgcgtcgctgtattccacctgtcccagcagggcattaagttgggcaaatttttccagcgtcggtttgcccactcgccattcattctggttcattgctctggcgcgatcgaacaggttttcaacgttataagaagccagtctcatgcgtatcccctttcaggcagtcagaaatgtgaacctgaaagcacccgcagacgcgcttcaggcaagcggcaaggtgcattgtctgttacaggcgcacggtgctcgtcgttcagtgtcgatgggttttgtgaagaatggatgtaaacagcatagacgtcgcggaaaaatgtgaggtgagcggcataacctgtgggcataaaaaaacccgccagcatgggcgggttttatcagaagtcagaagcagtaaacttactggcctttcacttctttcagaccgttgaacggggcttttgcacccagcgcttcttcgatacggatcagctggttgtacttcgcaacacggtcagagcggctcattgaaccggttttgatctggcctgcagctgtaccgaccgccaggtcagcgatggtcgcatcttccgtttcacctgaacggtgagagatcacagcggtgtagcctgcatctttcgccattttaatcgcagccagggtttcggtcagagaaccgatctggttgaatttgatcaggatggagttagcgatacctttgtcgataccttctttcaggatcttggtgttagtgacgaacaggtcgtcgcccaccagctggattttgtcgcccagcactttggtctggtaggcgaagccatcccagtcagattcgtccaggccatcttcgatagaaacgatcggatactgcttggtcagatcttccaggaagtgggtgaactcttctgacgtgaacgctttaccgccttcacccgccagaacgtatttgccatctttgtagaactcagaagccgcacagtccatagccagggtaatgtctttacccagctcataacctgctgcttttaccgcttccgcgataacagccagcgcttcggcgttagaacccaggtttggcgcatagccaccttcgtcacctaccgccgtgctcatgcctttgcttttcagcacttttgccaggttatggaacacttcagaacccatacggatcgcttctttcacgtttgaagcgccaaccggctgaatcatgaattcctggatgtcgacgttgttgtcggcatgttcgccgccgttgatgatgttcatcattggcagaggcatagagtatttgcctggggtgccgttcagttcagcgatgtgctcgtacagcgcctgacctttagaggccgctgccgctttcgctgcagccagtgacacggccagaatggcgttagcaccgaagttagatttgttctcagtaccgtccaggtcgatcatgattttatcgatgttcgcctgatctttcgcgtctttgccttttaccgcttcagcaatcggaccgttaaccgcagcaacggctttggttacgcctttgcccaggaaacgggatttgtcaccgtcacgcagttccagtgcttcacgagaaccggtagatgcacctgatggtgccgcagccagaccaacgaaaccaccttccaggtgaacttctgcttcaacagttgggttgccacgtgagtcgataatttcgcgaccgatgacttttacgattttggccattacgattttcctcagtacaagttagtcaattctaagacaaacaacgcgcgaaaagttcgcgcgttgttcgttaaacttatttcgctaaacgcttctgatgctcatgtgctgccttcacaaacccggcaaacaacggatgaccatcgcgtggcgtcgatgtgaactcgggatggaactggcaagcaataaaccacggatgattggggatctcaatgatctcaaccaattgatcatcaccagaccggcccgccacacgtaaacccgctgcctcgatttgcttcagcagcatgttgttcacttcatagcggtgacgatggcgctcaacaatggtgtcagaaccgtacagctggcgaaccttactttccgggtttagctgacactgctggctgccgaggcgcatggtgccgcccagatcgctctgttcagtacgcacttccacattgccttcttcgtcacgccattcggtgatcagtgcgaccaccggatacttacagtctggcacaaattctgtagagtttgcgcctgccataccggcaacgttacgggcgaactccatcaaagccacctgcatgccgagacagatgccaagataaggcacgttgttttcacgcgcatatttcgccgtcatcaacttgccttctacgccacgatagccaaaaccaccggggatcagaatggcatctaaatctttcagcaattcgacaccacgggtttcaacatcctgtgagtcaatcagcttgatattcacggtcacgcgatttttcagaccgccgtgcttcagcgcttctataacggatttataagcgtccggcagttcgacatatttgcccaccatgccgatggtgacttcgccgcctggattggcttcttcataaatcacctgctcccactccgccagattggcttccggggcgttcaggttgaaacgcttacagatatagtcatccaggccctgcgatttcagcatgcccgggattttgtaaatcgaatcgacgtctttcagcgagataacggctttttccggcacgttacagaacagcgcaattttgccacgctcattcgctggcaccgcgcgatcggaacggcagatgagaacgtcaggctgaataccgatggagagcagctctttaacagagtgctgcgttggcttggttttcacctcgcccgccgcggccatgtaaggcaccagcgtcaggtgcatgtacatcgtgtgctcgcggcccacatccaccgccatctgacgaatcgcttccaggaacggcaaggattcgatatcacccaccgtgccaccgatttcgaccagcacgacatcatggccttcgccgccttcaagaatgcgctctttgatcgcattcgtgatatgagggataacctgaatggtggcaccaagatagtcaccgcgacgctctttgcgcaggacttctgagtagatacgacccgtggtgaaattgttgcggcgcgacattttagtgcggatgaagcgctcgtagtgacccaaatccagatcggtttcggcaccgtcgtcggtgacgaacacttcaccatgctgagttgggctcatggtacccggatcgacgttgatgtacgggtccagtttcatgatggtcacattcagaccacgcgcttcaagaatggctgcgagggaggctgcggcaatgcctttacccagagaggaaacgaccccgccggtcacaaaaatataattcgttgtcatgctgaacctgagagtttaggtttaaagacggtggaataaccaggacgggaaaacagtatactggaaaccgctatcagccacaattggtgaatcacatccatctcccaacgcattgctgcgggtaacatagcggatagcggtaaacaaaattttgacctgcgtcacaaatctggcgtcaggctgaatcgagtaagctcaagagagcaatttatgctcgctgctggaataatcagcttttttccttcgccttaacctgttgccaggcggcttccatttgcgccagggtggcgcccggcatcgtcaggccctgcgcggtgataatggcttctaccgcacggaaacggcgctcaaacttgtcattggctttctgcagcgccgtttcggccttgctgcccagatgacgggaaagatttacggtagcaaacagcagatcgccaatctcttcttccagcttttgtggatcaatcacgctttgctgtgcctcatgcatcacttcgtcgatctcttcgtgcaccttatcgaccaccgggccaagcgtggtccagtcaaagcccacgttgtggcatcgcttctgaattttatgggcgcgcatcagtgcagggagcgctttcggaatatcgtccagcgcggagtgctgcgctttttctgcccgttcggcgcttttaatcgcttcccagtttttcaacacctccgcactgctctctgccgtgccctctgcgaagatatgcggatgacggcgctccagcttgtcactgatggcgtgacaaatatcatcaaagttaaaacgcccctgctcctgcgccatctgagcataaaacaccacctggaaaagcaaatcgcccagctcgccgcggagatcctcaaagtcttcacgctggatagcatccagcacttcataggtttcttccagcgtgtaaggcgcaatagtggcaaaggtctgctcgcgatcccacgggcagccctgctgcggatcgcgcagggttttcataatgcccagcaggcgatcaatagaggtcatatggcaatccttcaggtgttcagttggcgtaacagcggtgataaaagcagccaggcgcacgtcagaaagcacgtgcgcctgataacagaagtttagtgcagacgtcgggcatcaataatatcaggcacctggttcaggcgagacaggacgcgccccagcacctgatgattataaatttcaatatccatatcaatggtggctaactgttttttcgtatcgctacggcttgaaacccccagcacgttcaccttttcattggcgaggatggtggtgatatcgcgtaacagcccgctacgatcgttggccgtgactctcacgaccagtgaatagccgctggaatagctttcgccccacaccgcatccacgatgcgctcaggcgcggtggaaatcagctcagacagctgatcgcagtcggcgcggtgaatcgaaatgccgcgtccgtgggtgataaatccgacgatatcatcgcccggaatcggctgacaacagcgtgcaatgtggtgcatcaggttgccaacgccttccaccaccacgcgaccgctctcttttcgtgaggtgggcgcgtgcgatttttgcgtaagctgacgcagggcttcgcggtcttgctcttcggcagtcggcttattgagcttcgcctgcaggaaattcaccatctggtgcaggcgaatatcaccgccgccaatagcggccaacagctcgtccagcgaggtgacgttatagcgcggcagcagcagcttctcggcctcacgcaggctgatatccatctggttcagctcgttatccagaatctggcggcccgccaggatgtttttatcccgatcctgtttacggaaccagttatgaattttggcgcgaccacggctggtggtgatgaatcccaggttcgggttcagccagtcacggctcgggttcggctgtttttgggtaatgacttcaacctgatcgcccatctgcagttgataggtgaagggcacgatgcgcccgccaatcttcgcgccgatgcagcgatgaccgatatcgctgtgaatatggtaagcaaaatccagtggcgtagaacccgccggtaaatccaccacatccccttttggggtaaagacataaacgcggtcgtcaaacacctgactgcgcacctcttccagcagctcgccggaatccgccatctcttcctgccatgtgatcagcttacgcagccaggcaatgcgctcttcgtgacctgccgccccgcgcgcatggctggacgacgggccctctttgtatttccagtgcgcggccacgcccagctctgcatcttcatgcatctgacgggtacggatctggatctcgacggttttgccctcaggccccaataccacggtgtggatcgactgatagccattgggcttgggatttgctacatagtcgtcaaactcattgggcagatggcgatacagcgtatgcaccgtgcccagtgcgccataacagtcctgcagccgctcggcaacgatacgtaccgcgcgcacatcaaagagttcatcaaacgccagcgacttcttctgcatcttgcgccagatgctgtagatatgcttcggacggccgtacacttctgcccgcacgccctcttttgccatctctttacgcaggttattaacaaagttttcgatgtactgctcacggtcaatgcggcgctcatgcagcagcttagcaatgcgtttgtactcatcaggatgcaggtagcggaagcagtaatcttccagctcccatttaagctgcccaatgcccagccgattcgccagcggtgcataaatgttggtgctttctttcgctgccagtacgcgctcatcttccggcgcgtctttgacttcacgcaggttcatgatgcgctcagccagcttcagcacgacgcagcggaagtcttccaccatggccagcaacatgcggcggacgttatccacctgctcggaggccatggagtcgttatgaatggctttcagctgacggatggcgtccatatcacgaacgccgtgcaccagcgaaacgatgcctttgccgacggttttttccagctcttcttcgctgaccacttcgtcattagcaagggggaaaatcaacgcggcgcacaggctttcaatgtccatgctgagcatcgagaggatttccaccatctcgataccgcgccacagcagtagcgactggtgaggatgcccctgagtctgcgcttcacaatagcgccaggtttcagcgagacgatcacaggattgcgggttagcaacgccaaggctggcgatccactggtcaagggcaaactccccttccgtatttaaatgtgcacttctaaccgcaaccatatcctctcctgcacagcgcccctgccggacacttatattttttttctgaacagcaccatggattcgagatgacgggtatgaggaaacatatccagcatcacgaccctttccaattggtaacccgccgacagcaaggtgctactgtcacgtgcgagtgtcacaggattacaagatacatagaccacgcgttctggcgataattttacgacatgtgccataacacctgccgccccagcgcgtgccggatcgagtaataccttgttaaagccctgcatagcccagggctgatgcgaaacatcttcttccagattgtgctgaaaaaatctgacgtttttaagattattcacgtcagcattatacgctgcctgttgcactaatgctgcaacgccctcaacacctacggcacgttgtaccgattttcctacaggaagcgtaaagtttcccatgccacaaaacagatccagaacccgatcttcaggttgtaaatcaagccattcgatggccttcgccaccatctgctggttgaccgcatcattgacctgaataaaatcctgtggactgaagattagctcaagctggtgagaatgataaaatggtcgctgttcgctaaatccgcgcagcgtctcacttccatcatccagaaacagcatcagttggtgctgatgcgaaaaacgttccagttttgctatatcgtcggagcttaatgcatccagatggcgcagtagcagcactgagccattgtcagcctgcaccagttcaacatgtcctaaccgtttgacagcattaagcatggtgagacaattgcgcagcggaataattagcgcttcaagttggggcaccataacagggcattgctgaatatcgaccagatcgttggtagattcctggcgaaaccccatcagtaactgctgacttttgttatgccattgtaaaccaaggcgggcgcgacggcggtagccccaggtgggcccggcaataatgtcatcaaccgccacgggctggttcgcggcctgggtcagcatgcgcgccagcgcacgcgatttactctgctgctgcaacgcttcatcagcatgttgctgctgacagccaccacagcggctaaaatgaggacagcgtggctcaacccgtgacgcgctgcggctgagcaggcgcaccgttttcgctctggcaaactggcgtttgtcctccagcaggcttacctccgcctcttcgccaggcagcgcacccgtgacaaacagggttttccctttgtgccgggccacgccctgaccaaacgggtcgaggtcttcaatggtgacggtgatccgttgtttggtcgtcacgcgctgttttgcggagtaaaattgcgccatagtgtggttctttctcttttagattcgatgtgcataaggttcagcggatgcacagggacgtcaatgccggacagcaggcgactattatgaccaaatacagcctgcgggcgcgaatgatgattttaattttggcccctacgttgatggtaggtttgctgctcagctcattttttgtggtgcatcgctacaacgagctacagcgacaggtcattgaggcgggtgccaatatcattgaaccgctggcaatctccaccgaatacagcatgacgtggcacaatcgtgacgcgctacgtgaactggttagtttactgcatcgccgccattccgggatcgttcgtgccatctccgtctttgacgacaataatcagctctacgtcacctccaacaacaatcaaaacctcagtctggaatcaaaacaggctattcgcgcgcttcctgacgatgtttccatcgaaggcagcggcaacctgctgattttacgtaagccgataacgtctgagcgttacgccgttgacgagctaccggaacaggatgccaaacccgcaggcaatcctctgggctacgtggcgatagaactggatctgcaatccgtgcgcttgcagcaataccgggaagtctttattgccaccctgatgctgttgttctgcctgtgcattgccatgctgtttgcctaccgtctgatgcgggatgtcaccggccctatccgtaatatggtcagtaccgttgaccgcattcgccgtgggcagttagacagtcgggtggaaggtcatatgctcggcgagttgagtatcctgaaaaacgggatcaacgccatggcaatgtcgctcaccgcttatcacgaagagatgcagcacaatattgaccaggccacctgggatctgcgggaaacgctggagcaactggagattcagaacgtcgagctggatctggccaagaagcgggcgcaggaagccgcccgtatcaaatccgagtttctggcaaatatgtctcatgagctgcgtacgccgctcaatggcgtgctgggctttacccgacagatgctgaaaacgccgctgcgcactactcaacgcgactacatgctgaccattgagcgctcggccaataacctgctgtcgatcattaatgacgtgcttgatttttctaagctggaagccggcaaactgatgctggagtccattcccttcccgttgcgcgccaccctggatgaaaccctggttttactggctccgtcggcccatgaaaaagggctggagctgaccgtggtgtgcaataacagcgtgccggataacgttatcggtgatgcgcttcgtctgcagcaaatcctgatcaacctgatgggaaatgcgattaaatttaccgaaaaaggcacgattaatttacgcgtagatcaacacaccatcacggcgacccatgtcgagctggagattcaggttcgcgacaccggcattggcatttccgaagagcagcaggcgcagttgtttcaggcatttcgccaggcggatgccagtatttctcgccgccacggtggatcggggctggggctggtgatcacccaaaagctggtgcgggaaatgaacggggagattactttcgtcagccgccagaatcacggctctaccttttgggtgcgcgttaagctcgacctcaaccccaatgcaccgagtatgccgcgggtactggatgcgctgtcgaatacgcgcatggcctatgttgaagccaacccagatgttgccagcgcggtggtggaaattttagctgcaacgccgttgcaggttgagcacagcttaacgctggaaggcctgagccagccgcgctatcccattctgttgatggcaatgccggtcaacgccagccaaccgcaggtgcttgaggacaggctgatccattccctgctggaaagcgcggatctggtcattatggcgctgccgagtccgatgatgttactggccgatgagctgaaagtgcgcggtattgatggctgtatcacgaaacccgtctcgcaaacgcgcctgctgccgatgctgctggagctgcatgcgcgtcacagcaatgaaatgtccgcttcgccgcgcctgccgctgaccgtgatggccgtggacgacaatcctgctaacctgaagctgatcggggcgctgctcgaagaacaggtgcaacacatcgtactgtgtaataacgccgagcaggctattcgcgtcgcccaccggcaagcgttggacgtcattttaatggatatacaaatgccggatattgatggcatccgcgccagtgagatcatccgtacgctgccaaaccatgcagccacgccgatagttgccgttaccgctcatgctattgatggtgaacgcgagcatctgatcagggcaggaatgaacgactatcttgccaagccaattgatgaaaacaagctcgctcaggttctggcgcgttatatgccaagcccgaccaccacggtgccagagctgccccaaatattgccaacgctcgactggaagctggcattacgccaggcagcaaataaaccggacctggcacgggatttactacgaatgctgctggagttcttaccggaagtgcacggtaaaatggcgcaggccatggccgacaatgacgcgatcgccttacgcgagatcattcataaacttcacggcagcgccagttacagcggcgtgccacggatgaaacagctgtgtcgtaagcttgagaaagaacttcatcaggccagtgatatcgaagcgctggagccagaactcctggagcttcaggatgaaatggagaacgtcgccacgcaggcacggcgcatactctccatgccttaatcagtacagggtgatgatacgacggccctgtcactgctgcatggcggggccgtaaaaacgtttagtgaaaaccggcgattttcattgtagcggccacatttcgcgcagtgagccggacattgttttctgcccctttcagggcctcatccagcgagcaaatacggtaaagcacgctaaacaccgcatctaagccatgctgatgtaccacaccgacatcgtcagtcaggctgccagcaatccctatcaccggaatattaaaacgcttggcgacgttggcgacgccaatgggcactttgccattgatactctggctatcgatgcgtccctcgccggtgatgaccaggtcggcgtcttttacctgttcttccagtcccagtgcttcggtaacaatctcaatcccgcgacgtagctccgcctgacaaaaagcatgcagtgcagcgcccataccaccggctgcgccgccgccactgacctgcagcacatcaatgcccagatcacgctgaataatggtggcgtagtgcgtcagtgcccgatccagttgctcaaccaactcgggcgtcgcgcccttctgtgggccaaaaatcgctgaggcaccatgagcgcccgtcaacgtattggtgacgtcacaggctacttcaaagcggcagtgacggatacggctgtccagcccgctaatatcaatgcttgccagctcgggcaaggcaccgccgccctgaccaatttgcttgtgctgcttatccagcaagcgggcgcccagcgcctgcatcatgcctgcaccgccgtcattggtggcactgccaccaatgccaataatgatatgtttaacgcctttatccagcgcatttttaatcagctctcctgtaccaaacgaggtggtgatcaggggatcgcgctgcgctgccggtaccagctccaggccgctggccgccgccatttcgatgtaggcggtatcttcattacccgataagccataaaacgcctcaacgggttcacccagcggaccggttaccgttaacctgaccctttttccctgcgtcgcggccaccatcgcttcaaccgtaccttcgccaccatcagcgaccggtattttcacataatgggcatcggggaaaacctcacggaatcccgcttcgattgccgatgccacttccagggcagaaagactttctttatatgaatccggtgcgattacgattttcataggcaatccaggcggtattaattaacgattagagagtgaaagtggcccgacgtccgcagaagccgggcgagtcattaacgagagatttcgacgttggctaatttttcataatagcaggccaacgcgctgtggtcggcagttccctgtccgtcattacgcagcgcctgcatcatctccatcacggccgccgtcagcggaaggtgcgcaccgatgctgtgcgaggtatccagcgcgttagccaggtccttgatatgtaagtcaatgcggaagcccggcttaaagttgcggtccatcaccattggcgctttggcatcaagaacggtacttcccgccaggccaccacgaatcgcctggtacaccagttccggactcacgcccgctttggtcgccagggacagggcttctgacatcgcagcgatattcagcgccacaatcacctggtttgccagtttagtgacgttgcccgccccgatgtcaccggtgtgaaccaccgatcccgccatggctttcatgatgtcatagcactcgtcaaacacggccttatcgccgcccaccatgactgacagcgtcccttcaatcgctttgggctcgccgccactcaccggcgcatccagcattttaatttgttttgccgccagcgcatcgtggatttcccggctcgccagcggcgcgatggagctcatatcgatcacaatcaggcccggtttagcgccgtcgatgatgccgttttcgcccaggcagacttctttcacctgcggtgagttgggcaccatggtgatgaccacgtcacactgttgggccagttctttggcattcgccgccgttgtcgcgccgagcttcaccagttcagcttcgttttctgcattgtgatcgcgcaccaccagtgaataaccagcttttaacaggtttttactcattggtttgcccatgatgcccaggccaataaagccaattttcatttcgtttctcctgatgattactttttgaatttgtcacacaacgcctgagtggcactacgaaaaacaccgagatcgctgcctacggcaacgaaagtcgcgccccattcgagatagcgccgcgcgtccacctcaaccggtgccagaataccgctgggcttgttagccgcttttgcccgctcaaagatgtgtttgatgaccttcaatacctccgggtgcgcgggctgcccaaggtagccaagtgcggcagacaaatcgccagggccgacaaaaatgccgtccaccccgtcaacggccgcgatagcatcaatattgtccacggcctgctgcgtttctatttgtactaacacagcaatgttgtcgttaatggtgccgttataatccggcaccgtgccgtacatgttgctgcgatgagaaaccgacacgccgcgaatcccggcaggcggatagcgcgttgaggccaccgcacgtctggcgtcttcttcgttctctacaaaggggacgaggatgttgttaaaaccaatgtccaacaggcgcttaataattaccggttcgttacagggtggacgcaccaccggcgcactggggctgcccttcaacgccatgagctgaggcacaaaggtggtgatatcgttgggtgcgtgttcaccatccagtactaaccagtcaaatccggccagccccaacacttcggtcgagagaggacttgccagggcacaccaactgccgatcagggtttcaccagccagcaggcggcggcgaaattcatttggccaggctgtattactcatgatttagctcctgtggaacgggcttcctcaaggaagcccaaaaaagttaacgcaccaggcacgggcgcttgttatcaaacgtccactgcgggatcaggaactgcatcgcctgcgcatcatcacgtgcgcccagaccatgcttttgatagagcgcattggcctgcatgacctgatccatatccagttcaatacccagccccggtgcctgcggcaccgcgaccatgccaccttcaatctggaaaggcgttttggtcagtcgttgattgccttcctgccagatccagtgtgtatcaatggcggtgatcttgcccggtgcggcagcggcaacgtgggtgaacatcgccagtgaaatgtcgaaatggttgttggagtgcgaaccccacgtcaggccaaacgcgtggcacatttgcgccacgcgcacggaaccctgcatcgtccagaagtgcgggtccgccagcggaatatcgaccgactgcaaagataaggtgtggcccatttgacgccagtcagtggcaatcatattggtggcggtaggcaagccggttgcccgtcggaattcagccatcacttcgcgcccggaatagccctgctctgcgccacagggatcttctgcataggcaagcacgcctttaagctgcttgcccagcgtaatggcttcgtccagcgaccaggctccgttgggatcaatagtgacgcgcgcctgcgggaagcgtttcgccagcgccgtaatcgcttctgcctcgtcgctgccgctcagcacgccacctttgagcttaaagtcgttaaagccgtatttttcataggcggcttcagccagacgcaccaccgcatcgggcgtgagcgcttcctgatgtcgcaggcgataccagtcgcaggcgtcgttgtcctggttctgatagcccagtgaagtcttattgcgatcgccaacgtaaaacagataacccagcatttctactttgtcgcgctgctgcccatcgcccaacagcgaggcaacattaacgcccagatgctgccccagcagatccagcagtgaggcttcgatcccggtaaccacatgaatcgtggtgcgcagatcaaaggtctgattaccccggccgccggcatcgcgatcggcaaaggtggtgcgaaccaggctcaggatgtttttatattcgccaatcgttttccccaccaccagcgccgcggcatcttccaacgtctgacggattttttcgccgccgggaatttcacctacgccggtatggccggcgttatcgttaatgatgacgatatttcgggtgaagaaaggtgaatgtgcgccgctcaggttcaataacatgctgtcataaccggcgacgggaataacctgcatggcggtaattttcggtgtcgtattcatctgttatcccttaagcagaggcccggccaaacgccgggcgtttacggtcaaatgtccagccgggtaccaaatactgcatggccgtggcgtcattgcgcccgcccgctggcagtgatttgtagcgttcgtttgccaggcggagttgttcccagtccagttcaatacccaggcctggcgcatctggcaccgcaatttttccctgacggatctgcagcggatttttcgtcaggcgctgatcgccctcctgccagatccagtgggtatctatcgcggtaggtttaccgggcgcggcggcaccgacatgggtgaacatcgccagggaaatatcaaagtggttatttgagtggcagccccaggttaagccccattcatcgcaaagttgcgcgacccgcacggcaccgcttaacgtccagaagtgcggatcggccagcgggatatcaacggcattcagcatcagcgcatgattcatttcacgccagttggtggcgatcatgttggtggcgaccggcaagccagtggcacgacgaaactcggccatcacctcgcgtcctgaataaccctgctcagcgccacagggatcttccgcgtaggtcagcacatcctgcatgcccttgcacagcccgatcgcttcgtccagcagccacgcgccattgggatcgacggtgattcgtgcctcgggaaaacgttttttcagcgcctgcgcggtggcgatctcctgttcgcccggcagcacgccgcccttgagtttgaaatctttgaaaccgtatttatcctgtgccgcttccgccaaccggacaacggcctcgctactcagggcttcctgatgacgcaggtgataccagtcatgctgtgccttctcgccggacagataaggcaaatcggttttacggcggtcacctaagtagaacaggtagcccaaaacggtcacctcgttgcgctgctgacccggaccgagcagctcagcgaccggaacccccagacattgtcccagcaagtccagcaatgcagcctccagtgccgcgaccgcgttgacgcgcagttcaaacgtccaggcgcctttgccaaaggtatcgaaatcggcggactggttcccctgatgaacctgctgaaccagccggttcatgcgggcgacctgctgaccgatcacctggggtacggcatccaccagggtttgatagatggtttcgccgcctggcgcttcacccagcccggtgtgtccggcgctgtcagtcaggatcacgatattgcgcgtgaagcaggcattatgggccccaccaatattcagcagcatactgtcatagccagccacaggaacgacctgcatatcggtaatcacgggcgttgattgtgtattcatgctggctccttaacgtgttttcagttcgatgcgcttgatgttatccaccagcaccagataactaagcacggcaacgaacgcgtgaatgcccacataaaccagcgcaccgttataggagccggtagacgcaatgatgtagccgattgcgataggcgtgacgatgccggaaacgttgccaaacatgttgaacagaccaccgctcagcccgctgatctctttcggcgcagtgtccgccatcacggcccaacccagcgcaccgatgcctttaccaaagaaggcggtcgccatgaacagaaccacaacccagtccgtctcaacataattacagaccaccatggaggtagagagcagcatcccaaggacaatcggcgttttacgggcaatattcagagagccggttttgcgcatgagccagtcggatatcaccccaccgagcacaccaccgataaagccgcagagcgcaggaaccgaggcgacaaaccccgccttgaggatcgacatgccacgcgcctgtaccagatagaccgggaaccaggtgataaagaagtatgtcagagcgttgatacagtactgaccgatatacacaccgatcatcatgcgcgattgcagcagttgcttaacctggaaccacttatcacttaagctgactttttgcttcacgcttttctgatccatgttgatcaacgcgccgccctgctccatgtattccagttctgctttgttcacgccaggatgatcgcagggatcgtgaatcactttgagccagacgaggctcaaaataatccccaatccccccataaaccagaacacgtgcgcccagcccacggcagaggtcagccagcccataactggcgcaaaaatcaccgtagcgaaatattgtgcagagttgaaaattgccactgccgtcccgcgttcctgagccgggaaccaggccgcgacaatacggctgttgcctgggaatgaaggcgcttcagccagccccaccataaagcgcagcataaacagcgtcatcacaatggtgtaaccgctgaacaagtccacaaagccttgcagcagggtaaataacgaccaaaggaagatactccagaaatagacgcgcttagaaccaaagcggtccagcagccagccgccggggatttgtccgataacatacgcccacgaaaaagcagagaagataaagcccattcccaccgggtcgaggccgatatcttttgccatcgccgaacccgcaatagacaacgtggcgcggtcgccgtaattgaatgaggtcacaataaacagcatgaccacgatccagtaacgcgcgttggtgcgtttttgtaccgcctccgttgtctggtgataactactcatgatgcactcctgaaatatagcgaaagccacattcgctctgactgcatacacatcgcgttgggtatcagagagatgtaggttaaacacggcgatttttttaatggcaaaccgataatgcgtcgtgacaaataacctgcccgggaaaacggaaatcagtatatgaagctgatttggttgaggcattggaatatcaccctggaataaggtgaaaaggaggaggcttttttgtgccgttgcataaaacgctgcggaacgtttcacgtattttgtaaaaaatcacaaaaagcgcgcccataggcgtggagataactggctttgtgagaatcttcacttgatttagtaaaaagacattaaaactgcgtcaccagaacgccgaatataggtcaattgcacaatgtgcgggcggtattgcctctttatactgaccctggcagataccgaacctgtgacacctggcttatcataatgaatgcgccgcgcaaacaaggcgctacccactggaaggtgagcgatgaccccaacatcaaaagaacaaccgctctgcatcaaagttcatgaaaatgacaatgttgcgattgtggtgaacagtctgggcctggccgcgggcaccacgtttagtgatggattgacattgattgagcatgtcccccagggacataaggttgcgctgcaggcgattcctcagggccaggccgtgctgcgttatggtgaagtgattggccttgcgattcgtgatattgcccaaggcagttggatcgatgaatcactcattgcgcttccggacgcgcccgatttgcagagtttgcccctggcgaataacgttccgcctgacctgccaccgcttgaaggttatacctttgagggttatcgcaacgccgacggcagtgtaggcacacgtaaccttttaggcattaccaccagcgttcactgtgtggcgggcgtggtagattatgtggtgcaaatgatagagcgtgatttactgccccgttatcccaacgtggatggtgtggttgcgctgaatcatttgtacggctgtggtgtggcgatcaacgcccctgcggcggtcatccctatccgttccgtccacaatctggccctcaacgcgaatttcggcggcgaaatcatggtggtcagcctgggttgtgaaaagttacaacctgagcgcttactggccggtacgcccgacgtgcagcctgtctcgctggatgacgaagatattgtgcgtttgcaggatgagaaactggtgggctttggcgcgatggtggatgaaatccttcaggtggcagagcgccatttgcagcggctgaatcagcgccagcgtgaaacctgtccggcctctgaattagtcgtggggatgcagtgcggcggcagtgatgccttttccggcgtaacggcgaatcccgcagtggggtttgcgtccgacctgctggtgcgcagtggcgcgaccgtgatgttctctgaggttaccgaggtgcgcgacgcgattcacttactgacaccgcgtgtgatcaatcaggaagtggggcagcggctgattgaagagatggcctggtatgacagctatcttgatcaaggcaaaaccgatcgcagcgccaacccctctcccggtaacaagaaaggcgggctggcaaatgtggtggaaaaagcccttggctccattgccaaatcaggtcgcagtccgattgtggaagtgctgtccccggggcaacgcccttcgcggcgtggactgatttttgccgccacgcccgccagcgattttgtgtgtggaacccagcaactggcctccggcatcaccctacaggtttttaccaccggcaggggaacgccttatggtctggctgcaattccggtgattaaaatggcgacccgcaatgcgctggcggagcgctggcatgacctgatggatattaacgccggcaccattgccacaggtgaagaaaccatcgagcaggttggctggcggttattcgaattgattctggacattgccagcggcagaaaacagacctggtcagatcgctgggggattcgtaatcagctggccgtctttaatcctgcgccgataacctgagcaagatgccgttatgactgcgctaacggaacggcccgcacggcctgatcccgttagtcagaatgggctgccgcccgtttagaatgggacggcagcgaaacagcaaggctgacatgcgcttatcagagctgtttgccccattgctcaacccatggagtggtaacggattcaggttccggatcttccgtggcatccaccaacaacacctcccctacccgtttggcttgatgctcctgcaacagggcgtcaaaacgtttgcccgcgccacagaagttttcgtagctgctgtcgcctagcgcaatgacgccatagcgcagtgtcggctggtggcccagtttgtcctgcacgtcgtggaacaggccagaaatcgtatccggaaaatcgccctgacccgtggttgacgtaatcactaaggcgacatcctctgcatagccttgccagtcggctaacccaggatcttcaaaaatcttcacgtcatggccttgctgctgcaaaaccggttctgcttcttctgccaccagtaatgcattgccatatacggtgcctacaaaaataccaattttcgccatttctcttcccctttattccgtcacgctatcctgacctgagccagccataaactcaacccgtggcacatcaggtaaacaggcctgccagccaaactgatccagaacgccttgccagacagcatccagcccggcacgaatcaccaagggtgctttagtcacaggatggctgagcgccaggctgctggcatgtaacattaaacggttagcgccaaagtgctcagctgcgccgcggttctgacgcaaatcaccatgggctgaatcaccgatgatgggatggcgcaaatgggacatgtgccgacgcaactgatgcttacggccggttttcggtttgagctcaatcaggctgtaacgtgcggtgggataacgactgaccgcaaccggcatctctacctttgccagcgcatgataatcggtcacagcaggctgtggcacgcgcgcatcagtgacaaatttgtcggcgattttatccagttcttcaaccaacggataatccagccgatcgctgccttcaagccagccacgtaccacggcgtgataggttttctccatgtggtgatgctcaaactgctgcgacagcaggcggcccacttcactggaaaggcccattaacagcacgcccgacgtggggcgatcgagccggtgcgccgtaaaaacatgctggcctatctggtcgcgcaccgtctgcatcacaaactgggtttcgtggcgatcgagccaactgcggtgcaccagccagccggcaggtttattcaccgccaccagccactcatcctgataaatgatctctaacatccggcagactcatcctccagaagggcatccaactgctgtaacgtgaggagcagcagcgaacgaccgggctgctcaggcgttaaggcgacctcaaaatagggcgcgaccgcgaagttctttggcaaaggttgccgggcatcaatgatggcccgaacgcgcggaatcagtacccactgtaaccattccagcggttgaagtgtgtcgaggaaaaaaggttgctcgctggtgaacgcctgagcgtctggtgcagcggtctgccagagattgtgctcgtgcattatcgcttcgacctgctcgagccgttgaataattaagtgttccagcgtcatgcatcacctctgactggggaaaaatgggcggcaagcataacccgcaggcacaaaaaaagggagcactgtcattaaacagtgctcccggttcgtttgcagctttccggctacgttagtgctccctgctcatccgtgacaacttttcccgtgcgaactccatccgcgtatcatcctgatcaatccttagcctcctggcccgccgcctcttctaaggggctctcattctccatcctggaggtgtccgttaactcagtcctgagtgtcctgcttcatcctgaagccttccttgtgacgtaaactccgttacgttccggcctcctggctaccgtcatcctgacggctcctgttgtccaggacatcctgtccgcgagtgatattctcgtcagaaactactcaaggcacaaggtgttaaaatgatttataaccttaccttatagaagctgcccatcagcgcggctaataagttaatgatttacaatatttttacatcttttcggcatgaaggacgcgtgaattatagagcgatctctcacaaggtttgtaagagatctctcacacggctgctagcagatatctgtaactagtcactaagcggttgtaaattattgagaaaagaggggatatcggacgccagcgtgacgcgctttttctgcccgggtgtttccagaatgacattcccgctgatgttacacagcgagataatattctcttcagaatccgtggtcgcgataaacaggctcggggcctgtttcagacgtcgctgcatcactaaatgaccgatcaggttttcctgcagtcgaacaaagtcctcttcgctccagacctgcagtaacgtcagcctgttttgttcatagctggcgcgcatgtctccggcgaactggctggtataaaatgcggtgatttgcggatcaagctggatctccagcgctcgctcaacggcatccagcgatggcggcaggctaaagggctggggctgccagagggcacgctctccacggttctccagcaggcagggcgagggtacgccatacaggtcactgctggccggcgcatggccgtaatcctgctgccagtgctggcagtatcgggtggtgaaatcgattaaggcgtcagccgtttgctgcatcattcaaattctcacttctgataggttacacttactcactttgatgacctcagtggtaaccgttatgtcttcttatcagccggacccggcgcttagcaatctgacgctgggcaagcccacagcttatcacgatcgctacgacaacagcttattacaggcggtgcctcgcagcatgaaccgcgagccgctcggcctctatcctgataacctgccctttacaggtgctgatatctggacgttatatgaactttcgtggctcaacagtaaaggtgttccgcaggttgcggtgggcgaagtggtgcttgacgcccggagtcacaatcttatcgagtccaagagtttcaagctctatcttaacagctttaaccaaacccgctttgccgactggggcgaggtacgccaaacgctggagcaggatctgcgtgcctgcgcggaaggtgacgtgcgtgttgcgctgtttcggttaaatgaaattgagggccagcctgtcgggcactttgcgggcgactgcattgatgagcaggatatcgagattgaagattatggcttcaatgccgattatctggttgatgctgctggtcaggagcgggtggacgaaacgctggtcagccatctgcttaagtctaactgtctgatcaccaaccagcctgactggggctcggtgatgattcgctataagggcccacggctcaatcgcgaagcgctgctgcgctacatcatttcatttcgtcagcataatgagtttcatgaacagtgcgttgagcgtatcttcaatgacctgatgcgtttttgtcagccggaacagcttaccgtttacgcacgctatacgcgccgtggcggactggatatcaatccctggcgcagtaacgtggcctttacgcccggtcattctcgtctggtacgtcaatagtttgcgagatatttctcaggaagtcagtcaactatccggttccacttgagcaagccctgcccacaaggctactctgggcaaggcggtaaacagtggattgccgaccagggattttcgtcactgcatttgcagtgtcagcaatcaccctcgcgggtgcaaaggagttcatttgattacacatgtcagccctcttggctctatggatctgctctcccagttggaagtagatatgctgaagcgcacagccagcagcgatttgtatcaactcttccgtaactgctcgctcgccgtgctcaactccggcagtcagactgacagtagccatgaactgctgtcgcgttttgagaacttcgatatcaacgtgctgcgccgcgagcgcggtatcaagctggaactgatcaatccgcccgaagaggcctttgtagacggccatattattcgttcactgcaggccaacctgtttgccgtgctgcgcgatatcctgtttgttaacggccagttagccagctctggacgcttaccctgcgcagaagacaacgattcggtcatgattaccaacaccgtgttttccattctgcgtaatgcccgggcattacacgtgggcgaatatcccaataccgttgtctgctggggcggccactcgattaacgcggtggaataccagtactgtcgcaacgtgggcacgcagttgggcctgcgcgaactgaatatctgtaccggctgtggtccgggcgtgatggaagccccaatgaaaggcgcagcggtaggtcatgctcagcagcgctatcgcgacagtcgctttattggtttgaccgagccgtcgattatcgcggctgaaccgcctaatccgctggtgaacgaactgatcatcatgccggatatcgaaaagcgtctggaagcgttcgtgcgtattgcacatggcatcatcatcttccctggcggcgtagggacggcagaagaattcctttatctgctgggtattctgatgaatccccaaaacgaacatcaggttctgccgctcatcctgaccgggccaaaagagagcgcggactatttccgtgtgctggatgactttattgtcagtacgcttggggagcaggcacgtaagcattatcagatcattatcgatgatgccgccgaggtcgcccgcctgatgagaaaagccatgccgcaggtgaaagagcatcgccgcgaaacgggtgatgcctacagctttaactggtcaattcgcattgctcaggatttgcaggtgccctttatgccgacccatgaaaatatggctaacctcaatctctataccaatcagccgccggaaaaactggctgccgacctgcgccgggcgttctccggtatcgttgcgggtaacgtgaaagagatgggcatccgcgaaatccgcgaaaaaggcccttataaactgcacggtgatgccgacatcatgcaccgcatggatgaactgctacagggctttgtggcacagcagcgtatgaaactgcccggtactgcctatatcccgtgctacgaaatcattaagtaaaccaggaggcagcctgcgggctgcccttaccttatgtcacatcacttacttattgttgatgcactcaatttaattcgtcgcctgcatgccgtgcagggcacgccctgtgtggagggctgcgttgcggcgttgcgccagcttctgggacacacgcgcccctcacatgttgtggcagtgttcgacggcgaggcccgtcatcagggatggcggcatcagttgttacccgactacaaaagtggccgaccgccgatgccggaagagttacaggctgaaatgccagccctgcaggaggcttttcgggcggtgggcgtcagttgctggattgccgaacaggatgaagccgacgatctggccgccacgctggcggtaaaaatggcgcgagctggccatcaggccaccattgtttctaccgataagggctactgccagcttctcgctccggcgattcgcatccgcgattattttcagaagcgctggctggatttgccgtttattgaaaccgagttcggcgttgcaccgtccgttctgcccgactattggggattatgcggcatcagcagcagtaaaatcccaggcatcgcgggcattggccctaaaagcgcccgggagctactgctacagtttggttcactggaagctctgtatcagcagttggatcaggttccgacaaaatggcgtaataagctgcaatcaggccaggagatggcgcttatcagccgcgatgttgcccggctgaagcaggatttagtgctggaagggaatctgaatttactgcgttaccatggcgattaacatcaccaggccgggcgcaagggcacccggcggtggtgattagcgctcgtcgcgacggccacccatggcagcccagatacgacggatgtgcaccgtcacttcttcacgatcgtggtagagctggcgcgcgcgaatctgcgcattgatcccattttcagtgaggcgctcctcgatcatggccagattctgcgtcacttcttcataacgcttcttcatgggcaatttcaggttaaaaatggcttcccggcaccagccattcaccacccagtccgccatcagattcgccacgcgtgcaggtttttccaccatgtcgcacaccagccagctgatgttggtgcggggcggacggaagcggaaaccgtcttcacgttcatggaacacctgtccggtatccatcaggctcggtgccataggaccgttgtccaccgcatagaccatcatgctgcgctgaaccagttgatacgtccagccgccaggacaagcgcccaaatcgacagcatacatcccgctgcctaaacgctcatcccactcatcggctggcacaaaaacgtgaaaggcttcttccagcttaagcgttgagcggcttggcgcgtcagacggaaacttaagacgcggaatgcccatataaaatggcgaattgttttctggcagcgaatagcccacgtaacaggtgccgggggcgataaagaacacatgcaccaccgggcgttttgggctttcgtagttgagcagaatgttgctctcacgcaggctggcacgtaacggcacggtaaacttacggcagaatttggtcagctcttttgcctggttggtgtccggaacttcaacacgcagctctccgcctttctccaccacgccgcttaacatgccaacgatgggcgaaatgcgatcttcctgaggcagatcgcgcagcagttcaccgacgaccagcatctggcgggcgaaaatcaacgtgtcgaacggcagttcacggatcagcctttccgcatcaggctgctgataacattcaaacagaacataaccggcgtcctcttttacccgaggaaagccgtaaacgttatgctctgcagctttagcactaatttctgctgcacactctttttcaaagccggagcggcaatacagtaaaactttattcatggcgttctgccttggttttaagacgcagcgcgccaatcaacatcaatagccagccagtcaggaagaacaatcccccgacgggcgtgataaagacaaaaaacgttaaatgcgacagcgccagcgagtagaggctgccgctgaacaatacggttcccagcgccatagacgcactgctccagtaaaaccagatgttacagcgatacagcatcgccgcccccagccccagtacagccagcgtatggtaagcctggtattccagcccggtgtgaatccaggccatttcagtggcgcccagcgttttattcaacacgtgagcaccaaaagcaccaaatgccaccaggaaaaaaccgctgatggccgcaaaaataaacatggcacgtctggacatcaacctatcctcaaggtgcgtttgcaggtccctgcaaaaaaatcaaaaacattactgatcataacgaaagcggaatttttcttgttcggttgccgctttggcgagaatccactgtcgaaaggcggctattttacccagttctgcctgactgtcatgacaaaccagataaaaagcatttttgctcaccaaaacgtcattaaacggacaaatcaaccgtcccgcttcaatttcgctttgcgccatgacgttattggctaatgccacgccctgtccatgaatagccgcctgcagcaccatggcgctgtgactgaaaatggggccctgttgcacgttgatgtgctgaacgcccaactggcgaatataggactgccagtcgcggcgcgaggcatcatgtagcagggtaaagcgggcaagatccatgggggttttaagcggattctccccggtcatcagcgacggagagcacaccggcagcaggtattctgcatagagtttctctacccgcagtccgggccagttgccccggccatagaaaatcgccacatccacatcatcagccagtttctcttcatcccggtccaccgcctggatacggacatcaatgcccggataagccatattaaagctggaaaggcgcggcaccagccattgaatagcaaaactcggcagcaaactgaccgtgagcgcgcctttagcactgcgtgcctgcagtttgcgcgtggcttcattgagggcagtgaaaatttctttgatgtccaggtagtagctttgcccttcttccgtgagcaaaagcgaacgattcctccgcctgaacagctttaatcccagaaaatcttccagcgatttaatctgatggctgacggcagcctgggtgacaaacagctcttcagcggcttttgtaaagcttaaatggcgtgctgcggcatcgaatacccgcagtgcattaaggggaggaagacgttttgacatggttttccgtagccagcctggcaaaaaatacgcgaactaatacaaaggcattacgtattagaatttataatccgagacattataaattgtccgttgaggaagctccagcaaatacctatagttgcgctacttccagagccggaacgaaaagtttttagatttgtgagtgagttcgcagattttctgaaaacttttggcttgtggtcgtgatgttgtgtttgcaattttgatctgacctttacagatcaagctttttaattcctgtagatttaccctgtctgtccattgtgatattgagtagcaccgcaaattgcggtgctttttttatgcgctgactacttcgtttcaaccatctctttcacatctgaacggttaatttgctgctcattgccattcgcatctttatagctgatcataccggtgtcagtatcgacctttggtttgccttctgcgacgatcgtgcggccatcattggtatgcatcacgtagttgcttgaacaggcagccaaagtaaaggccattgtacaaacggccaacattgcggcgagttttttcatcttctatctccttgcagattgattgcaccaaaccccccgcgttacgctgaccaaagagacggtcaagtgggatcgactgtaagtatgtcgtatcgccatgcgggttaagtttataccttgcaatactcagcataacccgcttttccagctttgccagacagatagccatctttcagccttaatctgaaaattaacaacctatgagccacgtatgagcgccttcaatccttcttcatttcgtcagcagtttccagcgctaaacgatgccggtgtttatctcgacagtgccgctaccacgctgaaaccgcaggcggtgatagacgcgacgcagcagttctacagcctgagcgccggtacggtccaccgcagccagtttgctgccgcacgccagctgacagcccagtacgaacaggcgcgtggcacggtggcgcactggcttaatgccgccagcgatcgccagattgtgtggacgcgcggcaccacggaggcgattaacctggttgcccacggctggttagccccgcgtttacaagctggcgatgaaattattgtcagtgaagcggagcatcacgccaacctggtgccctggctgatggtcgcccaggccagcggtgcccgggtggtgaaatggccgattgggcccgatcgcctgccagatatgtcacaactgcccggattgattaacagccggactcgcctgttggcgatcggacagatgtccaatgtgaccggcggctgtccggatttagctcaggttatcgcgctggcccacgcggcagacgtaaaagtcatggtggatggcgcgcaaggtgtggtgcattgcccgccggatgtgcaggcgctggatattgatttctatgccttttccgggcacaaactttacgggccaatgggcatcggcgtgctgtacgggaaagccgaactgctggaagagatgattcccttacagggcggcggtaagatgctgacgcaggtagattttaccggttttaccccgcaaccggtgccctggcgttttgaagccggtacgccaaatgttgcgggtgtgaccgggttaagcgctgcgctcagttggttgcagcagcttgatatgcgcaaagccgagatgtggagtcagcagttagccagccttgccgaagagcagcttgctgagctgcccggctttcgaagcttccgctgcggcagtgccagcctgctggcctttgatattcagggcattcatcacagcgacatcgtgacgctactggcagagcacggtatcgccctgcgagcaggccagcactgtgctcagccgctcatggcggcgttaggcgttgaaggcacgttacgcgtttcgtttgcaccttataataatcttcaggatgtggatgcgctgctgcgcgccatgcacagcaccatcgcattgctatcggagttttgatgatgaccgcccccctgttagcgccccacccgttcggtgtggaaataaccccggctgatttgcaggcaaccttttcccgctttcatcagtgggaagatcgctaccggcagttgattttgctgggtcggcagttgcccgctttacccgacgcgttaaaaacgccggatattgagctgagcggttgtgaaaaccgcgtctggttcggcagtcagctgtgcgaaaagggtgctctgcacttttatggtgacagcgaaggtcgcatcgtgcgcggtttgctggccgtgctgctgaccgcggtggaaggcaaaacgcccgcgcaattgctggcgtccgatccgctggacctgtttgaagaactgggcctgcgcgcccagctcagcgcctcacgcagcagtggcctgaaagcgctggctgacgccgtgcaacaaagcgcacagcggttgctgggttaagcctggcgcgccgcgcgcgccaggaacttcttcagggcatgggataccgccacaaagccgaaggtggccgtcaccatggttgccgcgccaaaccccgattcgcagtccattcttttcggcccttctgccgtgctacgtgaggcgcaaaccgtgccatccgcctgcggataaaccagcgcctcggtagaaaacacacagtcgatgcccagcttgcctttgctgttctttaccacacctgactgcttcagacgctcgcgcagtttggccgcaagagggtcctgaatcgttttggccagatcgctcacctggatttgcgtcggatcgatttgacctcccgcgccgccggttgtgatcagtgggatcttattgcgccgacaccaggcaattaacgcggccttggggcggacgctatcgatggcatcgatcacatagtcgaaatcggccgccagcagcgtggccgtgttgtctggagtaataaaatcatcaatgcacaccacctcacaatcaggattaattgtgcgcaggcgatccgccatcacttccgttttggctttgcccacgttgccgctaagcgcatgtatctgacgattggtattggtgatacagacatcgtccatatcgatcagggttattttgccaatcccggtgcgcaccagcgcctctgcggcccaggagccaacgccaccaataccgatgacgcagaaatgcgcatcggcgaacagctgcagcgcctgcctgccataaagacgtgccgtaccaccaaaacgctggtgccaggcatcgtttaacactttcataattaaacctgttacagagtgcgggccagcgcgcccgcagcatcaagaattagttagcacctaacagcatggtgccgttgttaccgctctgagcattgctaaacagcggctgcccagcgccaggcgcagacttcagcacccacacgcgaccatagtggttatagaaaccggcaagatgagcagcatccggccctacgccctgataaatatcgaagtgctgacctttaattgcaccacccacatccagcgccaccatcatccgcatctcatatttaccgttgaatttgcccttttcattcagctgcggcacttctgccagcaacaccgttccggcaggaatcagtgaacgatctgatgccacagaggctttcgccaccagcggtacagcgctggcgccgcgtaccggcacgtaggattcaggtttgaagaagacaaatgaaggattggtttctaacagcgcacgcacttcctctggggaatgctcatccgcccactggcgaatcgcctgcatggacatgtcttcacgcttaacttcgccacggtcaatcagctctttaccgatgctatgataaccccagccgtttttcccgccataaccaaaaaagctcatcggacgaccgtcgccgaaatcgacgtagccactgccctgcacatccataatgaagttatcaataagtgaattactccaggcaatcacataacgatcgtctaacccaccactatatatagaagaacgactgggcagcttttgtccgcgtttgcgtggcggcatccggtaaatagggtactggaactcgccctgtcgcgtgtagcgcgcctcgaccaccggtgtgtaatagcccgtgaactgcacgttgccgtaattatcggtgccttccatctgaaacgcattcaaaccaaactgccgcagctgacgcgtatcgccaccggctatcaaccagttctcgaccgcactgtacgtactgttgttgcgaccaaacagggcagatgacgtggactgaatctgccgcacctgttcgccaaaatctctgccattgaccggacggcctttggcgttgggttgattgaccagggcaaggggctgctccagtttaccgtctttatactgttgaccccgatcggttggcttagaactacagccagccagcagcgctaaaaatgcgccagtaagtgcatacttcgcccaatgtcctttcatcttcatctctttttatgactgttcgccacgcgacgatagcaaagccgtcatcataatgaaatccatcctgtttggtcataatggatatcggttcaataaatcatcaaacgggggaatccttcagcaattaacagcaaatttagccttttagggcaaaaaggggttgcaacaatcatcgtgcggagtatagtgcgcatccacggacgcggggtggagcagcctggtagctcgtcgggctcataacccgaaggtcgtcggttcaaatccggcccccgcaaccaattcttctgtgatagtgctcagacagaagaaacaatgtgaaagtcgctatgcgcaatcggacgcggggtggagcagcctggtagctcgtcgggctcataacccgaaggtcgtcggttcaaatccggcctccgcaaccaacgcttctgtcactttgctcagacagaagacacaatgtgaaagtcgctatgcgcaatcggacgcggggtggagcagcctggtagctcgtcgggctcataacccgaaggtcgtcggttcaaatccggcccccgcaaccactttaaacacctgaaagggtgtttttttgtatctgaattccgctgaacgacacaagcccaccgctttcccccttttaatctcttataaaaacgccccatcagaccgaaggttattcgtgccgcaggtattgctctggccgatacatttctgctttcatgattcattcggacaccaaaaggtctggtatgaataatctcaatattgctgctctgacagctcagtacccgcaggtcgcggagttaatcgcgctcaacgaaaccacctggtttaatcccgccacgaccagcgtcgcggaagcccttcctcatgttggcctgacggcacaggatgtgaaagaggcgcacgatcgtctgaaccggttcgcgccttttatagcgcaggcctttccggaaaccgccgtcacgggcggcattattgagtcagagatcgtcgccatcccgacgatgcagaggcggctggaacaggcatacggacaaaaaattgcaggtaagctgttattaaagaaagacagccacctgccgatttctggctcgattaaagcccgtggtgggatttatgaagtgctgactcatgccgagaagctggcgctgggcgcaggtttgctgaccagggaagataactacagcaagctactttcccctgccttcaggcagttttttagccagtacagcatagccgtggggtcaaccggcaatctcgggctgtcgattggcatcatgagcgcccgcctcggctttaaagtaactgtgcatatgtcggcggacgcccgggaatggaagaaagccaaactgcgcagtcacggcgtcagagtggtggaatatcaacaggactatggcgtggcagtcgagcaaggacgtaaagcagcagaatctgacccggactgtttctttattgacgatgagaactcccgcacgctgtttctgggttatgcggttgccggacagcgcctgaaggcacagtttgaacaacagggacgcgtggttgacagcaaccatcccctgtttgtgtatttaccctgcggcgtgggcggcggccccggcggcgtcgcctttggtctgaagctggcttttggtgaacacgttcactgcctgtttgccgaaccaacccactctccctgcatgctgctgggcatcattaccggtttgcatgagggtatttcagtgcaggacatcggcatcgacaatatcacggcggcagatggactggcggtgggtcgggcttccggctttgttggccgggccatgcagcgcctgctggacgggctttatacgcttgacgatcaaagtatgtatgacatgctgagctggctggcgcaggaggaagacctgcggctggagccttcggcgcttgccggtatggctggcccccagcgcgtctgcggtgccgcggcttacctgcaactgcacggttttaccgcgacgcagctggaccaggcgacacatctggtctgggccacgggcggcgggatggtgccggaagacgaaatggcacgctacctggcgaagggccgctgagcacccgggcagccctgctgcgccccgaaacggacatcgggatgcgcgattacgcacgctgcatccgggcctgacgcgcctttcaccgcctgacggcaggccgggaaacgcagtagcagcctgtttcccccggcctgcgactcagcggtgagccagggcggcaccgcttttgaaataggctttaatcccttccagtatcgcctctgccacctgatgctgatagcgcgtggtacgcaacttacgctcttcttccacattactgatgaacgccgtttccaccaggatagacggaatatcgggtgccttaagcacggcaaagccggcctgatccacggtacgtttgtgcagatgattgatgcgccccagacggtgcagcacttctttgccaaacttcaggctgtcatggatggtctggcgctgcaccatatcaaacatggtgtgatccagatagcggtcgccactcatgctgacaccgccaatctgatcggcttcgttctggctgtgcgccaggaaacgcgccgcagcagaggtcgcgccgctggtagaaagggcaaagactgaagaaccgcgcgcggcccggctggtgaatgcatccgcatggatagagacaaacaggtcagcacgttgcttgcgcgctttggcgacgcgcacccgaagcggaataaacacatcttcgttgcgggtcatgtaagccttcatgttgcgctctttttcgatcaaggttttcagccgacgaccaatcttcagcacgatatctttttcgcgggttttgtatttaccatgcgcgccgggatcttcgccgccatgtccaggatcgatcatgatgataatgggtcgatcgcgtccggctttaccgggtaaaggcttctgcaccgtctcatttttttccagatcgccctggttgtaatctttaagtaacgccagtaaaggatcatcttcaaccatatcctgactgggatagagatcgaccaccagtcggtgcttgatggtggaaaccggggcaaggctgaagattttaggggaaacgttacgctttagttccagtaccacgcgcacggtgttggcatcaaactgccccactctggcgcttttaataaaaggatcgtcaacgcgcacgtgcttattcacgctctttagcaccgcgttgagatgcaagccatcaatatcaagcaccagtcggtcaggattcgtcagggcaaactgcttgtatttaagtgcgacgttcgattccagcgtcatacgcgagtaggttgaagagggccagatgcgcaccgccagaatatgacgggtggcagccatactcacgccactgacgctgagcagtaacagcgcccccgtaccttttaataatcgtctacgtgaaaccaggggattaccttccgacatgccactccagctgttatatagtgtttaaaaaaacggcagccaaataaaatggcggcgaaaactttatccaatcctccaggtaatgtcaccccggaaaccccaaataatgcaggctgttagcggcattagcatcaagaaaaacgtaaattatcgtcaggattaacgcttgcaaaatggcagtcaaaagcataaaaatacacaaaatacgaataaacattcactgagggttagccgtgaaggaacgtagtactgaactggttcagggttttcgccataccgttccctatatcaatgcgcatcgggataagacattcgtcatcatgcttggcggtgaggccattgagcatgagaatttctccagcatcgtcaacgatatcggcttgctacacagccttggcatccgtttggtcgtggtctatggcgcacgtccacagattgatgccagcctggcggcacatcagctggaaccggcttaccacaaatatacccgtgtcaccgatgcatcatcgctggaactggtcaaacaggcggcaggtcggttacagctggacatcactgcccggctctcaatgagcctcaataacacgccgctgcagggtgcacatattaacgtggtgagcggtaactttattatcgcccagccgctcggcgtggatgacggggtagactactgccacagtggacgcatccgccgtattgatgaagaggccattcatcgccagttggataacgatgccattgtgctgcttggcccggtcgcggtgtcagtgaccggtgaaagttttaacctgacgtccgaagaggttgccacgcagttagcgattaagctcaaagccgaaaaaatgattggcttctgttcagaacaaggcgtgatcgatcgtgaaggcaacatcgtctccgaactctttcccaacgatgctcaggcgcgtattgatgaaatggaaagcgatggcgattttctgtcgggcaccgtgcgctttttacggggcgcggtaaaagcctgtcgcagtggcgtgcgccgcagccatttaatcagctaccaggaagacggtgcgctgctgcaggagttattctcgcgcgacggcatcgggacacagatcgtaatggaatcggccgagcagatccgccgggcaaccatcaacgacatcggcggcattctggagctgattcgcccactggaacagcaaggcattctggttcgccgctcacgcgaacagttggaaatggagatcgataaatttaccattatccagcgcgataacctgaccatagcctgtgccgcgctttatccgtttatggatgaaaagattggtgaaatggcctgcgtcgcagtgcatccggattatcgcagctcgtcacgcggtgagctgctgctgcagcgcgtcgcgcttcaggcacggcaaatggggctggagaaactgttcgtgctgaccacgcgcagtattcactggttccaggagcgcggctttacgccggtggatattgagtcgctgccagaaagtaagaaagagatgtacaactatcagcgccgttcaaaggtgctgatggccgatttaacctgaccgtcaaccgggcggccatcctgccgccctgcttattatgcctgcccggcagcctctaacctttccaccagtccactgcgtcgctgagtttgcagctgtacggcacgttcaaatattgagcgatcgctgtaaatggtcagctgactgcgcgcgcgcgtaatggcggtataaaccagctcgcgagtcagcaccggcaaaaactgagtcggcatgaccaacgcggtatggtcaaactcagatccctgcgacttatgtaccgtcatcacccatgcggtttcatgggacggtaaacggctgggctgaatcgctttgacgctgccatccggcaacggaaaaaacaccctgagctggccttcttcgtcacgtaaagtaataccaatatcgccgttaaacagcccaagcgcgctgtcattgcgggtgatcatgaccggacggcctggataccagcggctgcccagcgcaggacggcgaaggcgctgcagctgcatcagacgttgctctatgcgctgattcagtccgtgtacgccaaacggcccttcacgcagggcacataacagctggtagcggctaaatgccgcgatggcctgttccggcgcggcctgctgctgcacagcgtgcagatatgcctcatagccccgcgccacctcgtccagcatcgcctgataagcgtcgccgtcattgagcggctgaaaagaaacgtcgtggtgccctgcggcgaaaacagtcttcatctggcgcgcatcgccctgattcaccgcccgggccagttggccgattccggacttctcatcgaaacgataactctgccgcagcaggcaaatgctgtcgcgtaccgcgggtgcagcctcggtgtcgttgcccacaagcgtacaaccggtaagggttgtcagttgcaaggcccgggaagcgctaaaccctgtttcgctacagcggcaaatgtcccccagcactgcgcccgcctcaaccgaggccagttgatcgcgatcacccagaaacaccactctggcgtgatgaggcagggcggaaatcagttttgccatcatggtcagatcgaccattgaggcttcatccaccaccagcacatccagatgcagaggatttcccgcgtgataacgcaggcgctgcgtgtcgggttgcgcgccgagcaggcgatgcagcgtcgtcgcttccgcagggaaacgggcgcgctcttcctcgttcaccgccagcccctgcagagctttacccagcgactccgttaaacgggccgccgcttttccggtgggtgctgccagctgtatgcgcaatggcagcgtattcagtcgaatcagcgcagccagcagttttgctaccgtcgtggttttaccggttccgggaccaccggaaatcacggcggttttgcgcgtcagtgccacagcagcggcaatcttttgccagtcatcaggaaggctgccaaacaggtcgtttaacacctcactggcgcggtgcgaatcgaagcgtccttcgtcgggctgcaatgagaaaaagcgcgcaacctgcccttcgctctgccacagacgatgcagatacaaacgctgattgctcagcaccagcggggtaacggcactgccgtcgctgactgccgaccagcccgccagctgcgcatgcagatcgtccggtgcgcctgcagcctgccacagagcctgggccagcgcaggctgacgacctgcaaacaaccctgcctcgctcagattagccagcggcagacagacatggccttctccggcatccgcactcacgcaggccgctgccaacagcagaaaaggctgagtttcatccgcgattaagcgggcaaactgaatatccagaggacgcagtaaacgcttttcgactgcctggagcagcaaggcgtttatatcactcataacatttcctctgtgttgccaaacaacctatccatctcatcaataaacgccgggtcgggtcgggtcgcgaaaatgccgttatcggcagagctgccgtccatgccgcgcagaaacaggtaaaataccccgccgaaatgctgttggtagtcgtagcctgccagccgatgctgcagataacggtgcaacgccagggtatacagctgatattgcagatcgtaccggtgatcgatcatggcctgctccatcgcttcgggcgtgtaagcggcatggctttcacccagccagttggatttgtaatccagcagatagtatttcccctgccagcggaacaccaggtcgataaagcctttcagcatgcctttgacctgccggaaatccagcgtagcaccgcgctgcgacaggggatcgtagcggcgcaccagcgcatccagatcggctgcagtcagcaaattgttaatcggcagatagaattccatttcgataagtcggtcactgctgttgatactggccagcgtcaggccttctttgttaagcggcgtcgtcagcacgcgcgcaatccactgctgaatgaccggaagccagctcagcggatagccattttgctgcagctgatcttccagccagatcgcgtctggcagttcggtaaaatcaattgattcaaacagcccgtgcagaaaagtaccaggtgcggcgccgcgaggaaaatggtgcggcgttaacagagcgtcttcatcgtctgccgcttcacctgcggcatcaatatcaaatctaggtaacgcatccagcagcggtgagctaccgtgctgctgtaatcccgaataactggtgacgcgccagctgtctgccagcgcacgcgtcatttcccgactactcagcgcatcgtcacgaccttcgccttcatgccagatcgcgccgggctggagttcgctgcttatgacctcaatgcccgccccctcaagcgcctgcagatgctggctgagctgtgcggcatcggcagtttcaccgcgctggaccagataaccgagcgcgcttttgtgcagatcgctctcgccttcttttttacgtgcccctttgatcagcggcgcaatgcccacgctgcagtggtacaccgagcgggtaagcgccacgtaaagcagacgcaagtcttctgccagccgctcctcttctgccagcgacaggctttgctcatcgccctgcacgtccagcatcgcggcaaagctttcgcgatcgtgatacagggcgctggcggcctcgcggaagccggcggcaaagggcagccagaccagaggatactgcagccctttcgatttatgaatggtgacgatttgcaccaggtggcgatcgctttccagccgcagctgctggctggaggcctggttgtcgggacgggcaatttgctgcgccagaaaacgcaccagcgcatgcgtgctgtcgagttgtactgccgcttcctgcagtaattcccccaggtgcatcagatcggttaagcgccgttcaccgttgtctgacgccagcatattttcggccagctgccgcttgatcatcacgtcacgcagcatgggtaaaacaccacgctgatgccagatttgctgccagctgacaaactgctctaccagcgcatcccagtcgcgttcgttctgcgtcagagcgtccagttctgcggcatcaatcgcaaagatggatgtcgccagcgcgctgcgcagtaatcgctcctgctcaggcgactgaaccgcctgtaaaagccacaacagctcacgcgcttcgggcgtagtgtaaacgctgtcgcgactggacagataaaccgagggaatcgccaggctgttcagcgcatcgcggatcaggctggcctcggtccggctgcggaccagcacggtaatgtccgatgctttaaccggctgtagggcatcacctttgccaatctgcgcctgtccctgctgtcccgccaccagccagcggctgatgtctgcagcacactgctgtgccataaattgttggtaatcacttactccaacgccttctcccggctgaagccagaagcgtaaggcgggctgcggctgttgctggtaaatcagtttcaagtcctggttgggcgcagccggactgaccgggagaaaagggatcgaagagaacagaaacggcgcatcgacctgcgaaaacaaccggttaacgctgtccaccatttctggggacgaacgccagttggtatctaatgtgtagtgagcactaacttcactccgggcgcgcagataggtaaaaatatccgcgccacggaaagcatagatagcctgcttgggatcgccgataagcagcagcgctaagtctggctgatgaatatacagcgtgcggaagatgcgatactgctgtgggtcggtatcctgaaattcatcgatcaatgccaccggaaaacggctacgaatggtttcagccagaagcaccccgcccggctgctgaagcgcctcatccagacgacttaacaggtcatcaaagcccagtaatgcacgctgacgcttctcacgctggactgcttcgcggacctccgtcagggcctgccagataatgacatcgcgtaacgttagcggttctgccaggaaccgatccaccgcgtcaaacagggaatgctgtggcgcctcgccctttttcgttttctcatgcagcacctgctgtccaaagcgctccagctctttgggatactgataatcaagcgtctcactctgtgcccactgcgtcactttggtaacccagttaggtaagtgcttactgctataactgcgtttatcaacgccagacgcggtaataatgccttccacatcgtcgctggcggcctgccactgctgcttaagggcgttgatacgctgaagattggccgcatgacgtgaggccagggtttcatctgcacgaggcggatgcctgagcgttggcgattccccctgtagccagggtcgtagcgtggtcagcaaactgtctggcccgctccactccgccgcaatcactctggccacatccagcgacagcgggtaacactgacgacgccagaaatcggccgtcgcctgccggagcagggtttgttcgttttcaatcagctcctgctcgaacagcatccccgattcaaacgcgttcaggttaagcatgcgctgacagaagccgtggatggtgaaaatagccgcttcgtccatttgccgctcggccgccagcagctgtgacgccgcctgtggcaggtcagggatttgtgcaatcagctgttgatgcatcgggttttgacttttaccgcgcacgcaggccagccgtagctgatggatattgtcacgaatacggccgcgaagctccgccgtggcggcttcggtaaaggtcaccaccagaatttcttcgacggacagtggcctgcgccaggcatactcaccgcccaaccctaacagcaggcgtaaataaagcaggccgatagtgaacgttttaccggtccccgctgacgcctcaattaatcgctcgccgttcagcggcagcgttaacgggtcaagtgactcgggccttgactgcatcattggatttcactctttaccggcagcgactgctgcagtttggcgatttcctgccaggttctccagccaggtagtggagcaaattcaattttgcgctcgccgctaccagctatctgcgacgtcattgccatcccttttttctgcatcacggcctgatgaaagaaatcggccagaccggctggcgtaagcagctggacctgctccatcagcttttgccgggtatcaaaatcgtagttctggcgatcaaaatcacggctaaaacgatcggcttcttcatttagcgtttgcggacgctgtttaagatcgttgagcatcgcctgctggtactgggtaaagtcggcctggctcatcgtgcgaagccgctgctctgcctgcggatagaatgcctgatagcgctgcatcagataagcgggctgcttgctgttactttgcaacagaaaaccgattccccactggcgtcctactggcatccggaaggcaaacacggcatagcccagttgctcttctgtacgcagctggttgtaaaaccagggctgcacgatctggctgagcatcgcgctgttcgccatgctttggtattcgtcatagcccaggggaatatagagtgccgccagcgcagagtctgtgctgctaccgtgctgttccagattcgccttcagcggcttttcaacgctgaggtagttgctgtgccagtagtgaatacctccacactgcatctgttgtttcagatcgcgccccagttgggtcacgctgtcggcgctgagattgcccaccgccatcatttccggcgtggcatttttaattaacgcatcacggtaggctaccacctcatccagcgtaatgccgctcaccagtttgcgtcgtgtctcgcgctgggtgtaaggcagttgcgataacagctgcataggctgaatcgcctgctcaaaggctttgcctttttcggccgcatccagccgctccaggtaccaggatttggcctgctcaagctgagattcactgggccggaaagtgctgtaacgatcaactaactgtttgagtaatgcgggcaggcgttgcgtaaagccactggcgttaaagaccaggccatcgttttcactggtcgagaaactgatcccgccaatcgacgcctgcgaactcagctcatccagcgcgaggctggccagatagtcgttcagaccaaacagcacctgttggcgcgcatcgctgatggcctgctgatttcgcagcgcgacggtaatgctggctttgggttcactgctatagaactggcttggcatccagtaaatgcgcataccgtaatcgttatccagcttcaccggatggcggtagaccttgtccccggtagcaaccagcgagaaatcatcaggaatgtagggattcagtacgggcatcgcgaattgcatgtcacgcccgcgctgctgccactgggtaaacgtctgagcggtgatcttatcaacctgataaggcgcgttgacaaaataggccagcttgttgtgcggttcctgtgggctgatgtaccagatgcgtgcattctgcggcgtcatgctgttaagacggccctgaatcgcctcagcatcatactggtcggcaaggtaaggcgcatccagcgtgtgctccaccggcacacgcagcattgtatcggccagccattcgatataatccatattgcgcgtgatggagggataacggaaatccagcgccagaacacgggaaacttcgtcgaaatagcggcgatcgatgcctttttctcgcagcatagaaatgtagctaaagacggccgcaaccacatcatcgcgctgggcaaggcctttatcggttagcgacacgttgaccgtaaaaacgccgctgttgcgttcggtgacagggtcggcccctgcgctgacgccatcggccagcccctgtttttgcagccagtctgccagcgtatttgggctacggttgcccattaaatagccgatgagcgtgtccgttttgctgcggaagcgggcactgttattcgggatacggaactcgattttcaactgcttacggggttgtgcaggcacgtaatgaataataatgccctgctgtgcttccgtgacgaccggctcgctaatcgcggggacgctggcattgtggttcgccacccgaccaaaggtgttggccgcaatggcggccatctgcgccaggggttgattactgtagataaccgccttcatcagattggccgaatagtgaccatgataaaagtccagcagcgcctgatgcaggttactacccggcttatcccgtagcgtttccagattgcccccgtaaaagtgtgctgccggatgggccggattgatcgtctcggcactgacctgccccatgcgcaaaccgtcccgtgcgcgcgccatggtcagctcggcattgactgcgtggcgttcccggtcagcattgaccgggtccagcaacggctcagcaatcgcgtccgcaaggcgatcgacggcaggctccagcgcatcgttttccacttcaaggtaataagccgtgcgataggatgcggtactggcgttgtgactgcccccgtgcttcttgaggaagtcagccaggctgtcaggctgcggataacgcgttgagcccatcagcaccatgtgttcaaggtagtgcgccaggccaggctgttgcgcaggatcgtccagtgaaccaatcggcagcgttaaggccgccagcgacttaggtgcatccttgtctgataccagcagcacggtcatgccattattcagcgtgatcgcctgatactggcgcgaatcctgttggcttttaccaatggtactgttaacgggctgccagccggggccggtctcggcctgaaccgtaaacgccaccaggctgaacaggatggccaggatcaagcgtgcatgtgtgcgcatgtaaacctcttacgttacccaaaagccgccttgccagcgcatcgacggctgaaaatacaacaaacgtttttggtgttctcatcacctgtaaaggtgtgacttaccgatcgtcctgatgggcctgcagtaccggcaagtaccagtgctccgcggcctcggttatgcgctgtacatgagacgcgtccagtgccctgcacaaccgctgcaaatagggatcgctcccctcgccctcctgctgataaccgcccacccaggccgccagcaaactattacgggctttgagctgagtcgcctcatccgtcaggaactgttggctttttttatcgaaacaggcgttgagccaggcaccgccgcttttggtcagcagcattaagggttcccgcattccctgcagatagccttgcatgtagcgcgctaacgtggcgatggcgtcatccggcgtaacggcgtggaagcaccagtaactgtgctgtcggccaaatatccggcttctgccgttaccgcccagtgcacaataaactaaatgctcgagccacagtaataaaccatcattgatattcagcacgcccggacgccagcgcaacagaccatcgctctgcacctgggtcagccaaccggataacctgacgccgtccagatccagattgatctcccagctttcaccttcgctgcgttgactgctcacttccgccgccacctcctgcatctcttcgcgctgagcctgccagaacagctcgccaaaggcaccgtaaggtaagtttcctgcggcgcgatgatgtgcataaagacgatcggtgtcatcgcccgtcaccaatgcattcagtaactgggcattaatctggtaacgctccaggctgtccagggcaaaaggctcgctatcgggcagttcattttcctcaagccagaaactgacgcccagacgttgctgaaaccaggcccgaaccggatgacgccagaatcgcaggaactgctccagggcgagtgtctctacgggcggagtgagcaggggctggacaaaatcaggttgcggctggcctgtgccttgcgcagccgggagccactcgcgggcaaagctgcgtgccgtcgacgcgggctggaagttttccggcgcaaacggcatgcggctgtgtaaatgttccagatgcgccctgacccgcagtgcgctctcgtccagatccaggtcctcatccccgggcaggtaaaaactttgcccgatatactccagtaattcagtgaccagtactgagggatagcgttcggtgttgtcctggattgcgcgtccgatatagctgatatagagctgttgctgtgccgaaatcagggcctccagaaacaggtagcggtcatcatcacgtcggctgcggtcgcctttgcgcgactgctgctgcatcaggtcaaatcccagcggcgctaaggtgcgcggataaacgccgtcattcatgcccagtaagcatacgacacggaaaggaatggagcgcatcggcatcagggtacaaaagttgatttgcccggcaagaaagcgttggctgatgcgctgctggtccagccgaccgcgcagatcgtcacgcagcaataccaccgggatcggctcatcgaaacgtgcgtccatgccatattcaatcagcgccttccactgctcttccaccagcagtaatgcggcttcagtttccgtatcggccgtaaagaacgcattgagcagctcgcggcataaaggcagccaggcttccagcgggcgcggttcggacaagacctgacgccagtgattaagccgtgacaacagttcggccagatggcccgccagttcggccaccagcccgctcgactcatcgtaaggtaaaatgccctgccagtcgccatgctgactttccatcgcatagccaagcagcatgcgttgcaggccaaagcgccaggtgtgctgaccggtaactggcaaggacaatgcctcaacgctggcatcatccagcccccagcggacgccggactcacttacccagcgccgcagtaaacgcagtccgctctcatcaatagagaagtgattcgctaaggcgggtacgtccagcagcgccagcacatcctctgagacaaaacggctgtcgggcagcgccagtaactgcaaaaaagcgacaatcgccggatgcgcctggctggcccgacggtcagagatggcaaaggggagatagcgttcggtcggcgcattggcaaacacggcctgaataaagggcgcataagcgtcaatgtctgccaccatgacgataatatcgcgcgcttttaacccaggactggcctccatcagcgccagtaaatgatcctgcagcacttccacttcgcgttgcgcgctgtggcagacctgtatggcaatcgagcgatcctcggggtccagttgacgcttttgtccgctgtaggccagttcatccgccgtcaggccaatcaccgcgttgtcctgcaggttgagaagatcgtgctgcatgctgtgtagcaggttgtcttcttcaacatcgacaaaggcgtcaatttcgctgttgagatccatctggctgagcagataaagattatcgcgccccagcttgccccaggaggccagaagcgggttagtcagctgctgctcgccctgttcactgaacagcgcaggcgcgcgtgccgcgtcactaaacaatccacggtattcgtcccgatcgtggcggcgacgctggcgactttgtaacttcgccagaaaggcataatcctgaatgtcgccccagtaatcgcggcagggattcgtgaacagcaggtaaatatcaatgtggcggcccagcgcctgcaacgcctgcagatagaccggcggaagcgctgaaataccacaaataaaaacccgctcgggcaggttagccggggcggtctgcgcctgctccagcgtatgaataaagcgggcatagaggttggcacggtgccatttaggctggcccagttcctcggtgtaattcactaagtcacgccatagcgccgcctgccagatctgagcatcgcccaggccgtcaatgttttggccacgttcccagctgttcagccagtcggcgcgataaaccagatactggtcaaacaggtcagcgatacgggcgctgagctgaaacagcttgcgcttgtcgccatcgtcgctcaggtaatgacgcagcgaggcaaactcatcctggcgcagcagtgagggtaaacggtgcatcagtttccagctcatgctggctttactgaaggcgctttcgaccggaatgtccggcaggacgcgaacaaacatttcccagataaagctggccggtagcgggaattcgatattcgccgcaataccaaaggtttgtgccagttccatctgtaaccattgcgccatgcccggactctgcaccagaaccatttctgaggcgaagggatcgtcaagtgggtccagtttaatcactctggctgccaggcttttgagcagatcaagctgattagagtgataaacgtgaaacatgaaaactcctgtggaaaatcaaaacggcatagcgacgtcagagggtattcactctaccgcgtatcgcatttgaagcctaacaaaaggcggtgggcgatagcgccccctggcggttaacaggttacacgcatcaggctggcgtgacgttgatacggcccgcttacctcggctttttccagcacacagcccgccggcccctgggttttctctgaccgggattgccagcccggcacctcgcggccgagcagccgttgctctgccacgcgccaggcttcgcgttgttgccactgctgactgaatcccagcgtcagcacccggtgatactgcaacagagcgctggtgctgacggccatcaggagcagagcaaacagggcttccggcaggctgaaccctcccgcatcagaagcagtcttccgctgcggccagcgggcagtagtcaatccagccttgcggcaagggatgaagacggctgccctgcaccctgacccagtgccatgaggccatctcactggtgcggtcttcacctttaagcaatcccttatcatctgcggttctctgcaggcagctctgccagccatactgtttctcctgctggcaggtcaacgtctgttgttccggccactgtaatgtcagcccccactgcagcgccgactgcgcctgccagaatccctgaatgaaacgctgttcatcggccactccgctcatcccctgcgccagcatctcacggctggcatgcagcgtcaggctccctgtcagcataatgatcaacaccatgcccagcgcactgttgccctgcgccttcacaaattcatgccctcgacccagcgtgctaccgtttcgtcctgttgaccagcccggccctgcagcaaaatgttgatcaggcggccttcccgctgcacatcaaaggcttccacggagagaaaagcgggatcggacaagcgctcccatccaccgccgttacagttatccacaccgcgctgcatctccagctgtttttgtcgcagacgatagccgtaatagtcgctttcgctgtggctgatcccttcccagtgaccgttgctgttttcatcaacgcgaataagcagacagctctccgctaccgtcactcccccgctgccacattctccctggcaatatcccgccctgcgcacggctttttccagggtagacagtatttgctgcaactccaggcgcaactgcacccgctgttgcagcctgaggttttcacccagcagcagcggcataaagcgccccgccccgaccatcagtaccgcactgatggacatcgcaatcagcatttccagcaggctaaatccggccattttcattcacagcccgcttcatctgccagacacaggcgaatccgtgcccgtgaagagataatcagccgtattcgtcctgccgcattcaccagctcaatgctaccggctttggcaacgttgcggcgtccgtaaaaaccgggttcaccgcgcaacggctgcaaggcgacatccgcgtgcggcgcaataaaatgcagacgcctggcggcctcacagccgttgaccggtggttcggctacaccaacgcaccagggctgggtcgtgcgcgcccacagaataaagtcgcggttttgccagttggcctgcgcccgcacgctgagcagaaagttctgcagttgccgggcgctgtcccgtaactgttgacgctgctgccagcgttgccagccctgagtggcaaatgcactgagaataccgacaatcaccatgacaaacagcagctctgccagcgtgaaaccttttgacgtttgttttttcatggcagtagagtgcggtgtggcgggcggtctggcaaagtgaaaaaccgggaacgggaagcggcgctgcagaggcgtttatctggttgttgtgtttaaacaaaagtttgcgatcaacgccgcaatgttacgccagacaaacaataaaaaaccccggtatacagcgccataccggggttttttatggggcgagatttaaacggcaaccggcgctttaatcgctggatgcggatcgtagccttcaatctcgaaatcgtcgaagtgataatcaaacagcgacgctggcttgcgcttgataataagcttaggcaggggccgcggctcacgcgttagctgcaggcgagcctgctcaaggtgattgctgtacaggtgcgtatcgcccccggtccagacgaaatcgcccacttccagatcgcactgctgcgccaccatatgcaccagcagcgcataactcgcgatattaaacggcaggccgaggaagatgtcgcaagagcgctggtaaagctggcaggacagtttgccgtcggcaacatagaactggaaaaatgcatggcagggtgccagcgccatctcgtccagctcaccgacgttccaggcggacacaataatgcggcgggaatccggatcgcgtttcagttgttcaatcaccttggtgatttgatcaatctcctggccgcttgccgtgccccaactgcgccactgtttgccgtaaaccggccccagattaccctgttcatccgcccactcatcccaaattgagaccttgttttctttgaggtaaccaatgttggtatcgccttgcagaaaccagagcagttcatgaatgatggagcgtagatggcacttcttggtggtgaccagcggaaaaccatcctgcagattaaaacgcatctggtgaccaaaaattgaaagcgtgcctgtaccggtacggtcagattttggtgtgccttcgttcagcacgtagcgcattaagtccagatactgtttcatttttcctcgtgaagttgttgctgcgggcgacgacggtacgcccaaatcatcataatcacaccggcaatgatcatgggcagagacaggagttgtcccatgctgagtccaccggtgagcaaaccaagctgtgcgtcgggctgacggaagaattcgacaataaagcggaagcagccgtagccaatcaggaacaggccagaaacgctgcccatcgggcgtggtttacgaataaacaggttcaggataatgaacagcacgataccttcaagaaacagctcatagagctgtgaaggatgacgtggcagtacgccataagtgttcagtaatgcctgatattgtgggttgttggctgccagcgcgatatcttcgctgcgcgaacccgggaacagcatggcaaaacggaagttgggatcgacacggccccacaactcaccattgatgaaattaccaaggcgaccggcacccaggccaaacggaatcagaggcgcaataaagtctgaaacctggaagaaatgtcgtttggtacggcgagcgaagatcagcatcaccagaatcacgccaatcagtccaccgtggaatgacataccgccatcccagactttgaacaggtacagtgggttatcgagaaacaggggcaggttataaaacagcacgtaaccaatacgtccacccaggaaaacgcccaggaaacccgcgtaaagcaggttttctacttcctcttttttccagccactgcccggcttattcgcccgacgcaccgccagccacatggcgaaaacaaaacccaccagatacatcaatccgtaccagtgaagcgaaagcggtccgatcgagaagattaccggatcgaactgcggaaatgcgatatagccgttattcatcattcaccgtatattttcagccctgaaaaggggacgtgatgcacataaattagggctgggcatgatagcacagccagttttctgagtagccgcagaaatgtaacctgggttaacgcccaccccgaatcaggccgcccagaccgcgctcttccataaacgccgacaccagctgacgcacatctgacgccgagtaagctttgagcgcctgggtactgagtttctgcacttcttcgtaatccagatggcgcagcagatattttacgcgcgagacattcttgccgttcatgctgagatggtgatatcccatccctatcaagagcgccacacacatcggatcgcccgccatttcaccacacaagcataattccagattcgccaaatgggcttcaatggaaatggcctgcagcgcgcgcagcatcgccggatgcagtgaatcatacagattcgccacgcgcgtattgttgcgatccaccgccagtaaatactgggtcaggtcattggtcccgacagacacaaaatcgacgcgtgaggccagatgcgggatcataaacagcatggaaggcacttcaatcataatcccgatgcgcggcttcggaatcgcatagccgagcatctcttccacttccgtgccggcgcgttgaataaggcgtttggcctcgtcgatctcatcgatatggctaatcatcggcagtaaaatgctcagattgcctgacgcggcgttagcacgcagcatggcgcgcacctgcaccataaaaatctcgggttggtcgagcgtgagacgaatgccccgccagcccaggcaagggttctcttcactaatcggcatgtacggcaactgtttgtctgccccgatatccagcgtgcgcagcgtaaccggtttttcatggaacagttgtaacatgccctgatactgagcaacctgctcttcttcggacgggaagccgctctgcagcataaagggaatttcagtgcgataaaggccaataccgtcaacccaactgcccagcgtctgctcatgctccgggcttaaccccgcattgagcatgacctgcacgcgctgaccgcttctcagttcaccaggcctgtccacgccgccttcagccattttactgagggcattttcttcactgattaaccgttggtactcctgcaccagcaccggttcaggatcgatcagcagttcgccgcgatagccatcgacaatcagcagacgtttgtttaactgactgggctgaatgtccgcgcccatgacggtcggaatccccatcgcgcgggttaaaatggccgcgtgggagtttgccgcgccgtcgcggaccacaatccccgccagccgctcgtggggaatttccgccagcgttgtcgccgtcagttcatccgccaccaggacgaaacgctcaggccaggcgttgacgcccaccagagaatcatcgaggtgaaacagcaagcgctgccccagcacccgcagatcgcctgcgcgctctttcaggtagctgtccgtcaggctggcaaactgggcggcaaacttttcaatcacggttttgaccgcccactcggcgaccgatccgcgttcgatctcagcaaagagatcttttttcaaccgtgcgtcagttaacaggtgtgagtagaggtcgaagatcgccgcgctctctttctgcgcgctggcggtaaagcgtttgctgaagcgacgaaattcattggcggcttcactcatcgccagcgataaacgttcgcgttcacgttgctgatccagcgtcgaggcggcagaaacctgatcaagcagcggctgggtttcatccacccatcccggagcgacagcgacacctggcgcggcagcaatggcccgaatgcgcgccagacgatactgaccgaacaactgactcaactgcgattgagacagtagcgctgccagctgcgtggctaaggtaacgagaaacgactcctcgctttcatcaaactgtcgatgttcacgctgctgaaccaccaacacgcccatgagctgacggcggctgataataggcacgccaaggaaagagcgatagcgctcttcctttacagaagggatgtacttatagctgggatggctctgcgcatcggcaaggttaattggctcggcaagtcgccccaccaggcccacaataccttcatcaaacgccagcttgaccgttaagccacgcggttttttcaggccgcgtgtggccatcaggtaataacagcgacgttcgtgatcggcgaggtagacggaacaaacttccgtttccatcgccaggcagatctcattaaccagaatgtcgagtgcttcattcagacgtggcgcactcgccaccttttcaacaatttctcgcaactgagtgagcataaagggcgtggcctatcctcttttacgtcgatgggcaggatgatttcgctgcaccgcactctcctgcatggacatgacaacgccagcaaattctttcataacccgacgataaacatcgcgcttaaaagaaacaacctgacgtaccggataccaaaaacttacccaccgccagccgtcgaattccggcgtgctgctgtgttgcacattaatatctgcgtcattacacatcaactgcagaagaaaccacttttgtttctgaccaatacaaaccggttttgtgtcccaacgcaccaaacgttttggcaacttgtagcgtagccagttacgggtagaagcaagtattcgaacatctttgcggtgtaacccgacttcttcgaacagttcgcgatacattgcctgttctgcggtttcaccgggattgatgcctccctgaggaaattgccaggagtgctgtccaaagcgcctggcccataacacttgcccctgcctgttacaaattacgataccaacattcgggcggtagccatcatcatcgatcaccggactacctcaaaagctaaaattgaatggtctgattgtttcacactccttacaggcggtaaaccactggatttgcgggcggttacaggcgtaatactgggataactcacagactaatgcgaagttataaacaaaggacactaaaaagagcgatcttattcacgttttctgtggatagctttgtgcagaacgcgggagttaactgaataacatctcaggatacttcggaggaggctcaaaaccagattgtctttttcaattgaaatgtaagataatttttttgcagaacccgctttttacccactgaaaatccaccggacaaatccttcacgctgacaattggctaaagatccaccacaacgctttttatccacagcaatcggcttaagcttgcatcaaaacggccaattcttgtcaaaaactggcaaagtcaaggctgtaaatggaaccagtaggccgttccagccagggttatcccatttttctgtggataactgggcctgagatcctgttcattgttgatagcaagttgggataacctgctacattagtgagagcaggcaaatttcacttcaaaaaaaagtactatgtttcatgttattatgtgagttataccgcgttctttcctgtggaaaaccttaggttgctgcaggctgcttaattattaatcattatgagttattcacatgacattccttcccgggcaacctgaagatgaggcaacgttgctgtcacgcgcgcagacgctggcgggtttaacgctgcaaaccctggctgaacaggcgggcattccgatgcctgccaaccttaaacgggacaaaggctgggtaggtatgctgctggaattacacttaggtgccagcgcgggcagtaaagcagaacaggattttgcccatctggggatagaactaaaaacgatccctgtcgatcgctatggcaagccgctggaaaccacgtttgtgtgcgtcgcgccactcaccggtaacagcggtgtgacgtggcaaaacagccatgttcgccataagctggcgcgcgtcctgtgggtcccggtagagggcgagcgtgaaatccccttagctgaacgccgggttggcgcgccgctgctgtggagccctgacgcgcaggaagatgaaatgctgcgtcaggactgggaagagttaatggatatgatcgtactgggcaaggtggaacgtattaccgcccgtcatggtgcctggctgcagattcgcccgaaagcggccaacagcaaagcgttaaccgaagggattggcgatcgcggacagccgatcatgacgctgccacgtggtttttatctcaagaaaagctttaccggccccttactggcgcgtcatttcctggtctgacgacggcgttctcatgtccgatactgtatttaaaggtgagttagacaaatttggtgcgtataatctttgtttaattttcgtttaggatatgagtgcaggtatgttcgattggatttacgatcccaacgcctggctggcgctgggtaccctgaccattctggaagtggtgctgggcattgataacattatctttctgtcgctagtggtggcgaaacttcccaaacaccagcaagcccgcgcacgtcgtatcggtttgatgggtgccatgctcatgcgtctgggtttactggcctccattgcctgggtcgctaaactcaccaacccgcttttcacgctgatggatcatgctttttcagcacgcgatctgatcctcctgtttgggggattatttttgctgtggaaatccagcatggagattcatgaaaccattgaaggcgaggaaaccgagcacaagagcaacgttaactcgttctttggggcgattgtccaaatcatgttgctcgacatcatttttagtctcgactcggtgattacggccgtgggcctctctgatcatctgtttattatgatggcggcggtcgtcattgccgtgctcatgatgatgtttgctgcccgcactattggcgagttcgttgatcgccatccgtcggtaaaaatgctggcactttcgttcctgattttggtgggtttcaccctgattctggaaagtttcgccgtgcatgtaccaaaaggttacatttattttgccatgttcttctcaatggccgttgagtgccttaaccttatgcgcagtaagaaaaaagtgagctagcgttgtcaagggcggccccgcgccgccccgttattttcagattgatacgattaacccaatcggtaaaaggatttattactacactttttgctatggacgattcgtgaggataagcataatgaaagggctgattaaaattgtattactggccgttgctgcggtgacattagcgggatgtagttccaattatgtcatggcaacaaaagatggccgtatgattatgaccgaaggcaaaccgagtattgataaagaaacggggctggtgcagtacaccgatcagtcgggccataccgtgcagattaacagtgatgaagtctcgaccattattgaacgctagatgcgaaacgtatcagcctgtcgccactcccctcgtcggcaggctacttctctttgttgttcccctttgttacccgctacgcctcgcgctatagtccctgaagacagaatacttatccctacagaaaaggaagccggcaatgcattatcaccgtatcccccatagcacgctggaagtcagccagcttggattgggcaccatgacgtttggtgagcaaaacagcgaagccgacgcccacgctcaactggatttagctgtcagttcgggcattaacctgattgataccgccgagatgtatccggtaccgccgcgtcccgaaacccaggggttgaccgaaaagtatattggtagctggttaaaaaagaccggcagccgggataaaatcattctcgccagtaaagtcgccgggccgacgcgcggcaacgatgcatcgattcgccctaacatggcgctggatcgcaaaaatattcgcgaagcgctggacgccagcctgaagcgcctcaataccgactacattgacctgtatcagctgcactggccgcagcgccaaaccaacttctttggcaagctcggctatcaatacagtgagaacagcgtgcctgtcaccttgttagaaacgctggaagcgctggccgagcaggtacgggcaggcaaaattcgttatatcggcgtatcgaatgaaacgccgtggggcgtaatgcgttacctgcaactggctgaaaagcacgagctaccgcgtatcgtctctattcaaaatccctacagcctgctgaatcgcagttttgaagtgggcctggcagaaatcagtcaacatgaaggcgtggaactgctggcctattcatgcctggcctttggtacgctgagcggaaaataccttaacggtgcgcaacctgctggcgcgcgcaataccctgtttagccgttttacgcgttacagcggtgagcagtcgcaactggcggtggcggaatatgtggcgctggctcaacagcatcagcttgatccttcacaaatggcactggcttttgtccgtcagcaaccctttgtttccagcaccctgctgggcgcgaccacgctggaccagttacagatcaatattgacagcgccaacctgaccctcagcaatgaggttctggaagcgcttgaagcgatccatcgccgttatacctatcctgcaccttgatatgtactgccagccgtgctgttgcgcggctggcgtatatcggccatcgtctttccctttcccgacagcctgactgcgcgcattaggctcattccagcgccagcagttcctcaatgcgctgtgcgcgacgaatttcccgcggctcgccgttttcgaacaggatctcaggaatcagcggacggctgttgtagttggaagacatcgacgcgccgtaagcgccggtatcatgaaacaccaggtaatcaccgactttagcggctggaatcgcccgggtttccaccttgccaccttcaagctgggtaaagacatcgcctgactcgcacagaggccccgcgaccacgctatcgatcgtcgtttgctcgttgatagtccggttatcacctgccatcagagagatatggtgatagctgccgtacatggatgggcgcatcaaatcactgaagcctgcatccaccagcacaaagtgacggctgcccatctcttttaccgcccgaacctgcgaaaccagcacacctgactctgcgaccaggaaacggccaggttcaatttccagcttcacggcatggcccagatgttcagctacgcgctgacgtgcggcatcccacaggccaaaatagtgttcggtatcgatcgcgtcttccccatagtgatagggaacagacagaccgccgccggcagagatagcctcaatatcctgaccaaattgcaccaccagatcgaccatcgcatcgcagacctgctgcaggtgcgcatagtccacgcctgaaccgatatgcatatgaataccgatgaggcgcagtccatattgttcaatggcggcctgtgcagcaggcagatcgctgggccagataccgtgtttactgttttcgccgccggtattggttttttggctgtggccgtgaccaaaacccggattgatacgcagccagaccgcgtgtccgggagacacggcacccagttgatgcagcatgtcgacggagccggcattcaccggcaccttgagttcagctatcctggccaacgtggcgttatccagaacatcagcggtaaagacgatttcatcgctgttgggcttaaagcccgccaccagcgcacgctcaatctcgcccagggaaactgaatcgacttttactcccgcagcatgcatcaggcgcagaatgtgcgtgttagaacaggctttttgcgcaaaacgcaccacgtcgaaggcgtgcagttgggcaatgcgctgttgaataatctgcgcatcataggcccagaatggaccgttatactggcgcgctagcggcaataaatggtcaacgttgagggcagattcagtcgtattgagtggacgaggcatgaaattttctcctgtggcaataaagccattaagccagaatcgtgccatgccgaaaaatatctgttttaatagcatctatgcaaaaatgatatggaatagcccatggcaaacatcaactggcggcatatcgagatttttcatgccgttatgaccagtgggaacctcactcaggctgcaacgctgctgcaaacctcgcagcccaccgtcagccgtgaactggcgcgccttgaacggcagctgagtctgaagttgtttgaacgcgtgcgcggccgcttacaacccacggtacagggattacgtctgttcgaagaggtacagcgctcgtggtatgggctggatcgcatcatcgatgcggcagaaggattgcgccagtttcgccagggcgaactgtccatcgcctgcctgccggtcttttcccagtcactgctgccgcctgtctgtcagacttttttgcagcgttatcccgatgtcagtctgaatattattccgcaggaatcaccgctactggaagagtggctgtcggcacagcgttatgatctggggcttacggaaacgcagcatgcccccgccgggaccgttcgacaggcgctactgacctgcgatgaagtgtgcgtgttgccgcagcagcatcgactggcacagcacagcgtgctgacgccgcaggattttgccggtgagaactatgtcagtctgtcacgcacggacagctatcgtcagttgctcgacgcgctgtttcatgaacagggcgtgacgcgcaggatggtgatggaaacccacagtgcagcgtccgtctgcgccatggtgcaggccggtgtagggatctcggtggtgaatccgctgacggcattagattatgccgacagcggtgtggtcatgcgcccttttagcgtcgccgtgccttttactatcagcctggtcaggccgcaacatcggccagcatcggccctggtggaggcgtttgtgagccatctgcagcaacaggtggcccgttttccagagcagattgcgagcaaactcgcttaagcatgcacccgggccgccgtaccgcctgacttgcggaaggtgatcaggcaaacgatcagcccaatcgccgccaggccagcagcggcaaccggcaccgccgtcagtccatagccgcgcgcgatcactgcaccaccgacccacgcgcccagcgcattgcccacgttaaaagcggaaatattcagggttgaaaccagattgggggcttctttaccgtggcgcacaacattgatctgcaggccgggaaccgttgcaaaggttgccatcgcccacaggaataatgtgatttccgccagccacagcgcatggctggtccagctaaacagcagtgagaacagcgtaatcagcgaaaaactgccgatcaggctcagggagactttacggtcggccattttgccccccagaatattgcccacggtcaggcccgcgccaatcaggaacaacgtccagctcacgccacgatcgccaatgccggtaacctgcaacagcaacggcgcaatgtagctgaacagtgcaaacatggcggcggcgaaacataccgtcatcagcaatgacagccacagtttgccatttgccagcgcgctgatttcgcttgccagattgaccggcttctcgtttttattccccggcagactggtgatcaacgcgataaatgccagcacgccgatagccgaaacgccccagaacgtggcgcgccagccaaacagctgaccaaaccaggttcccagcggcacgcctaagacgtttgccaatgtgagaccagtgaacatcaacgcgacggctgaagcctgacgatcggcggaaaccagactggctgcaaccaccgaccctatcccaaagaaggcaccgtgacagagcgcagtcaccacacgtgccagcatcagtaagttataactgtaagccagcgcacacagcagattgccgatgataaaaatcaccatcaacaggattagcgttttcttacgcggcaatttcgccgttaacagcgccatgactggcgcaccgattgccacgcctaatgcataaccgctaattaaccaaccagctgacggaatggtcacacgcaaatcgtttgcgacttccggcagcaggcccatgatcacaaactcagtggttccgatggcgaacgcactcagcgccaatgccagcaatgcaacaggcataacactctcccaaaaatgataattgctgcgtgacaggtgactcacgcaatgttatgaacgagctataatttatgatctacatcacactgtgtattacagcatagctgcctgtcatctgatactcacataacaacaacaatctattgcgtaaatggcaataattgacacacactccaactacgcttattaaacatactgttagagaaagaaatactgctttacgcaccagacgttgagaaaggttgccagcgaagtagccgtttttttgctaataccgattttagttatcaataaagtattagcgttgccgatatagctcttatgaatcgccagatgaaatgcagtcctactgacgcggagagagaaaatgcaacggcttatcgttttaatggtaatcagtcttacgggctgctcagtcggtcattatgaatacagcagagaagctgagaaacgcgttgatatgaccgtgaccggcattccaaccgtgctgggtgtgggcacactgggtaccaccattccgttaaccccgaactacagccttacggcggcccacgtggcgaaatattcgctttaccgtgtgaaagcctggcatccggaatgcgatcttgcggtcgtgtaccacaaaaacagcgaagccaacctgcccccatcattccgtaacagccatatcggcgaccaggtgaatctttatggttacagcttcatctccgccatgcccgtgagctcaacaggcaaaaacctggtgaacacgacgttagccaatgactggaataaagcaaactgcgtggtcgtggctgccaatgcaggcgtggttaagggcatgtcaggcggcgcagtttataacgcctctgatgacaccctggctggcgtgattatcggctacagtcagcgcatcaacgataaccatagtggtaaaaccttgtataaagatgtggcgctgtatgtgccctacgcccgttttcagacctggctggatgatgctgtgaaatcttaggatttttcatccggcagtccgggatgcgtgcccatctgctgctgcggtgggttaagccatctgtctttgcgcgttgcctcgtagtcgcggttgagcggataagtaatgcgattctccggcttgctgacctcgccgaccaccagaaagcgcgcgtcggcgtcactgttattaataaaggtgtggcaaataccggtgccggccggaaaagccactgcatcgcccggtgacaacgggtagagttcgccattgatccaggcgtggggattgccttccagcacgtagataaactcttcttctgcactctctgcatgaggataagacatgcgtcgtccgggtcgtagcctttcatgatggatgccgagccgggttaagcccgacagttttgccagaggtgtaccaatggacatcagctcatcgctatcggaataatgttcgttgtcttcgccttccagcgcttgccagtgaagaatgcagtcaggacgttgcttcatgatgatcgctccaggttgagattgtcagcctggcagacgaggtgagattactcaagtcgatgcacattgtgaggcgtggcgggcagcagaaatgaaaaaggccggaatcacccggcctttaaccagcagctgataattactttgagccagggcgcaacgccgggaacaggataacgtcacggatggtatggctgttggtaaacagcataaccatgcggtcaataccaatgcctaacccagccgttggcggtaaaccatgttccagcgcggtgacgtaatcttcgtcataaaacatcgcttcatcatcgcccgcatctttcgcattaacctgctgcaggaaacgctctgcctgatcctgcgcatcgttaagctcagaaaagccgttaccgatttcacgtccgccgataaagaactcgaagcggtcagtgatttcaggattctcgtcgttacgacgagccagcggagagacttcagccggatattcagtgataaaggttggctgaatcaggtgcgcttcagcggtttcttcaaagatttccgtcactacgcggcctaagccccagcttttctcaaccttaatatgcaaggactgggcaatggctaccgctttgtcgaaatcctccagatcggccaaatcagtttccggacggtatttcttgatcgcctcacgcatggtgagtttttcaaacggcttaccgaagtcgaattcctgttcaccgtaaggcacaacggtgctgcctaacacgtcctgcgccagggtacggaacaggctttcggtcagttcaatcaggtctttgtaatccgcataagccatatagagttccatcatggtgaactctgggttatgacgtggcgaaatgccctcgttgcggaagttacggttgatctcgaatacgcgatcaaaaccgcccacgaccagacgtttcaggtacagctctggcgcaatacgcagatacatatcaatatccagcgcattatgatgcgtgataaacggacgcgccgatgcgccgcccgggatcacctgcatcatcggcgtttccacttccataaagtcgcgtccaaccatgaactggcgaatgccggccatgatctgtgaacggattttgaaggtgttacgtgagtcatcgttggcaatcagatcaagataacgctgacggtagcgcgtttcctgatcggccagaccgtggaatttgtcgggcagcgggcgcaaggctttggttaacaagcgcagctctgagcagtggatcgacagctcgccggttttggttttgaacagtttgccgcgcgcaccgaggatatcgcccaggtcccactttttgaactgctcgttgtagatgccttcggccagatcgtcacgcgccacatacagctgaatgcggccgcccacgtcctgcagagtaataaaagaagctttgcccataatacggcgcgtcatcatgcggccagccacgctgacctcaatgcctaagtcttccagttcttcgttactcttctcgtcatagctggcatgcagccgatcggaggtggtatcacgacggaaatcgttaggaaacgccacgccgttttcacgcagcacgctcagtttctcgcgacgcgttttcagttcgttatttaactcaagtgcaacgtcagcgctctgcggttgttgttcagacatgtcggttccttatagccctgcttttaaacttgcttcaatgaatcggtccagatcgccatccagcaccgcctgcgtgttacgcgtttccacgccggtacgcagatctttaatacgtgagtcatccaaaacgtaagaacggatctggctgccccagccgatgtcagacttattgtcttccagcatctgcttctcggcattttttttctgcatctcaagctcgtacagcttcgccttcatctgcttcatcgcctgatctttgtttttgtgctgagagcgatcgttttgacactgggttaccgtaccggttggaacgtgggtaatacgcaccgccgattccgtacggttaacgtgctgaccaccggcaccggaggcgcggtaaacgtcaatacgcaggtcggccggattgatgtcgatatcaatatcgtcatccacttccggatagataaacgctgagctaaaggaggtatggcggcgaccaccggagtcaaatggactcttacgtaccaggcgatgtacgccggtttcggtgcgcagccagccaaatgcataatcgccagagacgcgaatagtgacggacttgatgcctgccacttcaccttctgactcttcaataatttcagtcttgaaccctctcgcctctgcccaacgcagatacatgcgcatcagcatgctggcccagtcctgcgcttctgttccaccggaaccggcctgcagatcaatgtagcagtcggcgctgtcatactcgccggaaaacatacgacgaaactcaagttcaccgagtttaccttccagcacgtccagttcagccacggcttcgttgaaggtttcttcatcgtcagcttctaccgccaggtcaagcagcccctgcacatcttccagcccctggttcatctgatcgagcgtattaacgatggcttccagcgaggagcgctctttacccagcgcctgagcacgttccggttcgttccagacgtcgggctgttccagttctgcgtttacttcttcaaggcgttctttcttggcatcgtagtcaaagatacccccgaagaacgtcgctgcgctcgctgaggtcctgaatacggtatttgaccgggttaatttcaaacatgtgtttagcgtcttttttacgttcgatggaataagaaattcagcctgcgagtttacccgaaaccgacggcagtttgtagcgttgagaaaatgcgcaggtcttaatctttcggctcagtcagatggactggctaagccgaaacgggcgtgacgatggtaatcatgacgacagggggaacagtgccgcgcaacccgcctgcccggctagctgagcggccagaggtgttcaacaatcagttgcaccgaccggttaccgcggtactcattgatatcaagccggtacgcgagttcaacctgacgcacgctgctgtcaggccaccgcgtggtatccacgttgaacgcgataccgtcaatcagcggcccgccttccagcggctcaaccatcagcttcaggtgacgttcaccgaccaggcgctgctgcagtagcctgaacttgccgtcgaaagccggttcaggaaaggactggccccagggaccggcatcgcgcagcatttccgccgtctgaattgaaaactcggcgggctgtaacgcgccatccgaccagataacgccctgtaacgcttctccggcaagccattcgcccaccaggtcggcaaagcgctgccgaaattcctcgtagcgcgtcgcttccagcgacagtcccgctgccatagcatggccgccaaacttctgcatcaggccgggatgcaacgtatcaagacgttccagcgcgtcgcgcagatgcaaacccgcaatcgatcgtcccgatcctttcaacatgccgtcaccggcaggtgcaaaggcaatgaccgggcgatggaagcgctctttcaggcgggaagccagaatgccgaccacgccctgatgccattcggggtgataaaaggccagccccagcggcagatcgctttgctcgctctccagcttttggcataacgccagcgcctcgctctgcatgccctgctctatctctttgcgcatctggttaagcgcatccagttcactggctaacatgcgtgactggctgagatcgtcggtcagtaacagcgccacgccaacagacatatcatccaggcgtccggcagcattaagccgcggacccagcgcaaaacccaggtcgctggcggccaactggcgggcatcgcggttggcgatttccagcagggctttaattcccggtcggcatttgccagcccggatgcggctcaggccctgccacactaagatgcggttattcgcatccagcggcaccacatccgccaccgtgcccagcgccaccagatccaacaggtccgccagattaggttccgctcgcgtagccccaaaccagccctgagttcgcagatgcgcgcgcagggccatcatcagataaaaggcaacgccaacgcccgctaacgagcgagagggaaaatcacaatccggcaggttgggattcacaatggcatcagcatccggcagcgtttcgcccggcaagtggtggtcggtgaccagcaccgcaatgccgtgctgatgcgccacctgcacaccggcgtgggaggagataccgttatccacggtcaaaatcatctcggcaccgcgcgctctggcctgctccaccacttccggactcagaccgtagccatcttcaaaacggttgggcaccagatactgcacgttgctgtatcccatgctgcgcagtgccagcaccgtcagcgcggtactggtggcaccgtcggcatcaaaatcgcccacaaccatgatgcaacggccatccagcagagcctgatgaagcaaactcacggccttgtctatgccgcttaatgcgctgaaaggcagcaggtttttcgcgcctctttccagctcggcggcatcggtaacgccgcgttgcagataaagccgacgcaggagtggcggtaaatcagccggtaacgccagctgatcggccaccgcctcacggcgacgtagttcgacttcgtgctttaccacgccttaaccaccacgcttttgattatccagtacctgcttgagttcctgtgggctttgatagcctgggatcatcattccgctatcggtcagaatagctggcgtaccctgaatgccgaacagcacacccagttggtactgcttgccgatatcgatattgcatgaggctggcgcatccatcttcggcacatcgcctttcatcgcctcatcaaaggctttgttgcgatcggcgctgcaccagacggccttcatggcgctggcgactttgccgttcatgccttcacgggggaaagccagatagcgaacggtgatgcccagcgcgttatagtccgccatttgctcatgcagtttgtggcagtagccgcaggtgatatccgtaaacaccgtcaccacatgctgctcttttggcgctttatacacgatcatttccgggaccagcgcctcaactttcttatccagcagcgcattcgtgacgttgaccggctgagtgccgctgacatcataaagcggcccctggatcatgtgtttaccatcatcggtaacgtacagcacgccactttcggtgagcacggttttaaaacccggcaggggtgaaggttgaatctcagtctggtgcaaacccagttttttcagggaaagctgaatggcgctgtcatcagcgtgggtcaatccggaaaaggcgctggcaagaagcgccagcatggcaacatgtttgttcattgttttccttactatccgtcggttatgcgcgcggatgatgctgttgatgtaacagtcgcagacgttccgtggcgacatgagtataaatctgtgtcgttgagaggtcgctgtgccccagtaacatctgtacgacacgtaagtcagccccgtggttcagcagatgcgtggcgaaagcatggcgcagcacgtgcggtgaaagcttttcgctgtcgatgcccgccagcgtggcgtaatgcttgatacgatgccagaaggtttgtcgcgtcatctgctgggcacggttactgggaaagaacacgtccagcgtctgcccattgagcagccatggccgcccgtgctccatataatattccagccagtaaaccgcctcttcacctaatggcaccaggcgttctttattgcctttaccgatcacccgcaccacgccctgacgcaggctgacatcattcagggtcagtcccaccagttctgagacacgcaagccggtggcgtataataattccagcatggctttatcgcgcagttcaagcggcacattgacatccggcgcctgcagcaggcgatctacctgcgcctcgctcagatcttttggcaaccgctggggcagtttgggggctgccagcatcgcgctgggatcgtcagatcgaatcttttcgcggtagaggtactgaaacaggcggcgcatggcgctgagcaggcgtgcagagctggaggctttatagccgccctcaagccgctccgcgagaaactgttgcagatcgggcgcagtcagcgtcgtgagcgtcaaaccgttatgcaccagccagccagtgagggtttgcagatcctgtcgataggaagacagggtattttgcgccagattgcgctcaatccatagcgcatcaagaaactgttctgtcagttcactatcttgcacgttttccccaccgttcagtatgaaatcgtgctcattatgcctgattcaaccctgcttctgatacaattacgccaaagtcaggattaacagagcactatctgcatgaaaataggtcttttttacggttccagtacctgttacaccgaaatcgtagcggagaaaattcgggattttattggtgacgagttagtgacgttgcacaacgtgaaagatgacgatccgcgtctgatggaagagtatgatctgttgattttgggcattcctacctgggattttggtgaattacaggaggactgggaggcaatctggcctcagttacccactctcaatttgcataacaagatagtggcactgtacggcatgggcgaccagattggctatggcgagtggtttttggatgctttgggcatgctgcatgagctgctacagccaatgggcgtgcagtttgtcggctactggccactggacggctatgaattcaccagccccaaaccgctgagcgctgatggcaaacagtttgtcgggctggcgctggacgatgttaatcagtttgaagcgacggatgagcgcgtcgaacagtggtgcgaacagattctgaccgagactgccgaccggctgtaacctctgttctgcagcccttgtccagaaagcggtgttaaaaaaccgccgttcagaaacgggggctaagaagccgctgttaattcaccttcttcagacagggttatccagaaattattgttttgaaggtcatgttttaaaagacatgttttgaaaaccgtgctttaaagccgtgttctgaaagccctgtcccgggcgcgttattctggaaaccttattcaggaaacattgttcaggaaacgttgttctgcaaaaagtgttctgggaagcgtgttctgaaaacatggctctggaagccttgttcagcgcgtcaggtgtcactgaaacagcgagcccgtaacgcgcgccattcctctggctgcatgttgtcctgcatcagccagagccgtaaagtcttgcctttgccgttgcgcaggaccagtaagaccgcgccgggtaaccagtacaacggctggtgcgtttgccagctgtcaccttgccagcgccagtcgcggttgttgtcgcgctgtaaccagccctgccgttggcgtaaacggcgatcctgtcgccacccttcccacagcactacggcgaccaggacaggcttaatcatccactctgccgcaggcagttccattatcccgacgcctgctatagtcattaacagcgccagggttaaggtcgtgcgtgcgtgccaggagggatgaaggttacatcgccaccggtccgcgttcacgattgcgctgctggataagtttaaccatacgattaagttcaggatcgcccggttcgccatggttcatcaaccagttgaaaagatcgggatcgtcacttttcagcagggcgataaacacttgcttatccgtgtcgttgagcgtgtcatattcgtacttaaagaacggcataatagcgatatccagctccagcatgccacgacggcaggcccagtgaattcgtgatttatcatcaatatccatgcaacagtttccacatttcacatcgtggccgctagtgtaccctggattaatgctgactgcaggctcacaacgcaaccctgtgcaacgcgccacagagtcaggtttttttaacgcctcagtacgcgttttgtgcgcccttttcagtaaacaggttgcattgccagtgtgctcttttaacattgaagacattgttccggatgaaccttcatactcaggatttatcgatgccaacatttacgcttcccccacgtcagcccgcagcctcgtcacgcctgccgttaacgttaatctctctggatgcctgggcactggtttccgtcgtcggccccgacagcacgccttatttgcagggccagttgactctggatgtggcagcgctggatgcggctcaccatctgcctgccgcccactgtgatgctaagggcaagatgtggagcaacctgcgtctgtttcatcgtggtgagggctatgcctatttggtgcgtcgcgagctgcgagacacgcagttgcctgagctgaaaaaatatgccgttttttctaaagtcaccctggcggcggatgacgatgtcgttttgctgggcgtcgccggtttccaggcgcgtgccgcgctggcgaatgtctttgacacgctgcccgaccactcaactcccgtagtacagcagggcgatacaacgctgttgtggtttgaacatcctgcagaacgttttctgctggtcacgtcgctttcacaggcagaagcgctgaaacagaggctggcggaggatgcgcagttcaatgacagcacacagtggctggcgttagatatcgaagccggtattccggtcatcgacgcggccaccagcgcgcagtttattccccaggctgcaaacatgcaggcactggacgcaattagctttaaaaaaggctgttacaccggccaggaaatggtggcaagggccaagtatcgcggcgcgaataaacgtgcgctctactggctgtcaggccaggccagtcacctgcccaccgctaacgactcgcttgagctgcagatgggcgagcgctggcgtcgcacgggcaccgttcttgcggcggtccagctggacgatggcgtgacctgggtgcaggtcgtgatgaacaacgatctggagccggacagcgtactacgtgttgaaggcgatgaaggcggtaagctgcagattcagcccttgccttactcgctggaagaaggctgagttcaggggcgggatcttctcccgcccttttttctttacatgacgtagaagtagatggcgcagaaatggcaaatacagccgcctaagacaaaaccgtgccagatagcatgattaaagggcacccgacgcgcgacgtaaaaaatcacgcccacggaatagataatgccgcccaacgccagcagccagatcccgccagccgacagtttcatcgccaactgataaaccacaatcagcgaaagccatcccatgcaaagataagtaaccagggacagcaccttaaagcgatcggcgatagtcagcttaaaaagaatccctaacagcgccaggccccagatgaccgccattaatccataggccagaggcgactgtaaccccaccatcaggaacggcgtgtaagtgcctgcaatcaacaagtagatagcgcagtggtcaacttttttcagcacgcgcttagcacgcggatggctgacagcatggtaaagcgttgaggccagaaacagcaggatcatgctgccgccgtacaggctggaactgacgatagtggttattccagcgttcatcgccattgccttatcaagcaacagcactaatcctacaatcccaaacaggcaaccgagcccgtgactgatactgttggcaatttcctctgccagtggataaccctgcgtcggtaaacttttgtgagtcataacattcctgcctgaaaagtgataacaactgcagctttatcgtgcaacagagtacccagaaaaagtttcagtgtacaagtgtaagcttaaaataattattgcggtcaacccctgcgcgatttctggtaaaatgctggctagtcaattgcctgatgagtttttccatgttctcgcatcacgatcttgccaccctgaacgatcttgaaatgcaggtttatcagtacatcatcaaacatcgcgacagtgtcagttacatgaccatccgcgatctggccgagcaggcagcggtgtcgaccaccaccgtattgcgtttttgtcgcaaaatgcagtgtgaaggctggtcagaatttcgtatccggctgcgtctggcgcaggagcaaacggcccctgtgctgccggtctcgggcgtcgcggatatgctgagtttctttaaaagcatcaacaacgatgagtttgagcaggtcatgcgtcaggcggcagagatgatcaatctggctgagcgggtgttttttattggcgtgggaacatcgggaagcctgggaaaatatggggcgcgctttttttcgaacgtcggtaagttcagccatgccattgacgacccctattatccggtgagtccgagcttatatgaaaacgccctggctattatcctttctgtttccggcgaaacggaagaagtgctgcgtatcgccagtcagttcagcctgaataagtgtaaaatcattgccatcaccaatagtgaaacctgctcactggcaaaaatgagcgactttacggtgtcttatcatgtacctgtgatacgaatggcagaccacagcgatattacgactcaggtcccggtcatgtatattattgagtctctgggtcgaaaactgggtaaataaaacaagacgttttttcgccgtaacaaatcccttttttgctacggtgttatagcgtgacattattaagtgctttgctacactcagcccaattttattgtcaggggagagagcgtaatgagcttaccaaaaacgtttctgtggggcggtgcggtcgcggcacatcaggtggaaggcggctgggatcagggcggtaaaggcatcagtattgccgatgtgctgaccggcggttcgcatggtgtggaccgggtcatcaccgacggcgtccagcccggaaaattctatcctaatcatcaggctgttgaattttactcgcattacaaacaggatattgcgctgtttgctgagatgggttttaaatgcttccgtacctcaattgcctggacccgtattttcccgaatggcgatgaattgcaacccaatgaagccggtctgcaattctatgacgatctgtttgatgaattacttaaatacggtattgagccggttattaccctttcccattttgaaatgccctatcatctggttaaagaatacggtggctggcataaccgtaaagtcgtcgatttctttgttcgctttagtgaagtcgtactgaaacgttacaagaacaaagtaaaatactggatgacctttaacgaaattaataatcagcgtaactggcaatatccgctgtttggttactgctgctcaggcgttattttcactgaacatgaaaaacctgaacaggcgatgtatcaggtcatgcatcatcagtttgttgccagcgccaaagtagtgaaactgggtcatgagatcaacccggactttcagattggctgcatgatcgccatggtgccggtttaccccttctcctgtcatccggatgacgtcctgctggcgcaggaagcgatgcatcaacgttatgtattcagtgacgtgcagatgcggggttactacccggcttatgcactgaaagagtgggcgcgcaaaggctatcacattgaaatggaagctgaagatgctgaaaccctgcgtaatggctgcgcggattacgtgggtttcagctattacatgagtactgccgtgcagaccagtgccagcggcgtagatgaccccattaccggttttgaaggcgcggttaaaaacccgcatgttaaagcctcagactggggctggcagattgatcccgttggcctgcgctatacgcttaacgagttgtacgagcgctaccaaaagcccctgtttattgtggaaaatggctttggtgccatcgataaaccgaacgcacagggcgtcatcgaggatgattaccgcattgattatctggccgcacacattgaagagatgaagaaagccgtcacacatgatggtgtggatcttatgggatacacgccgtggggctgtatcgactgtgtatctttcaccaccggtcagtacaacaaacgttacggttttattcatgtgaataaaaacgacgacggcagcggcgatttctcgcgcgcgaagaaaaagagctttgcctggtatcaacaggttatcgccagcaacggcgaaaaactgtaagcccgtgccgcagcgctttgctgcggcataattttagcgcccgccggcggcatcaataatgctgccggtaatgtaagaggcggcatcgctggctaaccagacgatggcttctgcaatttcttcagcataaccgccgcgccccattggaattccgctggccagccggtcgactctgcccggctcgcccccgtccgcatgcatttcggtgtagatcatccccggacgtacgccattgacacggattccctgctgagcgacttccagcgacaggcctttggtcatcgtatccatcgcgcctttcgatgctgcgtaatcgacatattcatttggcgaccccgtgcgggccgcagcagacgacacattaacaatgctaccgccctggccgccatgatgggttcccatgcgccggacggcttcccgactgcagagaaaggggccaagcacgttggtggcaaaaacctgctgaatacgcgaggcatccagttgctcaaggcgacattgctgaaacagtatgccggcattattcaccagcagcgtgagcggcagatcttcctgatccagccgctgaaacagcgacatcacctgcgcttcatcactgatgtcggcctgaacgctaaaagcctcaccgccctgacgcactatctcatccacaacctgatgggcctcactggcgcgtgagcggaaatttaccgccacccggtagcctcgggacgccagtaagagagccgttgcgcgaccaatgccgcgactgccgccggtaacgagtgcgagttgcatggctgtctccataaaaaagggccgaaaatcggccctcagaaataaatgcgttaacctgacttaagcatagtcgctcatcggcacacacgaacagaacaggttacggtcgccaaagacatcatccaggcgcttcaccgtcggccagtatttattgtgtccgcctgccgggaacacggccagctcacggctgtagggatgcgaccattctccgatgacttccgtttgcgtatgaggcgcattgaccagagggttatcctcaagtgaccactctccctgctcaacccgactgatttccatgcgaatcgccagcatggcatcaatgaaacggtccagttcgattttgccttccgattctgtcggttccaccatgagcgttccggctaccgggaatgacatggtcggcgcatggaagccatagtcgatcaggcgtttagcaatatccagctcactgataccggtttgctcttttaacggacgaatatcgagaatacattcgtgcgccacgcgaccatcgcgtcctgcataaagaatgggataggccgatttcaggcggctggcaatatagttagcgttaaggatcgcgaccgaactggcctgctttagtccttctgcccccatcatgcggatatacatccagctgataggcagaatggatgcgctgccaaatggcgcggcggagacggcgccctgctgcgtcagcatgccatcaatctgcaccacgctgtgtcccggaacaaacggggccagatgggctttcacgccgatcggtcccattcccgggccgccaccgccgtgcggtatgcagaaggttttgtgcaggttgaggtgcgaaacatctgcgccgatgtagcctggcgtggtgatgcccacctgcgcattcatgttggcaccatcaaggtaaacctgaccaccatgctgatgcacgatctggcacacctcacggatggtttcttcataaacaccgtgggtggagggataggtcaccataatgcatgacagtttatcgccggcctgagccgctttttcacgcaggtcgccaaggtcgatattgccctgtttgtcacaggctaccaccacgacatccatgcctgccatctgcgctgaggccggattggtgccgtgcgccgagctgggaatcaggcaaagatgacgttcaccttcaccacggctttcgtggtaacgacgaatcgctaacagtccggcatattccccctgcgcgcccgagttaggctgcatgcagagggcatcgtaaccggtcagctgtaccagccactgtgaaagctgccctatcatttgcaggtaaccccccgcctgttctgccgggcagaacggatgcagttcggcaaattcaggccaggtgatggggatcatctcggcggccgcgttgagtttcatggtgcaggaacccagcggaatcatcgcctgattcagtgccagatcttttttctccaggctgtgcatatagcgcatcatctcagtttcactgtgatgacggttaaacaccggatgagagagaatttcacttttacgctgctgcccggccggaaccgactggctgtcagccgcgacctggctgtcgagttggtcgatatcctgaccgtgttcatcacccagcagaatagcgaacagcgtgctgatgtcttcacggcgcgtggtttcatccagcgtgatgccgactgcattatgaatgtcgctacgcaggttaacgccaaaactcagcgcacggttaagcacgcccgctttatctgcaacctctaccgtcagcgtgtcaaaccagtggctatgacgcagtttcagcccaccacgctggagtccggcagccagaatatcggtgaagcgatggatacgcgacgcaatacgtttcagtccaaccggcccgtggaacaccgcatacagccccgcgatattggccagcagcacctgtgaagtacagatgttggagttggctttttcacgacggatatgctgctcgcgggtttgcatcgccatacgcagggcggtattgcctgccgcatcgcgggaaacgccgataatacggcctggcatagagcgcttgtgctcgtcgcggctggcgaagaaggcggcatgaggccctccatagcccattggcacaccaaagcgttgggcggaaccaaatacaatgtccgccccttgtttgccaggcgactcaagcagcaccagcgccataaagtcggatgccatgctcaccaccaccttgcgcgctttcagctcgttaatcaggtgggtaaagtcgtgtacttctccggtggtgccgacctgctgtagcagcacaccaaacaggttgtcgtgatccaacgctttggccggactatcgataatcaggtcaaagccaaaggtttcggcgcgggtacgcaccacatccagcgtttgtggatgaatatcgtcagcgataaagaaccggttggcatttttcagtttgctgatgcgttttgacatcgccatcgcttcagcggcggcggtggcttcgtccagcagtgaagcggaggcaatgtccatgccggtcagatcaatcgtgacctgctgaaagttaagcagtgcctcaaggcggccctgtgagacttctggctgatagggggtataagctgtgtaccagcccggattttccagcatgttacgcaaaattaccggcggcgtgatcaccgcactgtatcccatgccaatccaggatttataaagcaggttttgtccggcaatggcctttaactcagccagcgcctgttgttcagttgcggcatcgccaacagcgggcgggcctggcagctgaatgtcggcggggacgatagaaccaatcaacgacgccagagagctggcaccgatcgcctccagcatgacggcctgttgttctggcgacggaccaatatggcgctcgataaaggcaccgttgtgttcaagctggctgagagtctgagtcatgagctgtaagtcctgaatcgggctggggaacagagaatgcaagtcagatatgtgcggccccgataagaggccgcacaacgattactcgtcgatggaggctttataagcatccgcgtccagcagcgagtcaatttcggactcatcgctggctttgatctggaataaccagccaccgtcataaggctcgctgttcacctgttcaggggaatcgttcagggaatcgttcactgccacaatttcaccgctgacgggcgcataaatatctgaagcggctttgaccgattcggcgacggcgcactcttctccggcagagaaggtggcaccgacctcaggcaggtcaacaaacaccatatcgcccagtaactcctgcgcatgttcggtgataccaacggtataggtaccgtccgcatttttgcgcagccattcgtgactgtcgcggtatttcaactctgctggcacattgctcatcgccatttctcctgtaattatatgttactgcgcaaccggttttccggcgcgaacgaaaatcggtttagtgacttttacaggcatttcacggttacggatttcaacaatcgcgttctcaccgatacctgccggcacgcgggccagggcaatgctataacccaacgtaggggagaaagaaccgctggtgatcacaccctgctgcatctgaccctgttgatcggtaaaacgtaccggcaagccgttacgcagtacgcctttttccgtcagaatcagcccaaccagtttttcagtgccctttgctcgctggctttccagcgcttcacgtccaataaagttgcggtcagttggctcccagctaagcgtccagcccatattggccgccagcggtgatacgctctcgtccatttcctgaccgtagagattcatgcccgcttccagacgcaaagtatcacgtgcgcccagtcccgcaggtttgacgcctgcgctcagcaagcgctgccagaacgcgacggcttcggcggcagggagcgcaatttcatagcccgcttcgcccgtatagccggtggtggcgataaacagctctccggcttgtacgccaaagaagggtttcatgccctgcaccgcctggcgctgcgcatcgctgaataacgtttgcgctttttgctgggcctgcgggccttgtacagcgataagcgccagatcgtcacgctctgttaacgcgacgccgtaaccctgggcatgctcactgatccaggccagatcttttttacgcgtcgcggaattgaccaccagacggaaaaacgtctcgtccataaaataaacaatcaaatcgtcaatcacgccaccagaggcattcagcatgccggtgtagagcgctttgcccggctgggtcagtttggcgacatcgtttgccagcaggtagcgcagaaactcgcgcgtgcgctcacctttcacatcaacaatcgtcatatgcgacacatcgaacatgccggcatcgctgcgtacagcatgatgctcatccatttgcgagccatagtgcaacggcatcatccagccgtggaaatccaccatacgcgcgccatttgcctggtgctgttcaaacaacggtgtgtgctgagtcataactatcctgtgcagaaacgagtgagtttgaaactacgccgccatgttgccgacgcaaacgttctctttgccttgacgttaccaccgaacctgacgattaaccataagcaaagcgaggtcgaaagacgttgcacagcctaaccagggagaaaggcaaacaggacaaaaaactgtaattttgtgattagccacgcaataaatacgccatggtgatttatacgcagcaattttatgcgcgaagcctggcaggatgttaaaaaaatagcgggacgaaaaggcgcagggataaaaaaaagtaatgcgaaacatcaggcaaaattagaataaatcaaatgaggcgcaatcagggtgcagcactgcatttttatggtgcagcggattaaggcgataaaaaaaagccagcacgaatgctggcttttcgctgcaggatggcgttagcgaagccactctggcatatcattcaggcccattgcctgacggagcatcatcggcttcacgcccggcaaattatcggctaatttcaggcccaaatcgcgaaacagcttcctggcaggattgttgcctgcaaacaattcacggaagccctgcatcccggccagcatcattgctgcactgtgtttacgactgcgctcatagcggcgcagataaaggtgctccccaatatctttgccctgctgatgcagacggcgaatttcgccgatcagctctgcggcatccatgaatcccagattgacgccctgccctgccagcggatgaatggtatgcgccgcatcgcccaccagcgccagtcggtgagcggcaaagttacgtgcataacgtgccgtcagcgggaaacacttgcgttccccttccagctcgcacagccccagccgcatatcaaacgcgacggacaactgttgattgaacagcgactctggcatggcttccaggcggctggcttcctgaggtgaaagcgaccagacgattgagcaaagatgcggatgctgcatgggcaggaacgccagaatgccatcgccgtgaaaaacctgacgagccacgccgccatggggcaaggctgtacgaatattcgccaccagcgcatggtggtcgtaatcccagaaggtcaggggaatgtcggctttgttacgcaaccaggagttggctccgtccgccgcaaccatcagccgcgcgctcatcatgctgccatcttgcagcgtaataaaggcttcattatcgccaaatgccacttgctgtagctgtgaagcagccagtaacgtgacatcactgcagttgctggcgcgctgccacagggcggtgtggatcacgggattttcgatgatgtgcccaagatgcgccagaccctgctgctcgccatcaaatgcgatcgcgccaaagctgtcacgctcccagacttccatcgcctgataaggactggcgcggagggacaaaatagttgaccagacatccagcttttgcaaaagacgttcactggccgcattaatcgcggatacgcgcacagagggagatgcgcctgcatcaaattgcggctcggccgactgttccagcacggcaatgcgtaatccgctcccttgcagaccgcaggccactgccagccctaccattccgccgccagcgatcaccacatcgtaagtttgcatcagtgcctctcagttaacgcttaacccagccgagcgtacgctcagccagaagatttctcagccacggcagatgatccattgccagcaagcccaggttgcgcccgacgaccagcggcgcatgacgattagcaaacagacgtaccagcccgtcagtgatgcccacggtaatggcccggtcctgttggcgacgttgctggtagtgctgcaaaaccccgtagctaccgggatcttgttgctgccgatgtgcattggccagggtttcagccagtgacatcacatcccgcagacccaggttaaatccctgaccggctatcggatgcagcgtctgcgcagcgtttccgacggtgactacacgatgggaaaccgcaggattggcctgctgtaacgccaacggataaacatcacgcttgccggtatgggtgaatttgcccagccgccagccaaaggcgcgctgaagctggctgaggaatacctcgtcgttccagctttctacctgcgggcgctgctccagcggatggcaccacaccagcgacagacggttgtttgacattggcagcagcgccaggggaccaaactcggtaaagcgttcaaatgcccggccctgatgaggacgctcactggtgacgttggcgataagcgccaactgctgataggcctctgtctgccactgaatgccgcaggcggcagcaacggcagaacgggtgccatcagcggccaccagtacctcgccttccaactgctcaccattatcaagcgtaacctgcacgcgttcctgggtacgggccacctgagttacgcgtgacggacaacgcagtgtgacgccaggtgcctgcttaagctgcgtaaacagctgctgtcctacgtcgaataactcaaccacgtgccccaacgcgggaatcgcataatcgctggcggccagggatacaaaaccggcatgaccgcgatcggaaacatggatagtggtgatgggtgtcgcacagggtgaaatacgctgccagagattgatatcagcaagttgctgggaggtgcccgcagacagcgcgatcgcacgcccgtcatagcccggatgcgtgcggctggcaggttcgctgctttcaatcagcgtcacgggcagtgcgccctgtgtcaggtgtgaaatcgccagcgccagcgtggcgccggtcattccaccaccggcgataagaatggtcataccgcgcgtgccgccgccatcagtgcctcaatggcatcgggatctttcaccacgctgtcggtaagattctcgttaccgttttcagtaatcgcgatgtcatcctcaatgcggatgccgataccgcggtattccacaggcacatccgcatctggcgcgatatacagccccggctcaaccgtgataaccatgcccggttccaggatacgatcgcggcttggcgtgccgtagtgccccacatcgtggacatccagacctaaccaatggcccaggccgtgcataaagaatttgcgatgcgcgtcttcggcgatgagtgcatccacctcgccctgcattacgcccagctcaaccagtccagtgaccataatgcgcacgacgtcatcattgacctcgcggatgctgacgccaggacggaatcgggcaagtgccgtttctaaagatttgagtacgatattgtagatagcccgctgcggcgggctgaacttgccattaaccggaaaagtccgggtaatatcgcccgcataaccctgtaattcgcatcccgcatcgatgagcaccaggtcgccatcctgcatctcacactcattttcggtgtagtgcagaatgcagccgttttcaccggagcctacgatagtgttgtaagacgggaagcgcgcaccatgacggttaaattcgtgatgaatttcgccttcaagatgatattcaaacaggcctggacgacaggcttgcatggcgcgagtatgtgccagcgcactgatctcgcctgcgcgacgcaacagcgcaatttcttcagggcttttaaacaggcgcatctcatgcacccagggacgccagtcagtcaggctagccggtgcactcagattctggcgaaagccctgacgcagtttatccagcgcactaaacaccaacttgtcagcctcagcatactggccctgcgcgtgatacacctcatccagaccgttcagcagcaggtggagttgttcaccgatatcgttccatggcagagcacgatccacacccagtttagcgggcgccgcgtcctgtcccagacggcggccaaaccagatttctgcagtcaggtcgcgcacacgattaaacagcacgctgtgattgtggttctcatcacttttgatcagtaccagtaacgcctgcggctcattgaagccggtgaaataccagaagtcactgttctgacggaacggatattcactgtcgttactgcgtgttacttcaggcgcggcaaagattaacgctgcgctgcccggaaccattttcgctaacagcgcctgacggcgttgctggaaattttccagtgaaatcatgtctgcactccctgttgaactcagatatctggcttagtgtagcgttggcttttgtacttctggtgcggtcggttgcgggcgcgtgaaggtatcgtgacagagtagcgcagcaacgcgaacatactcgatcacctcttccagcgactgctcgagttcttcctgatcttcgtcttcgtcatagccaagctgagcaatcgtgcgcagatcgtcaatggcctcacccgtttcgccggtgaccttatccagtttaggctgggttacgcccaggccaagtaaaaaatgattcacccagcccgccagagcatcagcacggtcaaacaccgtgatgtcatcatcgccaggcagcatcagttgaaaaagaaagccatcgtcctcaagcgcagtagcaatgctggcatgcagagactgcagtggctgagacagcgtttgcgaaaaagccatgccttcattcgcgagatcatggaccagcgttttccagctgttatcctgattaccgccacacaggatgccgctaagcaatccgtgcatttccgcgggcgtcataccgacgccgtggtgtgagagcgccgccgccagcgcgttgtaatcgggggttgcgttctgtgaagacatcatttttcatcgtcgttggctgtaagagttcgtggtatgctaccactagctgcctcaaggtttccagaaaaggggttgtatcttatttctcaggtctatatagttgcccgcctcccaggccattgaaggctaaggggaatggcgagccaggtaatcagtcaggaaggtggcatgtctgcacaaccggtagatttacaaatttttggtcgttctttgagagtaaattgtccgcctgaacagcaagatgcgctgaacgcggcggcagaagatctcaatcaacggttgcaagatttaaaagttcgcactagagtcacaaatacagagcaactggtgttcattgccgcgttaaacatttgccatgaactggcacaagagaaaggtaagacgcgtgactatgctgctaatatggaacaacgaatccgtatgctacagcagacaattgaacaggcattagttgagcagggtcgcataaccgatcgcgaggatgcgaagttcgaataacacttcatggtcgctgtgctacactgacggtgaagtaaattttctctgagatgtttgcaagtgggccagtcccctgagccgatatttcataccaacagaatgtgacgctccgcaacctgtgagcatgctcggtccgtccgagaagcctgatggttgcgacggcatgttcaccttgaaccaagggttcaagggttacagcctacggcggcatctcggagatctcctttctggtagtactgctttatctcccaccaggcatgatataatgcgtcgctcaagcgaccttgtctgggggaaaccatgtcagaaccctctttgctaccgcgacaggacatccgtcagcatgttcgtcatttacgtcgcgcactcagccccgaacagcaacacgctgcagccgatcagcttgcggaacacgcgattaacgttgcgccgattgccgacgccagcaacatagcgctgtttttgtctgttgatggcgaaatcaatacacgaccacttatcgcaaagctgtggcagcaaaacaaacgggtttatctgccggttctgcatccctttgctgccggtcatttgctttttcttcgctatacgccggaaacacagttaatccaaaataagctgcgcattcccgaacctccgctcgatatccgccatctggttacacttgataaactggacgtaatgatggtgccgctggtggcatttgaccgcaccgggcagcgtttaggcatgggcggcggtttctacgaccgcactttacagaactggaaacagcacggattcctaccgattggggttgcccacgattgtcagttggttgatgtgctacctgctgcggcctgggatatccccctgcccgccgtactgacgccgtctaaactctggctatgggatgaataaacccaggcacgctcgtgcgcctgggtttatgacagcgatggattagtacagcagacgggcgcggatagtacccggaatagccttcatgagctgcagggctttctcagccagttcatgctcggcgtcaacgtcaatcaccacataacccatcatcggcgaggtttgcaggtactgagcggcaatattgatgccctgctcagcaaagatctggttgatcgcggtgaggacgcctgggcggttctcatgtatatgcagcagacgactggcgctcacgccgtgcatcggcaatgagacttcagggaagttaacggcggacagcgttgaaccgttatccgagtatttagccagcttacctgcgacttcaataccaatattttcctgcgcttcttcggtagatccaccgatatgcggcgtcaggataacgttgtcgaattcgctcagtggtgaaatgaacggatcgctgttggtcgcaggctcgaccgggaatacgtcaatagcggctccgccaacctgcttacttgccagcgcgtcacacaacgccggaatatccactacggtgccgcgtgaggcgtttatcagcaacgcaccgggtttcatctgcgccagttcattggcagagatcatattttgcgtggaggcggtttcaggtacatgcaggctgacgacatcgctcatgttcagcagttgcgtcaggctacgaacctgtgaagcgttgccgagcggcagtttgttttcaatatcgtagaaataaacgtgcatgcccaggctctcagccagcacgcccagttgcataccgatatgaccatagccaatgatgccgagctttttaccgcgcgcttcaaatgagcccttggcaattttattccagacgccgcggtgcgccttcgcattcgcttccggtacaccacgcagcatcagcagcatttcgccaataaccagttcggcaacagagcgcgtattggagaaaggcgcattaaacaccgggataccgcgcttagcggccgcatttaaatcaacctggttcgttccgatgcagaaacagcccacagccaccagtttttctgcagcggcaaaaatctcttcggtcagttgggaacgggaacggataccgataaaatgcgcatcgcgagcggacgctttcaacgcctcggcatccagtgcgcctttgtggaattcaatattggtgtaacctgcagcacggaggttttccagcgcactctgatggacaccttccaccagcaggaacttaattttgtctttttccagtgatacctttgccatttcccaaccctattcagaattcaacgaggactgaacgccgccagccgtctgtcaaaatatcaaaaaaatcgcctgcggcaatacaaacgattgcctgcccgtcagcatggccgggctcagagggcgtactttgccagacaaaatcatgggttggccgcatcggaaagaacgaacccgctgccgatgacggttatgtgacataagtcaccaaattttgacctggtaagaaaagttttttaaatcaaaaaaaagcgggcgccgttcagcgccaggcgcattattttttgagagttttgacgccgtccggcccaccaatcagtgcaacgtctgcgccgcgcgtcgcaaacagcccaacggtgaccacaccgggcaaggcgttgatggttttttccagctcaatgggattgagaatacgcagattgtgcacatcaagaatgatattgccgttgtcggtcactacattctgacgatattcaggtaagccccccaacttcaccagttcacgcgcaacataactgcgcgccatcgggatgacttcaaccggtagcggaaagcgtccaagcacatccacttctttggatgcatcggcgatgcagataaactttttggccactgcagcgacgattttctcacgcgtcagcgcagcgccaccgcctttaatcatctgcatttgtgggttaatttcatcggcaccatcgacataaatggccaggtcatcgatttcgttcaaatcaaacacctgaatgcccaggcttttcagcttttgcgttgaggcttcggaactggaaacggcaccgtcaatctgatgtttaatgcttgcgagcgcatcaataaagtgggcggcagtagaacctgttccaacaccgacgattgtaccgggctggacataatcaagtgcagcccaaccaacagcttttttcagttcatcctgggtcatgatatgtttagaacctgtgcgataaggaattgcgcgtagtataaagcaaggcttgctgaaaatgctcggatgcattgggcggatttaatgctttggaagccagcccacaaaaatttccccgacattgccgttggcacttttgtggcatagtgacgtccatcctgaaggagagagaaaaataatgaaacgccctgactacagaacgcttcaggcgctggacgcagtgatacgtgaacgcggcttcgaacgtgccgcgcaaaagctgtgcattacgcaatctgccgtatcgcagcgcattaaacagctggaaaacctgtttggtcagccactgttagttcgcaccgtgccgcctcgccctaccgagcaaggtcaaaaactgcttgcgctgctgcaccaggttgagttgctggaggaagagtggctgggcgatgaaatcagcgggacaacgccgctgctgctgtcgctggcggtgaacgccgacagtctggcaacctggctgttgcccgcattaaaagacgtactggccgattcgccggtgcgtctgaaccttcaggttgaggatgaaacccgcactcaggaacgcctgagacgaggcgaagtggttggcgcagtgagtatccagccgcaaccgctgcccagttgtctggtggatcaactgggtgccctggattatttgtttgtggcctcaaaggatttcgcagatcgctttttccccaacggcgtaacgcgttccgccctgcttaaagcgccagcggtggcctttgatcatctggatgatatgcatcaggccttcttgcagcagaactttgatttatctccgggcagcgttccctgccatatcgtcaactcatccgaagcgtttgtgcagatggcgcggcagggatcgacctgctgtatgatccctcacctgcagattgaacgcgaactggcaagtggcgagctcatcgatctcacgccggggctgtatcaacgtcggatgctgtactggcaccgttttgcgccagaaagccggctgatgcgtcgggtaacggatgcgctgattgcccatggccatcgggtgctacgtcaggatacggcggaatagcgggcggtcgacagatcaagcgctaaaggccaggaaaaacgagctggctgaaggttgtgtgccaaacgtctaatctttgccgccgcaaaagttgggcgttgcagtgagaaggtgtagttgtgaaagcggcacggcgttaatggccgtcagggcatttttcagaaggcaatacgcagcgctgagcagagggaatccacccggatttacccgcaaggatgcgggtaaaaggcacagccggcacagcgttgtgccggctgtgccggtccgtcaggttgatgagcgatgtgaaggaaccgcatcagcggcgcaaggaccgcctggcaaacattgcccctgatggcttaaccacaacaccgataacggcttactgtgccgtattcggtttcatctcaaacaccacatccacctggtcatcaaagttgatgctttgctgatcgtaggtttcctgcgcagacgtatctgccgcagccgaggctttaaacatgcggttcatgggcattggctgatagtttgcgacctgataacgaatgctgtagatcgggcccagtttggcattaaagccttcagccagttcagcggcctgttgggtcgcattcttaatcgcggctttacgcgcctgctgcttgtagctctctggattggcgacgcccagttcgacaccgcgcacttcgttcagaccggacttcagcgcaccatcaaggagatcgttcagcttgtccagctgacgaacggtgacctgcacctgacgcaccgcacgatagcctttaagctgcgatttaccgtctttggtgtagtcatactctggctgcgtcgtcaggttcgccgcttcaatgtcttttttctcaataccgtttttttgcaggaaatcaaaatattgcgctacgcgactatcgacctgcttttttgcttcagcggcatctttcgatgagacattcaccacaattgacagcgtcgcgatatccgggcgggcatctacggttgccttacctgacgtaacaacatggggtccgttcggcagttcgtcagcctgtacgctcaaaggcaatgcccctgcgctcatcatcgcggcaagcgccaatgctttcagtttcatgaaagtcctccttgaaaaggtcagttcgatggcttccagtatatgaagcccacaagcgcatcatattacgccttggttggagtggagattatggcaaaagttcggcagattgaccttaataaccggttttcgtttaccttttggtcaaaacccagagatgacctgtcgggcaagctgaaacgcaataaaccacattaccgccccaaccagcaggttaatgatgcgctgagcacgcgccgtttgcagtaaaggcgcgagccacgcagccagcagcgccagaccaaaaaaccagattaccgaggcgctgatggtgcccagtgcaaaccactgtcgcgccgtcgttccttgcaactgaccaccaaggctgcccagcaccacaaaggtatcaagataaacatgcggattcagccaggtcaccgccagcatcgtcgcaataattcgccctctgctttgcgtttcgtgcatccctgatgccagttcaatattgcggctaaacgccgtacgcaaggctccccagccgtaccacagcaggaaagcaacgcctgcacaggtaatcatcatcaggagcagtggcgattgattcagtagcgcgctgccaccaaaaatgcccgcacagattaaggcgatatcacttagcgcacagagcgccgccgtcatgagatgatactgacgctttacgccctggttcagcacaaaggcattttgtgggcctaacggcaggatgagcgcagccccaagagcaagcccttgaaaataaatggttaacacaggatgttattccttacatcggtgagatgcagggattatagagagcggtttggattagcggaaattgaaaaatttaatctgccattaacgaaattaatgggcggcacgggccgcccatcgcacgacttactgggtcgcggtcacgtcgctgtctggctgtttaacctgatgcaagtgtacatccatttgtggataaggaatgccgatgcctttgctgtccagcgcacgcttgaagttcttcagcaaatcccagtagacgtcctgcagatcgccgctattactccagcaacgaacaacaaagttaagcgaagatgcgcctaattcgttcaggccaatctggatgccacgatcttttaatacgcgctgatcggcttcaacgacatcacgcaacagagcaatcacctcatccacatcggcttcataagccactccgacgataaattcattacgacgcacaggctcacgcgaaaagttaacgatattgccgctgatgattttaccgttcggcaccaccacaattttgccatcggcggatttcagggtagtagagaagatttgtacattgagtacggtccccattacgccgcccagatcgacgaactcgccggtacggaacggacggaaggtgacgagcagcacgccagccgctaaattggagagcgaaccttgcaaggccaaaccgactgccagaccagcggcacccagcaccgcgatgaccgaggccgtttgcactcccacacgacccagcgcagcaataaccgtaaaggcgataacgccatagcgtaccagagcggaaaggaaatcggcgacggtggcatcaatatggcgcgcgcgcagcagccgattaaccgtgtttgaaatcaccctggcaatgatcatgccgacaatgataatggcaatcgccgccacgatattgacggcatagctcagaatcagtgcctggttatgcaccagccagccaccggcactgttgatgccattaacaacattcaagtcttccatttgtaagccctgttgatggttccccctacgggggaaaaacaaaaactgccagatgtaatccgacacccaagggttaagggtaatcaattatttagccaggcgccaaaatgagtgacatattaagacggctttgcacaattactcatcagtgccccagaagccacggttttgctcactgcacatggctcaggatattaatgagcctgccgaaaggatcgcggacataaaaacgacggacgccccacgcttcttccgtaagcccatattccactgttagcctcgcggcgacaacgcgtcggtacacctcatcaagattatcgacctcaatggacaagtccggcacaggcgtgcctgcaccgccttccagcgcaatgctgagctggggcgccatagcattctccgcagcccaggtcacaatccatccgtgatccatgaccagtttcaggtcgagaatgtcaccataaaagcgtttagcttcttccgtatttttgccctgaatattcgcgacgatgcgtttgactgccataaaatcgccctcacctgttaactcagagacaaagcataccggggacggtgcgatgaggttgtgacagccggtcagaaagtgtcgccctgtaagaagaaatgaaaccgggggtaagcggaaaggataaaaaaagtcccgatcggacgatcgggactgcgtcattcatccgacgttctggcgaactcagacgagtgcgttgtgatgcttacagaacgtcaacggcgttgagttctttgaacgcctgctccagacgcaccaccatggatgcctgagcagagcgcagccatacacgtggatcgtagtatttcttgtttggcttgtctgcgccttctgggttacccagttgcgcctgcagatagccttcgttctttttgtagtactgcaggataccgtcccaggttgcccattgggtatcggtatcgatattcatcttgatcacgccgtagctgatagactcttcgatttctgcagcagatgaacctgaaccaccgtggaacacgaagtccagcgcgttgtgcggcagaccgtgtttttcacaaacgtatttctgtgaatcacgcagaatcgttggggtcagttttacgttgcctggcttgtaaacgccgtgcacgttaccgaaggatgccgcaatggtgaaacgcgggctgatcgcattcagtttttcgtacgcgtagtttacgtcttctggctgggtgtaaagtgcagaagcgtccatatggctgttatctacgccatcttcttcaccaccagtgcagcccagttcgatttccagggtcatgtcgattttcgccatgcgcgccaggtatttgctgctgatttcgatgttttcttccagtgactcttcagacaggtcgatcatgtgagaagagaacagtggcttaccggttttcttgaagtgctcttcgcccgcgtccagcaggccgtcgatccacggcagcagtttcttggcgcagtggtcggtatgcaggataaccggcacgccgtactgttcagccatcagatgcacgtgatgtgcgccagagatagcaccgaaaatcgctgcgccctgtggcttgtctgttttaaaacctttaccggcgatgaatgcagcaccaccgttggagaactgtacgataaccggcgcttttactttcgcggcagcttccagtacagcgttaattgagtcggtgccgacgcagttgaccgctggcagagcgaatttgttctctttcgctactttgaagatcttctgaacgtcatcaccagtgacaacgccgggttttacgaaatcaaaaattttagacatgattgtgtcctgtttcgtgaccggttatccccaatacggggacagcgatttaaacgccctgtttcgggcgagttttcaggcgatgccgcagggcatcgcccccaaaggattactgcttcgcacgctcttccagcatggctacggcaggcagttttttgccttcaacgaactcaaggaaggcaccgccgccggtagagatataggagattttgtcttcgatcccaaacagatcgatggcagccagcgtatcaccgccgcctgccactgagaatgcgtcgctgtctgcaatcgcgtttgccacaatttcggtgcctttacggaagttcgggaactcaaacacgccaaccgggccattccacaggatggttttggcattcttcagaatggttgccatggcctgagcagtttcgtcgccgaagtccataatctcttcgttatctgcgacttctgaaacctttttcacggttgccggggcagtttcagagaattccgtgccaacacgggagtcggttggaacaggaataccatattgatcgcgcaggccttttgccgcttcaacgaagtctggctcgtacagcgatttgcccacgttgttgtcgatcgcgacaaaggtattcgcaatgccaccgccgacaatcacggtatcggcaatcttcaccagcgactgcagcacatcgaatttggtcgatactttagaaccccccaccacggccaccagcggacgctcagggcttttcatcactttacccagcgcttccagttcagcagacagcagtggacccgcacaggcgacaggcgcaaatttaccaacgccgtgcgtcgatgcctgggcgcggtgtgcggtaccaaatgcatccatcacaaagacgtcgcacagcgcagcatatttcttagacagcgcttcgtcgtctttcttttcgcctttgttaaagcgcacgttttccagcaccaccagttcacctgcgccgatgtcgacaccgtcaaggtagtctttcgccagggtaacctgagtaccgttcagtttttctttcaggtaattcactactggcagcagtgagaattcttcgttgtattcaccttcggtcggacgacccaggtgagaggtaaccatcactttggcgccctgtttcaacgccgcttcgatagttggcagtgaagcacgaatacgtgcatccgacgtcactttcccttctttcactggtacgttgagatcggcgcgaattaatacgcgtttgccagcaagatccagatcggtcatcttaattacggacatggtgaaccctctcgttgattctcataagttttgccagacgcaaaccgcgtcttacctgaaaccgcttgcggccatcgctaacgttgtgtcgagcattcggttagcaaagccccattcgttgtcacaccagaccagggttttgatcagatgctgaccgctgacccgcgtttgtgtaccgtccacaatggcactgtgcggatcatggttgaaatctactgagactaacggcaattccgtatagtcaactataccacgaaatgccccttctgccgcgctttgcaacaaggtgttaacctcgcgggcccgtacgggctggcgtacagaaacgctgagatcaatggctgtcacgttgatcgtcggcacgcgaaccgcgatggcttcgaagcgatcgttaaatttcggaaaaatacgcgtaatgcccgccgccaatcgggtatcgaccgggatgatagactgactggccgcacgcgtacggcgcagatcgctgtgataagcgtcaatcacctgctgatcgtgcatcgccgaatggatggtcgttaccgtgcccgactcaataccaaaggcgtcatccagcagcttaatcaccggaatgatgcagttggtggtacaggatgcattagagacaatacagtccgtttgtttcagctcctgctcgttgacgccgtacaccacggttgcatcaagatcgttaccacccggatgggaaaacaggacttttttcgcccccgcacgcaaatgggcttcgccatcgtcgcgggaaccgtaaacgccggtacagtccagcaccacgtcaacgttaagctcgcgccagggcagctcatccagtccggcctggtgcagaatgcgaataatatcgtccccgacccacagctggtcacgctcctgacggacatccagtgcaaaacgtccatggctggtgtcgtacttcagcaggtgcgccatgcctgcggcttcagccagttcgttaaccgccaccaccgtaatttcagcgcggcgccccgtttcatacagtgcacgcaacacgttgcgtccaatgcgaccaaagccgtttatcgctacccgaatggtcatctttctcctgccaaaccagactgaaaaaaaggtgctgatagcctgagcgtttcgctgcattttgtacaggagattcttagcccgggacagagcaaagcggcccaaactgaaacggttcagctaggataatggaaggaaggaataacgggaatgattgcgatcaagcgcgctgcttatttttggatctacgtcacaaaaacgggcaaaaaatcgctattactggaggaataatttggttaataaggggacggattccgccccctttaatcagaaggcaggcgcgtattcactcgcctgcctctctttactatgccagcaacgctttggctttcgctaccacgttatctaccgtgaagccaaagacttcaaacagcttctcagccggcgctgactcaccaaaggtagtcatgccgatgattgcgccgttcagaccggtatatttaaaccagtaatctgcaataccggcttcaatcgcaacgcgtgcggcaacggcttttggcaggaccgattcacgatattcagccgactgtttgtcgaaggcatcggtagagggcatggataccacacgtaccttacggccttcatcggtcagcttctgatacgcggctacagccagttcaacttcggaaccggtggcaatcaggatcagctctggcgtgcctgcgctgtctttcagcacgtaaccgccacgcgcgacgtttgccagctgctccgctgtacgatcctgctgtgccagattctggcgagagaagatcagtgcgcttgggccgtctttacgctcaatggcatatttccacgcaaccgccgattcaacctggtcacacggacgccacaggctcatgtttggcgtggtgcgcaggcttgccatctgctctaccggctggtgagtcgggccatcttcgcccaggccaatggagtcgtgggtataaaccatgatctgacggattttcatcagggcagccatacgggcggcgttacgcgcatactcaacaaacatcaggaaggttgcggtgtaaggcaggaagccaccgtgcagcgccagaccgttagcaatggcggtcataccaaactcacgcacgccataatggatatagttaccggctgcgtcttcattgattggcttagaacctgaccagatggtgaggttacttggtgccaggtcagcagaaccgcccagatattctggcaggattttaccaaaggcttcgatagcattttgtgacgctttacggctggcaattttcgccggattcgcctgtaactgctcgacaaacttctgcgattcctgctgccagttagctggcaggtcattgctcatgcggcgggtaaactcagcggccaactcagggaaagctttagcataggctgcaaatttggtattccacgccgcttctttggcctggcccgcttctttagcatcccactcagcataaatatctgaaggaatcacgaaaggaggatattcccagcctaactgcttacgggtcagtgcaatttcgtcatcgcccagtggcgcgccgtgtgagtcatgggtaccggctttattcggtgaaccaaaaccaataacggttttgcacatcagcagtgaaggcttgtcgctaacggctttcgcttcttcaatcgctttggcgatagcatcggcgttgtgaccatctacgccgcgtaccacgtgccagccgtacgcttcgaagcgcttagcggtgtcatcggtaaaccagccgtcaacgtgaccatcaattgaaatgccattgtcatcatagaatgccaccagcttgcccagcttcagcgtacccgccagcgagcaaacctcgtgtgaaatgccttccatcatgcagccgtcacccataaagacccaggtattatggtctacgatgtcatggcccggacggttgaactgcgctgccagcgtgcgttcagcaatggcaaaacccaccgcgttagcaatgccctgccccagcggaccggtggtggtttccacgccgacggtatagccgtactcagggtgacccggcgttttagagtgcagttgacggaagttttccagctcactgatcggtaaatcgtagccggtcaggtgcagcaggctgtaaatcagcatggagccgtggccgttagacagcacaaaacggtcacgatcggcccagtgtgggttggttgggttatgattgagatagccgcgccacaatacttcggcgatatccgccatgcccatcggggcacccgggtgtcccgatttagctttttgcactgcatccatacttaacgcgcgaatggcgttggcaagatctttacgagagggcatcttctactccagttcggattaatgatttgcgccttaacctgttgtaattaatcagctatcgggcaaagcacggggaaaagtttcaccacaatgtacatgaaaaacggggcaaaagtaatgtggtaaaacgctaaatgttcccgcttcgtctggcttttccagtaatgtctgctagcaaaatggcctatcgcgaactataacctgttggttcaaccacctggcgcagattcaggtgattgttttttatcttgttacttatgggacgacagaatgaaaattcaaaaaacggcactggctctgggcctggttgcattgctaagtggttgtgaaggcgtaaacagtgatggtctgctgcagtcgggcgcacaggctttccaggcttacaccctgagcgatgctcaggttaagcagctcagcgatcaatcctgcgcccagatggacaaagaaaaccaggtggcaccggctgacagcgaataccagcaacgtctgaacaaaatcgctgcggcgctgggtgacaacatcaatggcatcccggcgaactacaaggtttatcagaccaaagatgttaacgcatgggccatggccaacggctgcatccgcgtctacagcggtctgatggatatgatgaccgacaatgaggtcgaggcggtgctgggccacgaaatgggccacgttgcgctgggccatacgcgcaaagcgatgcaggtcgccttcaccacgacggcagcacgtaccgcggcagcttcggctggcgggatcattggttcgctgtcacagtcacagttgggtgatttgggcgaaaaactggtgaatgcgcagttctcgcagacgcaggaaacacaggccgatgactactcctacagcctgctgaagaagcgcggtattgatcccgttgggctggcaaccagctttgaaaaactggcaaaactggagaagggccgtcaaagctctatgtttgactcgcatcctgactcggaagcccgtgctcagcacattcgcgatcgcattgccgcagacgctaaataacgcgttatcagagggataacactgaggttatccctctgtcacctcagcccttgttggcagcctggacgtgcaacatgtccagcgccagagtagccgcggcaagagccgtcagatcggcgtgatcgtaacccggtgcaacttccaccagatccatccccacgatattcatgccctgtaaaccccgaatcagcttggtcgctttatcagtggtcaaaccgccaatgaccggcgtaccggtgcccggtgcatgcgcagggtccagacagtcgatatcaaatgtcagatagaccggcagatcgccaacggtgcgtttaatttcagccagaatatcgtccacgctacggtcgttgacctgagcggcatccagcacgttgaagcccaggctcttgtcgaactcggtacgaataccaatctgcaccgagtgctgagggtcgatcagcccttccttcggtgcggtaaagaacatggtgccatggtcaaacgttgggccattagagtaggtatcggtatgcgcgtcaaagtgcaccaacgccattttaccgaagtgcttcgcgtgcgcgcgcagcagaggcagcgtgacgtagtgatcgccaccgaaggtcatcatacgtttgccgttggccagcagtttctctgcatgggcctgcagcttgtcagacagatcctgtgaatcgccaaaggcataaaccagatcgccacagtccaccacgttcagacgctgacgcaggtcaaactcccacggccagcggcaaccttcccaggcgagattggtcgagatctgacggatagcgcctgggccaagacggctgcccggacggcccgaggtggccgcatcaaagggcacgccggtgatcacccactctgcatcgctgtcgtaaggctggaaatttaccgggaaacgcataaaaccaaaggcattagaaaccagtgaattgtcgtactgattgccaagggtattgtacataagtcgtcctctgtctgtgcttgagtcgggtctggcccgcgcaccatgaaggttgagataaaaaaaatccctcccgcgtcgttaggcccgacgaggaagggatgagttgctgccgattatcaacaatgtcccggcaagctgcaagcgcttcgcggggctttattcgtcttctaaataggtgtagccatacagaccactttcaaactcttgcaggaactgctcgcgcagttcgtcatccagttcagaggtctgaatttgcttacggaacagcgtcatcagttcgtttggatcaagctgaacatactgcagcatatcggctacggtatcgccttcatccgacagctggacttccacttccccattctggaacgcgaacacgtcaaccgcttcggtgtcaccaaacaggttgtgcatattgcccaggatttcctgataagcgcccaccataaagaagccgagcatcggtggattgtccacgtcgtactccggcatcggcatggttgtcgcaatcccatcaccatccacgtagtgatcgatggtgccgtctgagtcacaggtgatatccagcaacacggcgcgacgttccggctttttattcaagccttccagcggaagcacagggaacagttgatcaatgccccacgcatccggcattgactggaacagcgagaagttaacgtagatcttgtccgccatacgttcctgcagctcgtcgataataggacggtgtgcacggttgctgggatcaagatgctgctgaatatagtgacagatgctcagatagagttgctctgcccacgcgcgttgcttcaggctgtaagtgcccgatgagtaacccgtatggatatcaaacaggtccatctggctgtcatgaagccattcacgcagggagcggcgggtgttcggctcgtgcatctcctgccaggtttcccacatgctcaggataggacgaggcgcgtcttcaatatctggcgcttctggcttactgaattcgttacgctcaacgccgatgatgttagacaccagcaccgtatggtgcgccgtaactgcacgaccggattcggtgataaccgttgggtgctcaagaccatgctcgtcacaggccgcgccaattccccagatcacattgttggcatattcattcagcccgtagttaaccgaacagtcggactgcgaacgggtaccttcatagtcaacgcccagaccaccgccgacgtcaaagcacttaatgttgacgcccagtttcgccagctcaacatagaagcgtgctgactcacgcacgccggtggcgatatcgcggatgttagacatctgcgatcccaaatggaaatgcagaagctgcaggctgtccatccgaccggcttcacgcatgatgtcgaccagcttaaggacctgggtggcagacagaccaaatttggatttctcaccaccgctcgactgccatttaccggagccttgtgaagcaaggcgggcgcgaatacccagacgtggcaccacgttcaggcgttccgcttcttccagcaccatgcgcacttcggtcatcttctcaagtaccagataaaccttgtgaccaatcttctcgccaatcaacgccagacgaatatattcacgatctttgtaaccattacacacaatcactgaacgggtctgcccggcatgggccagcaccgccatcagttcggcttttgaaccggcttccaggcccagcggttcgccggagttaatcagagattcaatcacgcgcttgtgctggttaactttgatgggataaaccaggaagtaatcaccggtatagccgtaagactcacgcgcacgtttaaatgccccgttaatggagcgcaggcggtgttgaagaatctgggggaaacagaacagtgcgggcaggcgttggccttgtgcctctcgctccttgaccagcttagccagatcgacgcgtacatccgggcgatccgggtccgggcagacgctaatatgacccagttcattgacgtcatagtagttgttgccccaccaggcaatgttatacgttcgcagcatcaggctggcgtcttgatcgttcatcgccacctcctgcattgagcggagtgcaccttgttcgccagctgacgaacccttgatattcttcatgccgtcagacatcgcgaacctcaattttccgttgaaagataataatgtaaaccgactcaaaggtcggaagtctgaaaattcgttgccacatattacgtcatgctctgtctgcgtcgcgaacccgcacgatgcatccttgaatacctaagtgtaaaacactcagccatgtcaggtgcaaaagggtcgcgaataattgacgacgctcgcagcctgggcgatataaaccgctatcgcgtcagaggttagccagcgcttgtgtcgggataattaccgaaaccaataaaatgtcggcagaagagaaataaaggtgggaaacaggataacgccggcgcaacgccagcacgcgaagaacccgtgagtgggaacataaggctcataactcgtatcacctccgcacaggtcaaagacatgtggaaaagcatcagggtgaaagccagacagttgtctgacaggcgcgacgcgctagcacgtcatccttttttttctgctgagaacgcagcggcgttttatacattttgcgcacaaaaaatgcaaagagattatttgcttaatgcctccgccataaacagaattatccactgcgcagcataaagttaacagcgtaacctcaaaaagggctggtaattcgctcaccccgtaacctaaaatagacgtccagatggttttccatctaaacaggttaatatccaggcggtgttggcctgcgtgctgacactacctgactgctcacggctttgccttaaggggcgttaagtcagctaatactcacttgcgctatgcagtcgaattcaaaccattggtaaggtaaagaacataatggctaaacatctttttacatccgagtccgtatccgaaggacatcctgataaaatcgccgaccagatttctgatgccgtgcttgatgccatcctggaacaggatccgaaagcgcgtgtggcctgcgaaacttacgtgaaaaccggtatggtgctggttggcggcgaaatcaccaccagcgcctgggtcgatatcgaagaaatcacccgtaataccgttcgtgaaatcggctatgttcattccgatatgggctttgatgccaactcttgcgcagtgttaagcgcgattggcaaacagtctcaggatatcaaccagggcgttgaccgtagcgatccgctggagcaaggcgcgggtgaccagggcctgatgtttggctatgccacaaacgaaactgatgttctgatgcccgcaccggtgacctatgcgcaccgtctggttcagcgccaggctgaagtgcgtaagaacggcacgctgtcatggctgcgcccggatgctaaaagccaggtgaccttccagtacgacgacggtaaaattgttgggattgatgccgtggtgctgtcaacccagcacagcgaagacatctcacagacagcgttgcaggaagcggtgatggaagaaatcatcaagcctgtcctgcctgccgagtggctgaatgcatccactaaatatcacatcaacccgactggccgctttgttatcggtggtccgatgggtgactgcggcctgaccggtcgtaaaatcattgtcgatacttacggcgggatggcccgtcacggtggcggcgcattctctggtaaagatccgtctaaagttgaccgttcagccgcctatgccgcccgctatgttgccaaaaacatcgtggccgcgggcctggccgatcgttgtgagattcaggtttcctatgcgattggcgtcgctgagccgacctctatcatggtcgagacctttggcacagaaaaagtgtctactgaacagctgaccttgctggtgcgcgagttctttgacctgcgcccttacggcctgattcagatgctggacctgctgcatcctatctataaagaaaccgctgcctacggtcactttggtcgcgagcatttcccttgggaaaaaaccgacaaagctgcccagctgcgtgaggctgcgggcctgtaaggctgacgcatcactgaaaagccccgccatctggcggggcttttttttgcctgttctgcttccttttcatggcgttttttccttctgcacatttttttaactcaactacactttctttcggcttgtacgctgctgatgtgttaacgcttacaatttgaaacgctttatatatcggctatttaggaatttatcgccgtagttattcttctgaaaatgcgttattttcagcgtcatctgataggcgttaaacaggacattgtcagaaacttcgagggtgctatacctcactggttacttgacctttctgggttgtaaatgctggatttcagggtttcagcaagtgtaagcgattacatcaatgtgatcgggttcactttttgctcagttaaggttttttaacatcgataacaacaatgatggataattttggaggcaaccatgcctggcaattcacataaaagcagaacctcaaataaggcaatgaccttatttgtctgctttctggcagccctcgcaggcctgctgtttgggttggatatcggcgttattgccggtgctctgccctttatcgcgaaggactttaacgtcactgcccatcaacaggagtggattgtcagctccatgatgtttggtgcagcgatcggtgccatcggcagcggctggatgtcatcccgtctgggccgtaagaaaagcctgatggccggtgcgattctgtttgttattggctcactctggtcagccatggcaccgaaccctgaaatgctgatcagcgcacgtgtgctgttgggtctggcggtaggtatcgcctcttacaccgcgccgctttatctttcagagattgcccctgaaaaaatccgcggcagcatgatctcgctgtaccagttgatgatcaccatcggtattctgggtgcttatctttccgatacggcgttcagctttacaggtaactggcgctggatgctgggcgttatcactattcctgccctgctgttgctggttggcgtgttcttcctgcctaacagcccacgctggctggcggcgaaaggcaacttccgcgatgcgcaacgcgtactggatcgcctgcgtgataccagtgagcaggcaaagcgcgagctggatgaaatccgcgaaagcctgaagatcaaacagtcaggctggggattatttaccagtagcagccacttccgtcgtgcggtgtacctgggcattctgctgcaggttatgcaacagtttaccggcatgaacgtcatcatgtattacgcaccgaaaatttttgagattgcaggtttctcaaataccacccaacagatgtggggaacggtgattgtcggcctggttaacgtactggcaacctttattgctatcggtctggtggatcgctggggccgtaagcctaccctgattctgggcttcctggtgatggcggccggtatgggcgttctgggcaccatgctgcatatgggcattcattcgtcaggcgcgcagtacttcgcgattggcatgctgctgatgtttatcgtgggctttgccatgtcagccggtccgttgatctgggttctgtgttctgaaattcagccactgaaaggacgcgatttcggtatcaccgtgtcaacgaccaccaactggatcgccaacatgattgtcggcgcaaccttcctgaccatgctgaatacgctgggcaatgcaccgaccttctgggtttacggtctgctgaacgtcttcttcatcgtactgacggttatgttaattcccgaaaccaaaaacgtttcgctggagcacattgaacgtaacctgatggcaggcaaaaagctgcgcgacatcggtcagtaagcctccgcttttcatgtgtatctcaaagccagtcagtgaaaactgactggcttttttgctggcgttttaccgtcgttctctctcgaaaaatcccccgccttattatcgtcaagccctgctatttccccattgtcaccgtcaccgcttcgcttttctttcattaaagtcgaataaaaatacgccgataaattaaatgacgttttcattataaaaataatttttcagactttacgtttaccaggaaatcaaatgaacagcaccagcataaaaaagacaatgagcacccgtgctcagatgctgctggccggcggaatgacgattgtcgtggggtttactgcgaccatcggattactcagttggcagtcatccaaagaacaaaaatcccttgctgccgaatacctgcagcaaattgctgccggtcatggcgggcaaatccagcaagaactgactcacgcgctggatgccgcgcaaaatctgggacaaagcctggccgctctgcctgcggcggggataaccgatcgcaaagttgccgataagctcatggaatatgcgctgcacaaaaacccagactttgtgtcgatgaccgtggtgtttgaacccgatgcctttgacggccgcgatagtgccttcgtcgggcagcagggcacgccacctggtggtcgctatgcctggtacatagaccgggacaaagacggccgttacaaaatgaatccggcactggattatttgcagcccggtgccggaaattactatttgctgccgaaggaaacgctaaaggacacactgattgagccttacagcttcgcttatgatggcgcaaaaccagagtggctaacctcggtggcaacgcctgtcatggtcaacgacaaactgaaagtggtggtcagttccgatatcctgctgtccgccatccagaaaaaggtcaatcaaatcaagccctggcagggaaccggctatgcgctgctgctctcgaatagtggcaacgtgatttcctcccccgatgcaggtgaagccggtaaaaaatggcagggcaatgtaaacggctatcgtacggcagtgacagagcagtacgatcccgtcctgaaagaaaaagccatgtatacctggtacccgataagcgtaggtaacagcactaaaccctggtatgtcgggattgtcgcgccggtcagtcaggtgatggcggcggctgaccagcagctttactgggctatagcgttgatgataatcagtattctgtctgtaggggccgtgttggggctgttattcaaccgtaaagtaatgcgtccgctgggcggtgaacccgcagaggcggcgcgcattgcgctggccgttgctgagggccggttaaacaacggcattcaggtggcgccaggtgacagcagcagcctgttttatgctttacacaccatgcaggcacagttgcagagtatcgtgggtcaaatcaaagacgccagcacttcggtccagcagggtgcgggcgagattgccagtgcgaacctcaatctcgcctcacgcaccgaggaacaggcggcggcgctggaacagaccgccgcgagcatggagcagattagcgccgccattcgcatgaatgcggataatgcacagcaggcaacgggcctgaccgaaaatgccacgcgtatcgccagccggggagaaaccctggtggatcaggtggtaacgaccatggcccagatcgatgaaagctcaaagagaatcggtgatatcaccacgctgattaacagcatcgcgttccagaccaacattctggcactcaacgccgccgtcgaagcggctcgcgccggagaacaggggcgcggctttgctgtggtggcctctgaagtgcgtaatctggctcagcggacgaccagcgccgtgaaagatatctccgccctgattgaagcgtccgccgtgcgggtcgaaaatggtgttgtactggtcaacgatgcgggcaaaaccatgcatgagatgacgactgccgtttcatccgtgcagcatatcatcggtgaaatcgttgccgcctccgatgagcaggctcgcggcattgcgcaagtgaccatcgccgtcaacgaaatggatgggaccacgcagcagaatgccgcgctggttcagcagatgtcggccgcgtcgagttcgcttgaggaccaggcccggcaactggcgcagacggttaagcagtttcattaaaaagtgggtggtgccggtcggccagcatgaccttttttgcaggcggtgtattgctgttgagttcctcgcctgcgccgcttatgctgagcgccatgaaaacagcccgtcttcccattgccctgcaacaagccgttatgcgcgccctgcgtagcgcgcttgagcgggccaatgaaaagcttgaacgccattatcctgagccaacgctggtttatcagcagcgtggcaccgccgctggcacggcctggctggaaaaatgggaaattcgcctcaatcccgtcctgctgatggaaaatcagcaggcctttattgaagaagtcgttccccatgagctggcccatttgctggtgtggaaaacctttggccgcgtcgcgccccatggcaaagagtggaaatggatgatggagagcgttctgggcgtgccggcacggcgcactcatcagttcgaagtcgagtcggtgcgcagccgcacttttgcttatcgctgccagtgtcagcagcaccagcttaccgtgcgtcgccataaccgcgtgctccgaggcgaaagcgagtaccgctgcgtgcactgcggtagcctgttgaaagccgacgtctctcccctctcctgaacggattctcattccgcctgcgcctgcattctggtaccctgccgcccttttaaggatcaggggtaaaactggaatatgtctcgcaaattaatcataaccacggcgctgttactggcatcttttaacagccaggcccttaacctcaataactatcatcaaaataattttcagcaggccaaagccttcgccgcagagattaaccaggatgcgccaggcagcttttattgtggctgtaagattagctggcacggcaaaaagggcgagcctgacctgaacagttgtggttaccagccgcgcaaaaatgccaaccgcgccgcgcgtattgagtgggaacatgtgatgcctgcctgggagttcggtcatcaacgtcagtgctggcagaatggcggccgcaaaaattgcagtaaagatgccgactaccgccgtatcgaaaccgacctgcacaatctgcagccggccatcggtgaggtgaatggtgaccgtggtaactatgcttacagccagtggaacggcactgaaaagcagtacggtcagtgcaccatgcaaattgattttaaaaacaagcaggcgcagccgccagagcgggctcgcggcgcaatcgcccgcacttacttctacatgcgtgaccagtatcatctgcgcctgtcgcgtcaacaaacccagttattcatggcctgggacaagctctatccggtgagcaaatgggaatgtgagcgcgaccagcgcatcgcgcgtgtacaggggaatcataatccttatgtgctcgaggcttgcaagcgttaaaatccctgccctaaactaacggtttcaccgccccgccgcgttaatcccgcggcgtttagctctcagggaccttatgcgcatacctcgcatttatcacgcacagcctgttcacgttggcagtgaaattacgctggacgacgacgccgccaaccatgttggccgcgtgctccgtatgaccattgggcagcatgtagaactgtttgatggcagtaatctgactttcgcagcagaaatcacgcatgttgataaaaaacgtgtaaaagtatccatcacggcaagccaggaagacgatcgcgaatcaccgctttatctgcatctcggtcaggtgatgtctcgcggcgaaaaaatggaatttactattcagaaatcgatcgaactgggtgtaaatgtcattacgccgctgttttctgaacgctgtggtgtcaaactggatgccgaacgtctggcaaaaaaaattcagcagtggcaaaaaattgccattgccgcctgcgaacagtgtggtcgtaaccggatacctgaaatccgcccggccatgacgctggaagcctggtgcagtgaagcagaaagtgggttaaaactaaatctgcatccgcgcgccagccacagcatcaatacgttgccccagccggtagaacgtatccgcctgttgattggtccggaaggtgggctgtcaacggatgaaattgccatgacggcgcagcatggttttaccgatattttgcttggcccacgggttttacgcaccgaaaccacggcactgaccgccatcacggcacttcaggtgaggtttggtgacctgggttaagcgatacttttagcttcatcgggtcgcgctcagcacaaaccgcgtcctgactgttcagccccttttcgcccgaacggaacgagacggtaatccccgcctccttcaggagataataatgatcaagcttggcatcgtgatggacccgatctcatccatcaacattaagaaagactccagctttgcaatgctgctggaagcacagcgccgtggttacgaaattcactacatggagatgaacgatctctccctgcgcggtggcgtggctttcgcccgcactcgcctgctcagcgtggaacagaatgccgaaagctggtatcagtttggcagcgagcaggtgattaaactggctgatctgaacgtcgtgttgatgcgaaaagatccgccattcgacaccgaatttatctactgcacctatatcctggagcgcgcagaagaacagggcacgctgatcgttaacaagccgcaaagcctgcgcgattgtaacgaaaaactgtataccgcctggttcgcagaattcacgccagatacgctggtcacccgctctaagcaacagctgcgggcgttctggcaggagcatggcgatgtcattatgaagccgctggacggcatgggcggcgcgtccattttccgcgtgaagcaggacgacccgaatttcggtgttatcgcagaaaccctgactgaacatgaaagccgttactgcatggcgcaaaattacctgccggcgatcaaagacggtgataagcgcgttctggtggtcgatggcgaaccggttccctattgcctggcgcgtattccgcaggggggagaaacccgcggtaacctggcggctggcggacgcggcgaagctcgcccgctgagcgaaagcgactgggaaattgcccgccgtgtcggccctgccctgaaggccaaaggcctgatttttgtcgggctcgacattattggtgatagactgactgaagttaacgtgaccagcccgacatgcattcgtgaaatcgaggccgcgttccctgtctccatcaccggtatgctgatggacgccatcgagaagcgcctgggctgagcataacgctggggccatgctccgtgatcaacccaacaccggtgcagatgtcacgcaccggttatctttggtaaagcatgtgagaatgaatttacagcatcactttttaattgccatgccatcgttgcaagatccctttttcaaacgttctgtggtctacatttgcgagcataacgaagaaggggcaatggggctgattatcaataagccgatggaaaacctgacggttgacggcattctgaaaaagctcaagatcgccgaagaaaaccgcgacccggcaatcaatcttgataaaccggtgttcagcggtggtccgctggcagaagatcgcggctttattctgcattcggcacagcgaacctttacctccagcattcgcgtctcagacaacaccgtgattaccacctcacgcgacgttctggaagcgattggcacggcctcacagcccgatcatgtgctggtcgcgctgggttattgtgcctgggaaaaagaccagcttgaaaacgagctgatggaaaacgcctggctgaccacaccggctaacagcaacatcctgtttcagacgccgatctctgagcgctggcgtgaagccgcacgcagcattggcgttgatattcacaatatggccagcgatgcaggtcacgcctgatgaatacacaaacgttgttaggttttgacttcggcaccaaaagtatcggcgtcgcggtgggacaacagctgacgggcaatgcccgcccgttgagtgcgctcaaggcgcaggatggcacgcctgactggctgcaaatcgaaaaactgctcaaagagtggcagcctgattttgtggtggtgggattaccgttaaatatggacggcactgaacagcctttgaccgcgcgcgcgcgcaagtttgctaaccgcctgcatggtcgtttcggcattcgcgtggagctgcaggatgagcgcctcagcaccgtcgaagcgcgagccgatctgtttgaacggggcggttatcgtgcgctgaacaaaggatcagtggattcacagtcagcggcaattatcctgcaggactggtttgaaacccattaagcaataacgccttcggcctgacgggccagacggctctgctcaaacgtttgcattccggcctgcgcgccggtttgcaaaatggcaggaatctggtgcattttgccttcccgaatcaggttgatgaccgcactggtcgtaatcagcacctcaaacagcccgactcttttctcatcgatggcagaaaccagctgctgcgcgattaccgctttcaggctgcccgccagttgcgtgcgtatcagattcttttcatctgcaggaaacacatccaccagcctgtccaccgcctgaaccgcgccgcgcgtatgcaaggttgccagcaccagatgtccggtctctgcggcggtcagtgcctgacgaatggtgtcactgtcgcgtagttcacccagcatgatcacgtcaggatcttcccgtaaagccgctttcaggcccagactaaacgaccggcaatgcaacccgacttcgcgctgttgaatcagggattgctggctgtgatgaataaactcaatcggatcttccagcgtcagaatatgccgcgcctgcaggcggttgatggcatcgaccatagccgccagcgtggtcgatttaccactgccggttgcgccggtaatcaaaatcagcccgtcctgtttattcagtaaggtcggcaccacctccggcaggcgcaacgctgccagcgtgggacagtggctggcaataatacgcaacgccagtgacagcccgttacgctgcctaaacagattggcgcggaggcgttgtccactcaccagggttaacgcaaaatccagctgcccttcttgcttcagctgcgcctgctgttcagtgtccagccatgccgaggtaaaccgcgccatccagtcagcagacaggacaggctggtcgggaagcgtttcaagcctgccctgacggcgccagtacggcaaatgtccgttacaaaggtgcagatcggcggcgttatgctttacactaagcgccactatttcatccaaatccattttgatctccagactatgacttcaatccagcacaacctacagcaagtccgtcagcgaatcgctgctgctgcaacccgttgcggccgggcaccagaagaaattacgttacttgcagtaagcaaaacgaagcctgcgagcgcggtcgaagaagccgcagcggcgggtcagattgattttggtgagaattacgttcaggaaggggttgaaaaaattcagtccctggcctcacatcctggattgatatggcatttcattggtcccctgcagtccaataaaagccgactggtagccgaacattttgcctggtgccacaccgtcgatcgccagaagatcgcccagcggctcaacgatcagcggcctgaacatctgccgccgctcaatgtcttaattcaggtaaatatcagtgacgaaaacagcaaatctggcatcatgctggatgcggttgccgaactggctcaggagattaccgccatgccgcgtttgcggttgcgcggactgatggcgattccggcacccgaacaggattatcagcgacagctggcggtatgccagcaaatggctgatgcatttcaccagctaaaacagcaatatagtgatgttgacaccctctcactggggatgagcgatgacatggaggcggccatcgccgctggcagtactctggtgcgcattggcaccgctatatttggcgcgcgtgattacacacaaccttcacaacaataattgaggaacttcatgttaacaatgacgtttttagtaaaaacgataatcgatctctacgtcatggtgctgctgctgcgcatctggatgcagtggtcacgttgtgatttttataatccgcttgcccagtttgtggtgaagattactcagccgattgtgaaacccttacgtcgtatcctgcctgcactgggtccgatcgatacggcatctttgttgttagcctttgtactgacaacgcttaaatacccgcttctgctgctcatccaggtcggcgtgttctctgtcgatcccaccaatttgctggttgggctgctgtcgttgctgaaatctgccggctatttggtgttctgggtgattatcattcgctccctgatgagctggatcagccagggccgcggtgcgatggacttcgtgctgatccaactgaccgagccattaatggcgccgattcgccgcattctccctgccatgggcggcatcgacttctcagccatgattgtgattctggtgctgtatgccctgaatttccttggcatggatctgttcccgggtctctggtatttgctgtaaatgaatcaaactggaactgttatgcaaaaagttgttcttgccactggtaatcccggcaaagtacgtgaactggcggatctgctcgccgcctttggtctggatatcgtggcgcaaaccgaactcggcgtggaatccgccgaggaaaccggcctgacctttatcgaaaacgccatcctgaaagcgcgtcacgctgcacagcttaccgggcttcctgctcttgcagacgactccgggctggccgtaaatgcgctgggtggcgcacccgggatttattctgcccgctatgccggtgaagaggccagcgaccagcagaacctggaaaaactgcttcaggcgctggaaaacacgcccgacgggcaacgtcaggcacagttccactgcgtgctggtctatttacgtcatgcttctgatcccacgccgctggtgttccacggtagctgggacggggaaattacccggacggcagccggtaacggtgggtttggttacgatcccgtgttctatgttccggcattgggtaaaaccgccgccgaactgactaaagcagagaaaggaaaagtctctcatcgtggtaaagcattgacgctgttactggaagcgatgcgtaatgcctgatttaccgcctctgagtttgtacatccacattccctggtgtgtacagaaatgcccctactgtgattttaattctcacgccttaaaggatgaggtgccgcacgttgaatatgtgcagcacctgctgcgcgatcttgaaaacgatctgccgctgattcagggtcgcgaggttcgcacggtgtttatcggcggcggaacgccaagcctgttaagcagcagcgccatgcagatgttgatggatggtgtgcgcgagcgcctgacgctgacggcagatgcggaagtcacgatggaagcgaacccgggcacggtagaagctgaccgcttcagcgcttatcaacgcgccggcattaaccgcatctccattggcgtacagagcttcagtccgcagaagctggaacgactgggccgtatccacgggccagacgaagcgaaacgcgccgccgaactggctcaggggttaggcttacgcagcttcaaccttgacctgatgcatggccttcccgatcagtcactgacggaggcgctggacgatttacgccaggcgattgcgctcaatccaccgcatctttcctggtatcagttgaccattgagccgaataccttatttgcctctcgcccgcccacactgccggatgatgacgccctgtgggatattttcgagcagggtcatcagttgctgaccgccgccggttatcagcaatacgaaacctcggcctatgccaggccgggctaccgctgtgaacataacctgaactactggcggtttggtgactatctcggcattggctgcggtgcccacggcaaactgacccagcccgatggccgcattgtccgcacgataaaagtgcgtcatccgcgtggctttatgaagggaaactatctcgacaagcagtacgacgttgtggacagtgataagccgtttgagttctttatgaaccgttttcgtttgctggagcccgcgccgcgtgctgactttagccgctataccgggctggatgaaacgtgggttcgcccgcagatcgaccaggcgcttgccgcaggctacatcaccgaaacgccggaatattggcagattacagagaaaggcaaactgttcctgaacacgttgctggagctgtttttagcggaagcgtagcgccttcccggcccggaagcctgacgccacaggtgagcgtaaccgggccgtttgcaccgccgttcaaccgcgctcggtattctgccttagctgtaacagcctcgtgttaataatggcgatgttaacctcacagggcatgccatcatccagatagacggtttcgttgatctccagcgccgcatcattcgcattaaaattcagcagcctgagctgctcaccgtcggtaacgttgatggcattcagttgctgatcacgacgctgaattttcttgccggtgatctgttcaatgtacgaatattttgagatttccagtcgcccaaactccatgctgttaaacaggctgacgggcagatggatatattccagtgcgacagggatgtcatcaaagcacatcagacgaacgattttgtatatctggtcgctgttcttgatgcgtaaagcctgcgccatatcgggcccgggcactttgataatgctggcagtgagcaccttcctgaccgctttgtgtccttttttgtgcgcctgataatcaaacggcgaaagtgcatgaaaccggccagaatgattactcttgccgattgagccgacgaacaggcccgaaccttttacccgataaatgcgctgctgctcaataaggattcgggtggcttcccgcaccgtcgcccgggtaatgccaatgttcttggcaatggcaatttctgtgtccagcttatcgcccggcagaaggccatcctgcatgatcttcgtcagaatatagtcgacaacctctttttgcttctctgtaatgccatcgaacatcagcatgttcccgaatagtgtgcccgtgcctgcggtgcgctacagcaacgcctttacgcccgatttccgtcacgacgtgccagtaagaaaggacccagatgtgatccagctaacgattttgcactcaaattcccttcgcccagccagaaatgattcttgcatattgtatctgtacaggtcgaggtgcatcatcaagatgactagacaggtttaacatgtctatacgtacgaaacgttttttgcaacagcggatgttcaaaactgatgcgtgcagtcaaaataaaaaccataatttataatggtttatatttattttctttttcatcctgctgccagccgttttgctggataaaacggaaaagggatgacagcgtgaagaaataaagaaagctgactgtacagcttgatgaatgcggcgagcctgcatcctgacttttttgcataactttttatccaggataacgtatggcgaatctgacccaatggctgaatgccgacaaaattcactatcttgaacgcgtttctgactggaaagccgcgattcaggtcactggcgatcccctgctcagagaaggtgcgatttcacaggattacatcgacacgattatccgccttaaagaggaaaccggcccctacttcgttatcgcaccgcgcattgccatgccgcatgcccgccctgagcagggtgcaatgaagctgggactctccgtggtgaagcttgcaaacccggtcacctttgatgcgggggaaaacgatcctgtcgacattcttttcatgttctccgcccctgacagcaacagccacatcgagatgatctcgcagctggctgaagtcttgactgacgacgccatcatggaacgcgtgtaccaggcacaaagccaacacgcgttgtgcgcggtgctgttagcaaacgacatgtccaattaacctattcaaattcaaagaggtttttatgaaaattatggcagtgtgtggttcaggcctgggaagcagcttcatgatggaaatgaacatcaaaaaagtgcttaaagcgattgatgtcacggcggacgttgaacattccgatctcggctcagtgacaccggacgtggcggatgtgtttgttatggcaaaagacatcgcctacagcgctaacctgccgccggaaaaagtcatcatcattaataacattatcgacctgaaagaagttgagcaaaaaattcgcgactacttcaataaataatcctgtcacccacttataaaagaacacttaccgctgaggttattatgtttatacaaaaccttttactggtagttgtcgacgtgctgaaagtcccctctattctggtcggactggtggcgatgttcggtctgatcgcgcaacgcaaaccgctgccggatgtgataaaaggcacggtaaaaaccatcctgggttttttagtactggcaggcggtgccacggtgttggttggttcactaacgccgctgggggatatttttaagcacgcatttaacgttcagggaattattccaaataatgaggcgatggtgtctatcgccctggcgaagtatggcgcgcccacgacgcttatcatggcgtttggcatggtggcaaatatcaccgttgcccgttttacccgcctgaaatatatctacctctctggtcatgtgaccttttatatggcctgtatgattgccattatcctgtcggtggctggctttgaaggcgtacagcttatttataccggctcgctgacgctgggaatgttaatggcatttttcccggcactggctcagccctatatgcgtaaaatcattgggcacgatcaggttgcactggcgcataccggcacggtgggttatgtcctgtcaggctggataggttctctggtgggcaaaggttcaaaatccactgaagagatgaacatgccaaaaaacctgagttttttgcgtgacagcaccatctcgatttccctgacgatgatgatcatctattttattttgtccgtctcagcgggcagggaatatgtggagagtcagttcagccacggacaaaactatctggtgtactcgttcgtgcaggctattaccttcgctgcgggtgtctttattatccttcagggcgtgcgtttaattctggcggaaattgtgccggcatttaccgggttttcagagaagctggtgcccaacgcgcgtccggcactggactgccctatcgttttcccttatgcgcctaatgccgttctggttggctttatttccagctttgtcggcggactggtgggactgtttattcttggacagctgcactggatattaatcctgccaggtgtcgtaccgcactttttctgcggcgcaacggcaggcgtatttggtaatgcaaccggcggtaaacgcggggcaatgttaggggcctttgcgcacggcattctgattaccttcctgccggtcgccttattacctgtgctgggtgccatcggcctgaccaacaccaccttctcggacaccgattttggcgtcacggggatactgctgggtaatatggccaggttccttgataagggaacgatcaccatggtgatcacgggaatttttgccctgctggttatttataactacgttgccagcaacaaaacggtcgctaaagaggttaacaccgactaaatcctgccaggggctgatgaattcagccccttttgttttgcaacggattcaggaagggcgcaaccttgatgacgcctgaacacggacgtcttcatcgccagggcgcgcagaccctgagaacgggcgaccactggctcaatgaaccgcacggtgaagggcagacgacctgccggagcaggccctctgtgaagcattacttcagcgaactgaccagtgttttccggtctttctccagagcaataacccggttacagaccgcttttccaaactgctggaagtcggcttcctgattattccactcgctctgaatggcgttttgcaggccgccaagattccccatcaacccctgcaaaccgctgccgccaccgttggacatggctttgctgcccatctcattgatgctgtcctgcagaataccgcccatcgcctgattaaccagttgctgaccatcggcacgaacctgatcgatcgcctgatgatggaaggttaaaccatcactgcgatgctcaataatgcggttcatctgggtttttaactgggtattcagcgttgccagccgctcatgtaaccggctggattccccgacttgctgggtgatgatgttatccagcgcagcacgccctttctccagacgtgatgtggcaccgttatcgatccagggaagatcgcgacgtaaggcattttgataatcaatcgccttctgacggttagccgcattcatcgtcattttctgaccgttgaactgcacatcacccagcgtcgagatctgcatgttgccgttttcacccaccacctgcacgttttgtggcgtaataacaacatcatcctgtggtttgacactgcactcccaggcggcctgggcctgcgttgctgccagtaaaagaccggcgaccagcgcgttacgaatcatacaatctccctgtgtgggtgtgaaagcgacactgctggtaacttagtcccaccagacgtcaaagagttcggtcactttcacatcctgcagcttgcggtcgtcaagccacttgcgtaccagctcacgatgttcatcggtgcatttaccggtttgctccaggcaaatcagcccttcccatgccagataaccgctaccatcgaaagccagaccattaggcgcgatcgcttcattgatgaactgattcagggtttcgtcgatgtcactttcagcggtgccttcaggaaaacgccaggccacggaaaagcccagttcctgaaattcatcaatatgtaattttttacgtaaacggcggctgcgttgtgtggccattatttcaccctctcaaacattaaatcccatacgccatggcctaaacgctgcccgcgctgctcaaattttgtcagtggacgcgtttccggacgcggcacatacgtgctgtcttcagacaggttttgataacctgcaatgctgctcatgacctcaagcatatgttctgcataggcttcccagtcggtcgccatatggaacacgccacccagcttaagtttacgcatcaccagttcggcaaagggcacctgcacaatgcggcgtttattatgacgggctttatgccacgggtccgggaagaaaagctgaaccatgcgcagtgagttatcaggaatcattttttccagcacttcaacagcatcatgacacataacccgcagattgctgacctccgcttcttttgcagaagccagacaggcccccacgcccggcgcgtgcacttcaatccccaggaagttttgatgtggcgtattttgcgccatggtcaccagcgaggcgcccataccaaagccaatttccagggtcaccggcgcatcacgaccaaacagcacaggcaaatcaatgggatcaggctgatattcaacacccatctccggccagtaattatccagcgccagctgctggcctttggttaagcggccctgacggcgcacaaaactacgaatccgacgcaacgggcgtccattttcatcatattccggggtgatgacatcattaatcatgtagaagcctgctggtttgcctgttctgggaaacgggcattatgcaaagttcaaaagcagaagcaagcctttgccacgttctgctttattcctgggtgccctgaagcgcgatttcctgcctgagtgtagagtaaaccgcagaaatttccttgttgagatcaccctgtcaggatctcgacgcatcacgcgaaaaacggcttataaagccatcgtctgccgccgctgctggctcagcttacgatactgctgtggagacatgccgacatatttagcaaatgtgctgtagaagcggctactggatcggaatccggccgtcaacgccacatcaagcacggtgatatcggtgtcgctcaataacgctctgacatggttgatgcgcatggcggtaatgtactgttttaacgtgagctgcataacgcgctgaaaaatgcccatcgcataattggcattgagcttaacgtgttcggctacgtcattgatggtcaaggcctgatcgtagttatccgcaataaattccagcatctgactgacataaaactgggcatgacgcgacacactgtttttatgcgtgcgagaggttttgttcacccctaccggctgccatcccgacaaactaaagcgtttaagcatcaggccaatttcatcgacggcaagctggcggatctgttcgtcggggctgttgagttcctgctgccagcgctgcacttcaaacacactgagctgctgctttgccacagacttaatcaccatgccgtgagtaacatgattgattaactctctgtcgagcggccaggacaaaaacagatgcatcggcaggttaaggatagccatgttctggcagttgccgggacgcgtaagctgatgcggcgtacaggcccaaaacagcgtgatgtaaccctgtttaatctggacgacttcattattgatcaggtactccacgtcaccatcaaacgggacattcacctccacctgaccgtgccagtggctggtggtcatggccagcggcggacgcagttcgatatccatgcgctggtattcagaatagagcgacagcggactgcgggtctgcttttcatcgctgctacacatatgcgggtcgggtggaagcggtacgccaggctgcatcatcatcattccctctcctgaattatcagaaccctgccatatctgaagggctcaggccagtagcagaggccaaaaatgggcggttcgcgttaataattctctgcttttcaggccagatactcttctttccaggcaaatttatcccaaaaactcagattcgatgctggcggcgggcagatctgagcttttgggaatgctcccctgattagaaggaagtttcgttagttacggcgtgacactatgacgttatccaaccttgcaatggagcatcctgatgtctgcacccaaaattacgtttattggcgcgggttccactattttcgtcaaaaatatccttggtgatgtcttccaccgcgatgcgctgaagtcagcccatatcgcgttgatggatattgatgcaacccggcttgacgagtcctacaccgtggtcagcaagctgatgagttcggctggcgcggcaggccatattacctgccacagtgatcagaaaacggcattagtcgatgccgattttgtggtggtggcgttccagattggcggctatgaaccctgtaccgtcacagactttgcggtatgtaagcgctatggccttgagcagaccatcgccgatacgcttggccccggcggcatcatgcgcgcgctgcgcaccatcccgcacctgtggcagatttgtgaagatatgacggcggtgtgccccaatgccaccatgcttaattacgtcaaccccatggcgatgaacacctgggcgatgtacgcacgttatccgcatatcaaacaggttggcctgtgccattccgttcagggaaccgctgaagagctggcgaacgatctcaacctcaaccctgccgatttacgttaccgctctgccggtatcaaccatatggcgttttatctggagcttgagcggaaaaccgcagagggtacctacgtcaatctgtatccggaactgctggccgcctttgacgccgggcaggcaccgaaacccaatattcacggcaatccacgctgcccgaacctggtacgctatgaaatgttcaaaaaactgggctatttcgtcaccgaatcttcagaacacttcgcggaatacacgccctggtttatcaagccgggacgagacgatctgattgagcgctaccagatcccgctggacgaatatcctaaacgctgcgtagagcaactggataactggcgtagcgaacttgagcattacaagcgcgctgaacgcattgaaagtaagccatcacgcgagtatgccagcgccattatgaatgcgatatggacaggcgaaccggccgtgatttacggcaatgtgcgcaatgatgcgttaatcgacaatctgccacagggatgctgtgtggaagtcgcctgcctggtggacgccaacgggattcagcccaccaaagtcggcactctgccgtcacatctggcggccatgatgcaaaccaatatcaatgtgcaaacgctgctgaccgaagccatcctgacggaaaaccgtgaccgggtttaccacgccgccatgctggacccccacacggcagcggtgctgggcattgaggagatttatgcgctggtggatgagctgatcgccgaacacggagactggctgcccgcctggcttcacgcgtaacgtctttgtctccggacatgcagtccggctgctgctgtattccataacagaaggcgggcgctggcaacagcgtcccggtacccgatgagcatttcaataacgacaaaactcagctacggattcggcgcgtttgggaaagatttcgctattggcattgtttatatgtatttgatgtattactacaccgacgtagtgggtttatcggttggtgtcgtcggtacgctgtttttagtggcacggatctgggatgccattaacgatccgatcatgggctggatcgttaatgccacgcgatcacgctgggggaaattcaaaccctggatttttgtgggcacgctggcgaactcgctggtgctgttcctgttgtttagcgcccacttgttcgagggcacggcccagttggtgttcgtctgcgtcacttacatcttatggggcatgacctacaccattatggatatcccgttctggtcgctggtgcccactatcaccctggacaagcgcgaacgtgaagagctggtgccctggccgcgctttttcgccagccttgcctccttcgtcaccgcaggcattgccctgccctttgtcagctatgttggcggtgacaatcgcggattaggcttccagatgtttacgctggtgttaattgccttttttatcgcatcgatgttggtgacactgcgaaacgtgcatgaagtctattcgtccactgacgatgagaccacggacggcagccggttgggactgaaagccattgtcgccctcatctatcgtaacgatcagctttcctgcctgctgggaatggcgctggcttacaacgtcgcggctaacattattaccggctttaccatctactatttcacctacgttatcggtgatgccgctcttttcccctactatctctcttatgccggtgcggcgaacctggtgacgttaatcctgttcccaaaactggtgaacattctgtcgcgccgaattctgtgggcggcggcatccgcgctgcccatactgagctgtggcgtgctgtttgccatggcgctggcgggctatcactccactccgctgattgtggtggccggcatcctgttaaataccggtaccgcccttttctgggtgctccaggtgatcatggtggcggataccgtcgattacggtgaatacaagctgcatgtgcgctgcgagagcattgcttattcggtgcagactatggtggtgaaaggcggttcagcctttgccgctttctttatcgccgtggtgctggggataattggctatatgcctaacatcgcacagtcacaggaaaccctggtaggtatgcaatttattatgatcgcactgcccgcggtattttttatgctgacgctgctgctctatttccgtttctacaggctgaacggcgatatgctgcggaaaatccagatccatctcctggataaataccgtaaaccgccggcgtcagaagcgattccggtcaggagccttgcgatacctggatctgaaccgtaaaagccgcacgccgggcttttaataccgggtttcgaacagccacagcaggccaggtgcatgtcatctggcctgctgctgtctggcatttgtgattgatgctggcgcgcccgtggcgactcgcccaggggcggtcaaggcaacgcatccgacgggcctgaatgaaacaggccttttcaatcttccggtttactctcacgtgcgcttatgctggaattcctgcccgaatgtcgcgtaatcacggaaatatcccctttatgatgcaagccccgcagttcgcgcaacaggtgctggactggtatcagcgctttggccgtaaaaccctgccgtggcagttggaaaaaacaccttataaggtgtggctgtctgaagtcatgttacagcaaacccaggtgaccaccgttattccctactttgaacgctttatggcgcggtttcctaccgtcagcgatttagccgccgcgcccctggacgaggtattgcatctctggaccggcctgggttactacgcccgggcgcgcaacctgcataaagcggcaaaacaggtcgtggatgttcatggcggcgagtttccccgcaactatgatgacgtcgccgctttgcctggcgtgggacgttctaccgctggcgctattttgtctctgtcgctgggtctgcattttcctattctggatggtaacgttaaacgggttttggcacgttgttacgcggtaggtggctggccgggtaaaaaagatgtcgaaaaacgtctgtggcaaatcagcgaggacgtcaccccagccgaaggcgtcagtcagtttaaccaggcaatgatggacctgggcgcaatggtgtgtacccgctcccgaccgaaatgtgacatctgtccgcttaacagcggatgcgaagcccgggcgaacaacagttgggccagctatccagggaaaaagccgaaacagacgttgccggcgcgcagcggctggtttttgatgatgcaacatggcgacaaggtctggctggaacagcgtccgccggtgggcctttggggcggattattctgcttcccgcagttcaccagtgaagaggcgatgaccgactggctgacggcacgaggcattcgggcgaaacctcagcagcttacggcgtttcgtcataccttcagccatttccatctggatatcgtcccaatgtggctgtcatggccttctgccggggcattaatggatgaagcgggcggtctctggtataacttaacgctgccgccgtctgtgggattagccgcacccgtagagcgtcttttgcacgaactgcgccatccccagcagttgcctttaggccgctgtgagattaacgaggaagaataatgagccgcactattttttgtacttttttacaacgtgacgctgaaggacaagatttccaactctaccctggcgatctgggaaaacgcatttacaatgaaatctcgaaagaagcctggcagcaatggatggccaagcaaaccatgctgatcaacgagaaaaagctcaacatgatgaaccccgaagatcgcaaagtgctggaaaaggagatgatcaatttcctgtttgaaggcaaagacgtccacattgaaggctatacgccacccgaagcataacctttttggcctcagtactggggccgttttccaggtcaggcatgtattttagatgaataaaaagctgatagccctgctggtgattgcaccccttttagtttcctgttccggaaaaaagaacccgacctattcagaagagtgggtgaaggacaccaacggatttgacatcctgatggggcagttcgcccataacattgagaacatctggggtatcaatgaggttctgattgccggaccaaaagactacgtcaaatatagcgacaactattacacccgcagccatatcaactttgaaagcggtaatatcactattgagaccatttccggtaccgatcccacggccagcctgcgtcaggcgatcgtgaccaccttgctgatcggcgaggacccgggcaatgtcgatctttattctgatgtcaacgatatccaaatcagtaaagaaccgctgctgtatggtcaggtactggataacaccgggcaggccatccgctggcagggccgcgctcaggcgtttgcggactatttgattgcgaataaactgcagcgtcgcaattctggtctgcatgtgatctactcggttaccattccgatggtgcctaaccatcttgataagcgtgcgcataaatatctgccgatggtgcgcaaagctgctgagcaatatggtgttgatgcgtctctgatcctcgcgattatgcagaccgaatccagttttaacccctacgccgtcagccattctgacgcactgggtttaatgcaggtggtacagcataccgcgggcgtagatgtgttccgcatgaagggtaaatggggcaaaccaagccgcagctacctgctggaccccgagaacaacattgatgccggtacggcttacctgtcattgctgcagcgcagctatctggcaggcattcaggacccgctttcgcgtcgctatgccgtcattaccgcctataacggcggtgcaggcagcgtactgcgtgtgttctccagcgataaggatcgtgcggtcactatcattaacggtatgtcacccagtcaggtttatcagacgctgtctaaacagcatccgtctgcggaatcgcggcattatttgtataaggtgagtacggcgcagcggagttatcatcggttttgatggggggctgcccgccgggcgatgggttgttttgcccgtcgggcgttgggttgcttactctggctgtgagaaggttccgcccgccaggcgttgggttgcttactctggctgtgagaaggttccgcacgccaggcgttgggttgctcactctggctgtgagaaggttccgcccgccaggcgttgggttgctcactctggctgtgagaaggttccgcccgccaggcgttgggttgctcactctggctatgagatggttctgcccgccaggcgttgggcagtttcagcctgcccgtgcaggcggacgtgttaaggggcttacgccagccccttaacaatcccggcgtccggcagccgtcgctgttccttcgtcactcactgcggcctgacgggccggacggatgcaccctccctggcgcagccgtcctctgcgcggcatccctgccgctccgccctggcctccgctctctcctcagcgctccggatgcctcctgaaaacctacgcctgtgagatcgaatgttttcccggaaggtcggcgttgtctgtaattgactgcgtgcggttaaatgaatgcggacgtttagggaacagaaaaatatctttatctcaatatattaggatgcgctccggatgcctcctgaaaacccacgcctgtgagggcttatatttttcccggaaggtcggcgttgtctgtaattaactacgtgcggttaaaatgaatgcggacgtttagggaacagaaaaatatctttatctcaatacattaggatgcgatccggatgcctccgaaaacctacgcctgtgagatcgaatgttttcccggaagactggcttcgcctgttgttaacatgcgcaatcaaaactcaggacgggaaagcctgacgaacatgaaaaaatgaaaagtgatgagccaggaggcttttcctgcatctgaagcggcaacgcggttggttttactacagatatcgaagcgggggagttggccggccttcccgaccgctgagcggatgagggatttccggatgagccgacaggacgtcggcgagagccgggccgcgccagggacggcgcgtcctggcggtccggcagaaatcctgaagcagcgaagggaccgcgcagcggcgggcgggcaggacgggagcccggggtcaaggggccgcggcgactggccgccccttgtcggtcgcccgcacggggcaaactgaaactccctgccgcctggcgaacgaaaccttctcagggcctgatgacaggccatccgccgaaaccctggtgataagccgccgcccaggcataacgcaaactcattgcaccatcatatttgccaccagatacttacgtccgtcagcatcttcctcggtgtaaaccccttgtaactccggagaaaaaccaggcaactggttaatgcccgcttccagcgccaggaaatagcgctgtaccgccccgccccatgcttcacccggtaccacacaaagtacgccaggtggataaggcagtgcgccttccgccgcaatacgcccttctgccgttgcaatcggtaccagctcaacttcgccacgaatataagcctgatgcgcatcctgtgggttcactttaacctgcggcaaaccctgctcgcggaacatcatgcgttgcagatcttttacgttaaagctcacgtacaggtcatgcatctcctgacacagacggcgcaaggtgtaacccgcgtagcgtttggcgtttttacggtaaagcgtgggcagcacttcagccagcaacgtatcttctttaacatgttgctcaaactgcgccaacatcgcgaccagaatcgccattttttccgggctttctgctggcgttagcagaaacagaatggaattgagatcgcatttttccggcacgatgccgttctcacgcaggtagttcgccagaatggtcgctggaataccaaaatcagcgtattcgccactggcagcatcaatgcctggtgtggtcagcagcaacttgcaaggatcgacacggtactgatcgcgatcgtatccggcaaaaccgtgccatttagcgttaggttcgaagctaaaatagttaagatcgcgtgcgatcgcttccgttggcgcatcctgccagcgctggccattgacggtttccggcacgaaaggcaggatcatttcacaacgctcaaagatcgctttgcgcgcttcaatgcccagcatcacgcactcatcccacatgcggcgtcccgcctcgccctgatgcattttggcgttaatatccagtgcggcaaacagcggataaaacgggctggttgatgcgtgcagcatgaatgcgttgttcaaccgcttgtgcgggcagaaacgcttttgcccacgaatatggttatcttttttatgaatctgcgaggtctgcgaaaagcctgccagctgcttgtgcactgactgggtaacaaaaatgccgggatcgttttcgttaagctcaagcgtcagcggagagcaaccttccatcagcggaataaactgctcatagcccagccaggccgagtcaaacagaatgtagtcacacagatgaccaatgcgatccaccacctgacgcgcgttgtagaccgtgccgtcgtaggtgcctagctgaataatcgccagccggaatggacgcgcgtcgttagcccgctcaggtacgactttcttgatctgttcgcgcagatagccgtcgtcaaaacagtgcgcatcaatgccgccaataaagccaaacggattacgggcagcctcaagataaacaggcgttgcccctgcctggatcagcgcaccatgatggttggatttatgattattgcggtcaaacagcactaaatcaccgcgcgtcagtaaagcattggtgaccactttattcgcgcttgaagtgccatttaacacaaagtaggttttatccgcattaaacactttggcggcaaatttttgtgcatgcttcgccgagccttcatggatcagcagatcgcccagcttaacgtcggcattacacatgtccgatcgaaaaacgttttcgccataaaaatcaaaaaattgcttacctgcaggatgctttttaaaaaacgcaccgccctgatgaccgggacaggcaaacgtgctgttttgcatgtcgacgtaacgcgtcagagtttcaaaaaacggcggcaataatgcggcttcataagcctgagcggcggtttccaatgccacccaatcctgcggctcgccattcagttcacccgtgacgccaggcaggtgcatcacctcttcttcgaaggcattggcaacaaacaccggtaaattaaaaccagtgtgacgtaacaacgccagcacgccactgcgtgtatcagccagcgagacgaccacagccgccacatcggtaaaatcagtattatccagcgtaaccacgtcgcgcgcagtattcagggtcagattaggcgcaacagcagcgctggcagcaattttaagtggtgtcataacacaaatccctaacagtcagggagtgggtgcctgaggcacggcaatagggaaatttccccggcgaataatgtctgacgcgatagaccgatagacatcagtaaagagtagtccttactcatgtccaacagttgcggcccgattggcctcaccgcatagtgaacgatgtgtgtgtaactggcatgacgacgaggaacagttcacgcgccagctcaggcgagtgggaacaagtgcggatgcgcattgaaccggacatgatagcgtcctctgttagcgggcggtggcaagaaaaaagtggcggtcataatgtcattttttaccggcaggaacaacccgacaactttatatatcaggtcaataaacacaaaataaaaaagccttaaatatcatttaattgcatttaaaacgctcatgaccaaccgattaagtttttgtaattaatgcaaaattatgcaatatgcaaatacggcagcaccttcatcagcctgcactggaacaccaccaaattgcggcacgtcgcgcacttgtcggtccagtgcctaccgcaatcggcgtatccggcgtaaacttgcctgattattcttatgcctgacggaggctgcatgtttaaggcactggtcatcgacaatgacgaacagggttaccgctctcaactcaaagaactctccgaaacacaattacccgatcaagacgtcaccctcgacgtaagctattccaccctcaactacaaagacgcgctggcaatctgcaataaagggccgattgtgcgccagttcccaatggtgccggggattgatttcgtcggacgcgtcacggcaagccgccatcctgactggcaagaaggcgatgcggcgctgctcaccggctggggcgttggggaaaaacactggggcgggctggcacagaaagcccgcgtgtctggcgactggctggtcgcgctgccggatacgctgacacccttgaataccatggcaattggaacggcgggttttaccgccatgctgtgcgtgctggcgcttgaaaaacagggcgttaagcccggtagcggtccggttttagtcactggtgccagcggaggcgtcggcagcttcagcgtcgctttactggcaaagcttggctatgaggtaatcgcctccagcggacgggccagcgatgaagcctatttaatctccaccctgggggccaccgcggtgatggatcgcgccgaactgacccaacccggcaagccactgggtaaagagcgctgggccgccgccatcgacagcgtcggcagccacacgctgagcaatgtgctggccgggatgcagcgtgacggcgtggtggcggcctgcggcatggcacaggggctggatctgcccaccagcgtcgcgccctttattctgcgcggtgtgacgctggcaggcgtagacagcgtgatgtgccctaaaccgctgcgacaacaggcctggcagcggctggggcagcttctggatgatgcgttactgagccagatgacaacagtcatcccgctcagtgaagtgtgccagggcgcacaggacctgctggatggcaaaatccggggccgtctgatcgtcgactgcgcttaatgctcttttacggtctggagcgacgaaggcgggcgcgtcagtaattcgctcagcccctgaatcgcccagatcgtcccctgctccatcaccgctttcggctcaccggaaaagtgctgacagcgggcgatgacgtcaccgcccggcaaggcccatcctacccaaatcgtacctgcgggggtgccatcctgtccgccgtccggcccggcatagccgctgatagccagactgaccggctcaccagagcgctcacgcgcaccccgagccatttcgcatacggtttcccggcttaccgccgtatgtttttccagcgtgtcctcgctgacgccaagcagtcgtaccttggcgctttcgctataggtcacaaaaccgctggtaaaaaaatcgccactgttttcgactgcagccagcgtcatgctgattaatcctgccgtgcaggactccgccgtcgccagacgaagaccagaggataaaagttgctgccccagtaacgctgcggcctcattaagtttcatcatgggttttcctttgtttcctgccatgagtgaagtatggccgaaaccacacaacctgaaacagctaatctgatgttttatcagaataaacgcaggcgcttacctgtaccgtttcggctggcgatgggttaaggtttgcgctgctgtctgccacgggtgaggattcgcgtcagggttagcaacaaaacatcaagacaagaaacccatgcgtaacagcacagccggacgcgcacgctaatagcgcctgctggtctgagcgttaacgaataagaaagagagggaaagatgcaaaaacccgtgatcgtcatccactactgtacccaatgtaactggctgctgcgctccgcctggatggcgcaggaactgctgcaaacctttgcacaggacttagccagcgtgacgttgcgtccgggcaccggcggtgtatttgaaattaccctggatgagcatctgttgtgggaacgcaaacgcgacggcggattccccgatgcccagacgcttaagcagcgggtaagggatatctgtttcccggagcgttcgctggggcacattgataaaaataaatctgacgacagctgatcaccagcctcagtcattaactgcggttgatttcatctgccgcagtcttcagcaccgcaacaattttttcccgggtttcatcggtaatctcctgctgcgccaggcgagtgtttaaggcacttttgaagtgataaatagcctgctcaatctccggtatgctgcggttattgaccagaaccgcaagggatgacaaacgcttcatcaggcgagatagcaatgcggcatcgcgctttagcatggcgtggcccgtttcggtcagcacaaaagccttacgcgcggcgagaggatcatggatatgaatggcgtccatctcctccagccatgtcagattgggataaatgatgccaggactgggcgaatactcgccttttgacagctcctcaatacatttaatcagctcataaccatgcgtggcacgctgcgagataaaatgcagcatcaacagacggatctcgcccgcatccaacattttttcacggcgcttgcgacgtccactgcacggctccgaatgcgcatcgtggttactctgccctgaatgtgccgaatccattttcattctctgcctgagtcagtggaaagagcctgatggtagtgggccgtcaggcaaaattcaatcaacagcaggtcacgtaaatccagttagcagaagaagacttacttttgatgccagtaagccacggcacgcacacaatcagcgtcaaccccgcgctgcgtggtgaaatagtcacacagctgtttcacgaactgcccttctccggtaagccagataaaggcgtcgtgctgcggaatagctatcttatccagtgcagcagtgagctgcggtaaatccgccaacgtcatgttacccctgccgagccagctgatctctgcattgccggtatccgccaggcaagcgcgcccggcggcctcatcggcgtaggcaaacagatgcagcgcctctgcctttactgtgctgctgcggcgcttaaacgctggcagcccggtttcatcgcacacataaagctgaaaagcataatctgtcggcaccagcaaagaaccacgcggaccaccgatgattaaggtatcacccacctgcgcctgcgctgcccagttactggcgacgccgctttcatgactgtaaaaatccagcgtcagcgatgacaggccgtcgaacgccagtggcgtatagtcgcgcgctaccggccgcaagccgtcttgccactgaataccgtcctcgttgatcgtcggcagtgccagcgctgcgccgtcagcggagggaaagaagaccttaatatggtcgtcaaaaccaggggagttgaagcccatcaggtcgtcacctgtgaagacgatgcgccaaaacgtgtcggcgatcctggttttttcggccacatggatgcgacgaaagcgcagttcgttacgtacgcgttcaggtaaacgacggggataagatgtatgcacagtaactctccggaaacgcggctgtgcgagcgggaatggttttcgcgcggcctgagtaaatagaaatcattctcatgctagcggctcagaatagctatgatatatcttaagaacaatgaccaaaaatgcgatcggttatgaagagagggatcgcaagggaagaagaaacgggcacgtaaaaacaaaaaaggcgcttgcgcaccttttaagaggactgacggcaataacgttgttatcgaaccgggttttgtccgctgctttgaggcagagagctgtcaccgagtatctcgttatgcgtgccctgcgagccagggtgcaaacctgttggcacattgacaggatcggtcatttgcgcgccagccagagccggagccacagacagcgcgatagccagcagcattgctgatatctgggaaagtttaatcatagtttttagcctgataaggcgcagaaagcaggtgaatattccagctcagagaaataaaagccgtcgtagtggctcctcagtgagcttcagggagaattttacgcctcgccagattacctgcttataaaatcgtgcgctttatcacagtatggcgcacgtaatgtgcattcagcattgcgttaccgggatggaaaatacgccttcaatgttgtcagccgtgcaccgggctaaatccaggcacagtaaatccatccccggacggcaggcaacgcccaatttgggcaaatgcagataataaatatccgcgataaaacgcgtgagttgttccggcgtaccgctccacgtaaggctggcatacaggccaggctcaactatgcggaccggcttatcctgatggacatcagccgctggttgcacctcaaccccgcgaaacagactgatgtgctgctgttcaacagcgctgcttcccggaccgtactgaaaccccaaccagccgtgtgcagttccctgatgcgcaaggacaaaatgacgaacctgttcggcaacgcgctgatggcgatcgcatatatagtcgccgtacctgcactcccactccagcgtctcgccctgcaactgcaacgcctcttcacgtactgtcagtaacacctgttttactggcgtgcgctgggcaatgcgtccgtgaaaatggcgcacaggtaagactctgaggcgtcggaaagcccccggcgtcatcgtgaaatggtttttaaagacacgattaaaattttgctgattttcaaagccgaaacgcaccgcaacatcaatcaacggcatgcgggtcagtcgcagtgccatggcggcgagcgtgagccggcgttttcgcgtataggccgccagtgtttgcccggtcatctccttgaacaaacgctgcatatgccattttgagtagccggatttgagggtgatctggtcgatattaatgtcgttggtcaggttggcctcaatccagtcgactagatcattaatatgctgtttttttatggtttgacttagcattgatgtatgaacagaaaaagaggggggaattcgtcataaaagagtaacaaaaagccttacaaaatgtaatgaagcgcagggtaaacgtcaggatggacggcgaaaagcgcattaattgcctgggttactattaaaaaagccagcccgaaggctggccgataacagaagaacagagcaaaccgggtacgatatcctgccccggtttcgctacgcagtgggtgaagcttagtggctgcgcatgccagcggcggtcatcatcattctgaacagcgtggccaccacaccgagtgccagcacacttgccccatagataaccaccagccacagcacgcgtttccaccacggcgaccgggtttcattctgacgttctttgctgctgacctgggtctgcatatcaatggtatccttcgtctgctttgatttttccgcggaacacgtaatagctccagaaggtgtagcccaggatcatcgggataatcagcaggctgcccaccagcataaatgcctgactctgtggtggagaagccgcatcccagatcgaaaccgagggcggaataatattcggccagatactgattcccaggcctgagaagcccaggaaaatcagcgccagcgtcagcaggaaaggcgaatagtgcgcctcacgcttgatggcgcttctcagtccccaggcacacagcagcaccagaacgggcaccggcaggaaccagaacagattcggcatgctgaaccagcggtgcgcaatgttatggtgggtaaagggtgtccagatgctgatcacgccaataatgaccagcagtgccacgagcagcggcgttgccagtgcggacattttacggtgcagctcatgctcggttttcatgataagccaggtacagcccagtaatgcataggccaccaccagtccgacgccgcagaacagcgggaacggggccagccagtccatcgtggaacctgcaaagctacggccggataccggaataccgtccagcatggcacctaccgcaacgccctggctaaaggtcgccagcagcgaaccggcgataaacgacttgtcccaaaatgcccggtgatgctcgacggccttaaaacggaactcaaaggccacgccgcgaaaaatcaacccaatcagcatggcggtgagcgggatagaaagcgcatccgcaataaccgcgtaggccagggggaacgcgccaaacaggcccgcaccacccagcaccagccaggtttcgttaccatcccagactggcgcaaccgtattcaccatcatgtcgcgctcgcctgcatccttattgaaaggaaacagcaggccaatgcccaggtcgaaaccgtccatcacgatatacatcaggacagcaaaaacgataatcgcgaaccagataacagagtaatcaaccatctcaacgctcctcattctggtgagtggcagcagagagcggacgtgatggcgttttgatctggccggggccacccgtttcaacgatatcgccttcgcccgtcaccggaccctgcttaatcaaccgcatcatatagtgataacccacaccgaagacggaggagtaaaccaggataaaggcgagcaggctgatactcatgtgcatttcgccatgcggcgataccgcatcgatagtgcgctgtacgccataaacgacccacggctgacggccaatttctgtggtaaaccaaccggctaagatggcaatcaggcccgatggccccatcagtaaggcaaaccacaggaacggacgcgactcatacaggcgtcctttaaagcgtaaccacaagctgaccacgcccagcgtaatcatcaacaggcccagcgccaccatcacgcggaatgaccagaagatgatggttgagtttggacgatcttctttcgggaaggattttagcgccggtacctgcttatccagactgtgcgtcagaataaggctgccaagataaggaatctccagcgcatacttagtgcgttcttcttccatatccggcacaccaaacagaatgagtggcgtcgcttcacccggcgggttttcccagtggccttcgatagccgcaatttttgccggctggtgttccagggtattcagcccgtgcgcatccccaatcatggcctgaaccggtgccacaatcagggccatccacagcgccattgagaacatcttacgaatggcgggattgtcattgcctttaagtaaatgccaggctgcagaagcgcccacaaagaaggcactggccagaaaggccgccacggacatatgtaacaggcgataagggaatgacgggttaaagacaattttaaaccagtcttccggcacgacaacgccgttctgaatcaggtagccctgcggcgtttgcatccagctattggaggacagaatccagaacgtggaaattaacgtgccgagcgccaccatgcaggtcgcaaagtagtgcaggccgggaccgacgcggttccagccgaataacatcacacccagaaaaccggcttccaggaagaacgccgttaacacttcgtaggtcagcaacgggccggtaatactgcccgcaaactgagaaaaaccactccagttggtgccaaactgatacgccatgaccagcccggaaaccacgcccataccgaagttcaccgcaaagattttcgaccaaaaatgatagagatcgcgataggtttgattatgcgtttttagccacattccctccagcacagccagaaaactggccaggccgatcgtgatggcgggaaagataatatggaaggaaacagtaaatgcgaactgaatcctggcgagatgaaaggcatctaatccaaacattgcttacctctttgccacatagaacaccatatagttacttataattaacaacttatgtacaaagaacgtcattccgttgcacagaaaaattccatggcgaatgtaaaacgcttcgcccgggtaaaacagagacaatcagatatgtaaaaactataacagtattttttgatttagatcatttttttgttgaaagatcttttatttgaaaaacaacaataaaaagttaattacagcgcagcaatgtgacatttttgttattaaattagaggctaaaaaactacattcccgccaggctgcactgggtaaaaaaaacctcgcaactcgctgtttttctctgttattcagcctttcccggctggcttaaatccgttaaaaatctacatcccacaataaaattacgtgtttttttatattgttagcaggatagtgatcttatcttctctctctgacggtttttgcccgttcgggacatatttaaccaagaataaataagcgtttactcgtgccattcagcacaggaaagtttgctatttatgttaaaatttaacgcagtatgtaaataaagaactatctgctaaaacccaaagtcattatttcttcccgatagctcgctgaaataaccgcattagtaaaaacgatgttaaaaaatgccagcgaacaacctcccctgtggcgctggccggttgttcatgccggtcagttgcagtgcagcctttactctgcgtaatcggctatggccaggctggcgcgtcacctgacaggcaaacgcgccccgttcagggtgacaatttattccccggtggcgtctttttcacgatgagacagaatacgatcaacattctcttctaaccagtcggccaggccgaccacctgctcccccacttccaggcccaatggcgtgaggcgatactccacatgcggaggcaccacatcataggcaatacgctgcacaaaaccgtcttcttccatgtagcgcaggctctgtgccagcatgcgttcactcacgccgcccaccgtccgccgtaattcgctaaaccgtagcgttttatctttcagcgccagcaggattaacacgctccagcggctggtaatgcgctttaacaggtcacgtgacggacagttaacgtgcaacagctcaccgcgtttaaatctttcactaatcttttcagacatttagctatatcgctccacgctaacaattctgtaagtacttactaaaagttagtttatcgcttaggctgtttttcaccaaccgctatgttaaaggagttacccaatgatcgctgttactggtgcgactggccagctgggccgtttagtcatagaagcattacgcaaaaaaattgctgcagaccacattgttgccaccgtgcgctcgcccgctaaagccggtgaccttgccgcattgggcgttgtagtgcgtgaagcggattacaacaaacctgagaccttagcggccgcctttaaaggggtagataaagtactgctgatttcgggaagtgaagtgggccaacgtgaagctcagcaccgcgccgtgatagacgcagccaaagccgcaggcgtgaaatttattgcctataccagcctgctgcatactgatacttctccgctctcacttggcattgagcatcgcgcgaccgaagccatgctggcagcctctggtgtgccttacgccctgctgcgcaacggctggtacaccgaaaactatgccgccagcatcgcgccagccctggcacatcatgtgttccttggtgctgcgggcgaaggacgaatctcttctgctgcgcgccaggattatgctgaggcagcggccgaagtgatggttcgtgacgatcaggctggaaaagtgtacgagctggcaggcgatgacagttacaccctggctgaatttgccgctgaaattgcggcacaaagcggagaaaaagtcgattacgtgaacctgccgcaggcggagtttgccgcagcgctgaaagccgcaggtttaccggcaccgctggcggacttactggcggactccgacgtcggtgttgctcagggcgggctgttcgatgattcgcgcacactgagccagcttattggtcgccccaccaccgcttatcaggacgtgattcgcgcgacgctggcaaaaggctaaggtcgacccgctaacctccgctttactcgctaacgacgccgtcgtctaccggagcaggataaccgatagacgacggcgatcttgtcttgattgcgcctgatgcctccatccttatcgcctcttgcccgcgaggcgtacaccatgattcggtacacgccgaagcaagacattttgccgtgcgtaaactgcctgcatgtttactcatggagatccaaaatgattgctgttctttttgaagcagaggcactgcccgcagcgcaacaacgctaccttgcgctggcggctgagttgacacccgcgctggccgaaataccggggtttatcaggatcgaacgatttcagagcctgagcgcgcccggcaaggttttatcgttatcgtggtgggaggatgagagtgcagtaagaaactggcgggaaaacacgcggcatcagtcggcacaggcagaaggtaaaaaacgcatttttgcccattaccagatacgcgttgtccagctcattcgggactattcagggccagaggggcgcgatcatgtttgatattcacgtcgtgttcagtaatacaccgggggcgctttcatcatttggcaccctgctcggccagcatggcattgggctggaaggcggtggcgtttttacaacgtcgcacgagagccacgcgcattttcttgttgaagaggggcccaaagcatatcagttattgtctgacgccggtttcgatgtcagagagctcaaaaaaccgttgattaggaagttagcgcaggaacagccgggagaactgggtgaaattgcgcgggtcattgcggaaaatggcattactatactggttcaatacagcgatcacagtaaccgactgatcctgatcaccgatgatgatgagcgggctggtgacgtcacccgaaaatggacattagcgacagcatgaaactgatcccttcccggcatcaacaagatcatccgccttcactggagaccagcatgtctgcggtcgccaccgcgatggcggatgcatccagaatgcatattctctgtgcactaatggatggccgggcatggacagccactgagctaagcgtggttgccgacatcgccccgtccaccaccagcggtcatttgcataagttgcttgataccggcctgatcgtctgtgtggtgcagggcaggcatcgctactacagcctggccgatcgcgaggttgccgggctactggaaaacctgatgggcgtttcggttaagcccggtaacgccgttaaaaccacgacgccaaaccgggtgaggcgagcccgcacctgctacgaccatctggccggtgagattgcggtcgaaatctatgattttctgcaatcggcaggctggataacatcagacggcacagccttaacgccgtgcggcacggcgaactttgacaaggcgggcatcgtgcttgcccctcgttcccgacgaaaagcatgctgtccctgcctggactggagtgaaagacgctttcatgccgggggcgaagtgggtgccgctttgttacgctttctgctgcaaaagcactggctgatgcaggcgccgggataccgggagcttgttgtaacggacagcggcaaagcggcactgcagcgtctgttcagtatcagcccgatctgaccgccgccctgtattgcccgtttgttcagcacaggttacaggcttagcgctcaggttcagcatcccgccgcatcagcaaggtatcgtgaaaaacgccgttgacataaagcgcagcaacatccgtcgcgtaggtctgaaaccccgccgagcggtacagcctggcagccgcgatattggtggcgctcacggcgagtttcaggctgcggcattcacgggcttccgctatcgcagccgtgagcagcgccttcgccagtccgctgccccgccattcaggacgcacatacattccccagagcgtggcgatgtgccgctgtttcacgcctggattaaagcgcacgccgacgatgccacctgtctggccctggtcatcgatgcccgccagcatacggttttcacgtagcattgccgcaaaaaaagcgtccggctgctgacgctcgcgatcgtaatccgcgccaaaggcgtcgggatgacgcctgagtgcctccagtctgatagcacggaatgccgacacatcctgctcagcgagaggttgtaagatgtaaggtttcaccacggaattgtccttagcggggttgttcgcaccattttgctttatcctgacacttctgtgcattttgacggctacgcaggtcaaaaacatgcccgctggcgatgatcaaaatttatttagttatatcctaagagattcatctgaaatgcatttaatgcaaaactggtcatatttggttgaattgactgtgttttattcaatgcatacgattaatcgacaatttttattacgttcatagacaatctgcattgttgttcctgcctgcgagaggtctataatttctcttttgtgcaaccccgttcgctcaggaggccgttattaatacttatcgccagcaactcaatgcattcgaagagaatcgtgccggggcggaagttgagtatcaatacgatccccatgaactgaagctggaccgcatgcaggattctgaacctgagccagagctgatcgaaggcttaccggctccggatgcgctgacgcctgccgatcgctatcttgagctgtttgaagccgtccagatgtcgggcattttcgaggacagcaaaacctttcccgattgttcgcccaagtatgatccactggatgttctgatgcgctatcgccgtcaaaagcgcagcaaggacttcgatctgtcgcgtttcgttactgagcatttttatatgccaggcattaacgaaagcttttacgtctcaaatcccgataaaacgctcaacgagcatatcgacgatctgtggccggttctgaccaaaatgccgcagcagcatatgccgcactcctcgttgctgccgctgcctaagccctacgtggtgcccggcggacgcttctgtgaaacctactattgggattcctacttcaccatgctcggcctggctgaatcgggccgtgacgatttgttgcgccatatggcagacaacttcgcctggctgatcgataactacggtcatgtgccaaacggtaaccgtacctattatctcagccgttcacagccaccggtgtttgccttgatggtggagctgtttgaagaggacggcgtgcagggttcacagcgctatctggatcaactgatgaaagagtatcagttctggatggacggtgcgggctcgctgatgccaaaccaggcttaccgccatgtggttcgtatgcctgacggctcgttgctgaaccgctactgggatgaccgggataccccgcgcgatgagtcctggatcgaagatgtggaaacggctcgtctttcaaagcgcccggcaagcgaggtttatcgggatctgcgcgcaggtgccgcgtccggatgggattattcgtcgcgctggctacgcaatcccaaacgcctggcgagcattcgtaccacgcagtttatccccatcgacctcaatgcgttgttatacaagcttgagttgatgatagccacgctgtctcatgccaaaggcgaagagcttaccgccctggcctggcagaaaaaggccgaggcgcgcaagcgggcaattacccgctatttatgggacagcacggctggtgtgttccgcgattacgactggcgtcgtgcacgcttcggggcctttaccgccgccgccgtggtgccgttgtttgtcggtctggctacgccttaccaggcacacctgcaggctatcgccctgcgtcacctgctgctcagtaacggcggcctgctcacctcaatggtggaaagcggtgaacagtgggacaaaccgaacggctgggcccctatgcagtggatggccgtcgtcggcctgaataactacggggaagagacgctggcgaatgaaattgccgttaactggctgaacacggtgaataacttctatcagttgcaccataaactggtagaaaagtacgatatcagcggcgatcgtgcccgtccgggcggcggaggtgaatatccgttacaggacgggtttggctggacaaacggggtaacgcgtcgtctgatggcgatgtatggtcacctgatggctgattaaccgccagccgtaccgaacagacgcaaaaaagccgggaatctgtcccggctttttttatacccgtcagcgcgtagtcacgttatttcttcgcttctacacctggctgggctgagcgctgcaggaactgttgagtcacctccggcaaatgctggaacagccattcagccatcgcaatttcctggtcgcgaatctctgtcagcactctgacaccttcgctgtcgcctacctgttccgctgccgcgatgagactggtgtaactggcaatctctgcgttttcgaacacatagccgctcattgcgcctttcacgacttcgtcaggggtaaacataccgccaatcgcctgccccatggccgccatttttcccatcacgtctttcataatggaatggtcaatatcgtggcgttccagcagttgctccagcagcctgagctgatgtttggtttcatccagatgctgcgccagccgctgctccaacgccggataatgctccagacggcccgccattttactcagcatgctctcagcctgcttttccatggcgtgagcatcacgaagccagtcatgataattttcaatcgccgtcgtcattttgatgctcctttaaccgtgctgatggcctgtgcaacgccggtcagtttttcatcggtctgtttttcttcctcaagcgtttgagccagcagctttgccgctttggtgtagcccagcttcagtgccagcgcatgcagggtgccgtaggtagcaatctcataatgctcaactttctgcgccgccccgatcaatccctgatcgcgtacttcacccttttcaacagactcaataatctcctgcgcttcttccaccaacccttcaagcgcatgacacttcatacgtttaattttaacctcgggcgtgatgtcgactaattcatcaagacgctcaatttgcccgcgtgtctcttcaagatgttgattgaacgcagcgataagattttcatcactggctgcgcgggccatttttggcagcgcccgggctatctgtttttcagcactgtaaacatctgacaggtcatggatgaaaagatcatttaacgttttaacagtcataaaaagcgcctcattatttaaacagccacgccgtaatttcagcgcagcaaccgtaaatctcactctcatataaccttagtgtaattagcggaaattgcgtttaactttgcacaaacccacagcaaaagtagcattaccgatgcaatttttcttttactaccagtcatttacttcttttaatttatcttcggtcaaagaatgatttctcaccaataacgacaaacctgtacaaaaaatcaataatccgtacaacttaatccacgctttaaataaaaacgttccgcccgttggactcaggttccatttttttaaatttgtgatttttttgatatcggacgacaagataaaaaaataccggaaaggaatttcctttccggcaagattaacgcaatctcacaccagagatgattgacacaacgaattacactggaaggtttatctgtttcgaagaaacgttaagcttttcagtgcacaaagataatgattaactcattgttaattaagcattaactccggcgactgactttaccacctttacgacctgcttcaatagcgcgttgcggatcgttcttaaagtttccaccgctgttttgaccacctttacgtcccgcttctgctgcacgttctttgtctgcagcaaaattacccgccccaccacgatattgcgtcattctgtgttctcctcaaatttcattattcaaacagcacagttgaagttacatcagctaaagggtgccagaaataaatgtagtcataaaacttaccttatcaagcatgatgtttgagaaaaggcatcacatttctggtcatggtttgtgaagaactttcctctcattctttagtgatgaaactatttaaagcagaaactcaactaaaccgcatcaggtgcccactgtgtgacagcggcacctttcagcctgtattaatcgatcgattcattaaaaagtccactctgtttttcttttaaagcgaagcgtaacaacgtgatgattgcgcctgacatcgtcaatctgatcaataaatgatctatttaaccaggcgtgataacgcaaattcctttatcaaaatatttcatcggatgaaaataagcgaagcggtaaattcgtttattattaagatactgataaaaagcagatcatttaataatcaaccagacatcaattagcaaaacgaccgggtcagaaaagagagaaaaagataaagagggcgttttaaataagcgaagcgtaggaaaataaaaaaacgccctgacgggcgttcttttcggactattctgccctgctacttttgcaggaacgtcagtaaatcttgattaagctgatcctgatgcgtcactgcaaacccatgcggaccctggtcatagatcttaagttccgagccggttatcagcgcatgggccagtttaccggttgcttcaaaaggcacgatttggtcgtggctgccgtggatgattaacgttggcacatcgactttcgcaaggtccgaccggaaatccgtttcagcaaaagcggtcacgcagtccagcgtccctttcagggaggccattaacgcaatcgttaaggtctgagttaatacaccgtcagaaacctgttgaccggcgttcgtgccataaaacggcgcagcaaactcgttaataaactgcgcgcgatccttgagtagcccctgtttaatgccgtcgaaaacggctttttccaccccttctgggtgatcgtctgttttgccgaaaatcggcgtaaccgcacccagcagcaccaggcttttgactttagcggtaccgtacttaccgatatagcgcgacacatcaccgccgcccatcgagaaaccgaccagcgttacgtcgctgagttgcaggtgctcaatcagactatgaatatcttcagcaaaagtgtcgtagtcatagccttcccagggttgatcggaacgcccgaagccgcgacggtcaaaggcgatggcgcgatagccccgttcagccagaaagttaagctggctatcccacatatctgcatccagcggccagccgtggctaaagagaaccggctgaccttttccccagtccttgtaataaagattaaagccatctttgcttttaaacagactcataagtgcctcgctatgggtgaaagtcatgactcttcaggccagcgcgaataacgttaccgcgacagccgtggcagagggcgatacctgacaagtttggcagagggggaaaaatgttccaatgcggaacagaggacgctacagataaccctcgtgtgacagcgctacgccgcatttgccatttttcttgatgctgtacatagccgcatccgcgcgtgccagtgcgctgtcaaagttctccgggtattcaacctgaaccacgccgatggatgcgccaattgaggcgctgccgttggccacttcaaaaggctgtaaggctgcctccaggcaagcgtcggtgagcttctttgtgagcggatgagacaacgcaaaaggaatcagtaaaacaaattcgtcgccccccagacggccaatgatgacattcgccggacaggccgcgataaaacgctggctgagttgaatcaggacatcgtcaccactgcgatgacctaaggtgtcgttaacatgtttgaagttatctaaatcaataaaggcaatacaaaaggctacgtccgttttcatctcgcggaaatggttgattaacgcatggcgattggttaactgcgtaagtggatcgtgcatagccagcgtggccagttgttcttcgtactgtttctctttggtcatatcaatgtgggtgcccgtcactttagtgggccttccctgcgcatcccattcgctgacacgaccgcgatccagtacccaggtaattttgcccgttttgccaatcatgcgatgcaacgcctcatagaaaggcgctttcccatcgatgtgatcgtagaaagcctttaacacatcgctggcgtcgtccggatgcaggtaggatttccatacatcgaaatgcgcaccgacctctttaggctgaaagcccagcatcgatccccagcgtcggttaaagataaccagcttgccgctgggaatatccaactgccacagacacaaccccgtgccgtccagtgcggcgcttaatttattacgggcatcgtgcgcaatacgctttaaccgtgcgttatgtttttttaaattcgcgatttgctgccgcagggcttcttcagacatagggataactggaaagggaaatgtctattttgccagtgctatacattgtgtaaagcagcatgttgaaaagacgatgagacgcggacaaaaccggcctcgacaggatttctcacccttaacggcgtcagaaacagcacacgacaaaatcttaagggataacgtcagggcgtttacattgtcccggcgagcctcaggtcgataacagaggtatcgcgtgaagtgttggtcagatgtcagcctgtacgttttcatctatagaaagctttgcttttttaaagaacaggcggcctgtaacaacagcattctgataaccacctgatatgtaatcataaataaaatcatcaaatgtaacgctgacatgtttatgcaaactcataatcacacttaaatatcttccgggtgttaagtaaagacgtcagcacgacatcaaggagataaatgatgaacccgttaatcacgctttcttttcacggtactcagtgtaaaaatcagtcacaacaagattcccatctcaccgacgcgctttttttaggcgatatgtttttcgctcataataatgacaacgaacatcatgtaaaaaattatggattacatggcgctgcgcccggccatttctgtgtaagaaatgctgtgctggataatcatttccacactagccaaaaaggggcagcgatatatatctgaccaccaccgcgcattatttttgccaatcagtaataacccgtaagaaggcaatatcgatgtaatcaatgacgttagcacctttcggatgcataaatgcagaggataactatcatgaaaaagatgattattagctcaatgattgtagccgtactcgtttttaccggcggtgccgcagccgcagaatcattcaaagacagccatacgttaaataacgaagtcgtgtctgcgcaggccgcacaggcgatgaatgacattcagctttctcgcaatgcgttatttaatggccagacgcagcaggctaaaacgctggcgacccaggctgaaacgtatcttaaagataatagtgtggactggaccaggtatattcgctacgacaaaaaggccccaataacaggtgataactatattcgtataggctcggacgtctcggtttctgaagattatcaactttccaaacagaaaaatgacgcgatcgatcaagccaaccagcatattaaagcgggagataaacaaggcgcgctcgatgcattgaaactggcaggggttgccgttaccgaaacgcaggaactcatgccgttgcagcaaaccgaaaatgacgtttccaacgcgcttgccatgatgaaacaggataagtactaccaggcaggcatgttgctgaaatcagcagaagaaggggtcatttacgacacccaaacctattcagaaagccctgttaatccaaccatgcatcacacccaaacgggtacccatgctcagccaggtaataaaggataaccatcctttttaataaagttacgttattaaataacgctgccgctttcattattcaggatgaaagcggcaacgtacatctataaatacactataagataatctgcttatctcttgttgcgcataagtattacgaatacatcccacttcataaaaaaagaaatgactttttcactgaacaaaccatctcttctggttattcgaatttatttaaacgaacgctgccgcgcgatacactttttcaaacaacgctccagcaccctgtcctttctattgataaccaatgaaattactttttaactaaactaaaggatagttttctaaaaaaaagacttcaggttataaactgcaattcatctttgccgataaacgaaatgtaatggctttaatcacaaaaataataagatcacttatcggggaaaaacatgaaaatcacaactggccgtaaaatcgctttagcgttcggcatcatcgtcatcgtctcgctgattggcagcagtttgtcgatcactaactttcttaaactgcgccaggccaacacctggaacgtccacagttaccaggtcatgagcgtcagcgacagcatgctgaccgatatggttaatatggaaaccggcgtgcgtgggtttgttgtctctggcaatgacaactttctggcaccgtttaacagcggtaaaaccgctttcgatcagaagtacagccagctacgctcgatgactgcggataacgccgagcagcagcaaaggctggcatcactgcttgaattgcataaaagcgttcagggcgtagatgagcaactgatcgccttacgccgcgaggtgaacagcggcaagcaaccgttggagaccctgacgcatttctttcaggaaggccgcgataaagcgtttatggatcgctatcgcgccatcgctgctgaattcaacggtgcggaagccacactgttagccaaacgttctgcagaggtaaacagtctggcctttgccaccaaaatgacgctgagtctggcaggtatcaccaccattctgctttccatcattctgggcaccattattacgcgcagtattatccgcgcactgggcggcgagccaaaagcggctgccgatattgccggaatgattgcgcagggtaacctgaccgtggagatcgccgttccggtcaaaggacagagtagcctgatgggctctcttgaagccatgcgcatgcagttagtcaccatcgtcagcggtatccagtcctctgctgagctgatcaacaattctgcgagcgaaatcgcgcagggcaatgtcgatctggcccaacgtactgaagagcaggccgcggcgcttgaacaaacggctgccagcatggaacaacttaccgctaccgtgcgtcagaataccgataatgcgcgtcatgcgaatacacaggccgacacaacgtcacatgtggcgacgcagggcggtgatgtggtgaaacaggttgttgagaccatgcgctccatttcagaaagctcaggcaaagtggcagaaatcatttcggtcatcgaaggcattgctttccagaccaatatcctggcgctgaacgccgcggttgaagccgcaagagcgggtgaaggtggacgcggatttgccgttgtcgccggtgaggtgcgttcgctggccttacgcagttccactgccgccaaagagatcaaagatttgatcactcagtcggttgaacatgtggcaaaaggctcaggactggcccgccaggccggtaatacgatggaagagatcgtgaaatcggtgcagggcgtgacgacgattatgggcgaaatcaccatcgcttccgatgagcagagcaatggtatcggtcaggtcagcattgccgtcagccagatggaccaggtgacccagcagaacgccgctctcgttcagcaggtttcttctgccgcacaaggtatgctggagcaaacggtgatgttacgcgacgcggtttccatcttccgcatcgaaaaaagcgctaacctcgctaccccggctttccgctaaccggcacgcttttattctgagtgcctgagtcatcacagagcccggacccgctaaccgctggcccgggcctgtcttaacgattgcgccgatcatgcctgttgcccccacgcttttcccgcgtatcccttgccaaaaaaagcgttttaaaaaacaccgatgaccactaaagtgagcataaccttactcacaacgggcgcaactatgtttacgaaaacctatcaggttgacgaaaagcacattgattttcagggcgtggtggatggactttactatccgttttatatggaatggacacgtcacgcatttatgaaagagcaccttggcgtcgatcttgaagaagagtttgccgcaggccgaattcatatgctacttgagtactcgctgcgctttaaaaagagcctgaaaaaaggcgatgaaatgcaggtcacctgcgcgctggccgccaatgaaaaacgcaaccgcgttaacttcatccaacaaattctggtaaacaatgtggtgtacgccgaggcggtttttaccggcacctgtctggaaaatggtcgcccgtccatcccggaatttttgcgcagtgcgattccggataatccgtcgtaacgcggcctcactctgccgcattgcaacgacgtccgccgcacgcggatgctgttaaggccgtcacctcatcggtgaggcgcatgccctctgttgtctccactgcatgtccttgatgaatagcgtgacgcgcctcactgctctgtttcgatatgaccgaaatgtgacctaaatatgacacacgcgatgccgataaccttagtggacccgagtcgatcggcctccctttaaacgggtcgttgtctctccactacgtggtcaaaatcttttgaccttttaacggctataaatggagagatctatgttttccctcacgcgtttactaccaggcaaaatttcgctggccgtgtcagatgatcaaaataacattcaggcgataaaggcctgtagcggttggatcgaatttaccccagaggggatcattctctcggccaacccggcctttctggccgtgaccggctatcagcttaacgaaatcaccggacagcaccatcgcatgttctgtaagccagagttcgtccactcccgtgaatatggccagttctgggaaagactggcatccgggcagtcgttcagcggcatcttcgaacgctacagaaaagacaaaagcctgctctacctgagcgccaattatttccccgtgaaagacaaacacggcaccgttaaaaaaatcatcaaaatcgccaatgacattaccgacaggcatgaagagctgacgcacaaagaagccattattactgcgctgaataatacaatggcgacgattgaatttactccgcatggtgacatcatcaatgcgaacgaaaacttcctcgcgctgatggagtacgatcttgcagaaatcaaaggcaagcatcaccgtatgttctgcttcgatgcgttctataaagaaaacccggatttctggaataaaatccagcatggccggtcctttaccggacgtttcgaaagggtaactgcgtcagggaagcgcgtctggcttgaagccaactacaatccggttaaagatgcctcggggcacgtgtataaagtgattaagctggcttccgatatcaccgaacgcgtggaaacggcgaagcaggttgccgatatcgccatgagcacgtctgaaaaaacctctcatatcaccgttaatgcaaacgatgtactgagccaaacggtgcgtaacgcggaatcaatggcctcgcaggtcaatgcggcaacggcaatcagtgacaaactgaattactcggccaaagacatcaaagagattgtctcgaccattaacaacattgccggacaaactaatattctggcgctgaatgccgcaattgaagccgcacgtgcgggcgaagcgggacgcggttttgccgtcgtggcggaagaagtcagacgtcttgccgcctccacctctcaggcgacgcagaaaatcagcaaggtggttgaagaaaatactaatcttattgatgagatgtaccgacagctcgatgagatcaaccactttctcaccacagaaaacgacaagatcactaatctctcagacaatattcaggaaatttttagcggggtaaaagagttcgtcaccgtgattcacaggctggatgtgtaatcgaaaagcgccagtatcgataatatgctgaccgcttgcgtcagcggcgcgcctggtcaggccatcctgaaaagacgaccatcattccctcagcgcagagcggctcacgcgtcaccccttatcacattgtgatgccgcccgctgccatcgactctctttatcgatgtcggagcaacccgctcaattctgctttcccgcccatcaggtcatcgtatggtcacagacttcgcgtagcctgcttgatcatttgcacatatttttatcgggcaggctgcctgtgcaacgctggtacgccggttaaagggttggtctgcaatgatgcgtagaccagaggcacgcacagttgccgcctcaatcccgttcgcgcacgcatgacacttttgagtgcgtttgccggacgattcgctgatacagggggagcaccatgacaacacggagaacacttttgaaaggaacgctgttgacgctgaccggaatggccacctccatgagccgggctgccgatcatttgccgaacgacacaggcagaaaatttgcggctgacgggcgcgtactgccgtttcggggcaacacgattatttgtcatctgccacagcaagaaaaagattctgacgcgttcgatgcgctgctggatatttaccgcgcattaccggctgaaccctgggcgcgcaacgtcacggcactgccgccatccagttatcatatgacggtcttcggtggcgcaaacgacaaggctcgccgctacccgttatggccagcagggcttccactcgatatgccgatagaggaatgcgatcgtatcctggctgatcggctgcggcaatttcgcctgggtgaggatgcctctccttaccgtatgcgcgttgatccggcagagccgtccgcgaaggaaaagccgctgacgcttcgcctgctgtcagccgatgaggataccgaaacctgcctgcgccgtttgcgcgatcggctatcgcaggtgactggcattcatgagccagaccatgagcgttacggtttccacatcaccctgggttatcagttcgctcccctgaccgacgacgaggacgccgcatggcgacgttcgctggcggcatggaaaacaaccattgcccaacgtgtcccggtgataaccctgggtaatcctgagtattgcctgatgaacgatatgttcgcattcaggcgccagttttatctgacataacggacgcgcgtctgcaacaggcacgccaggcgcggctgaaaatgccgccgcccttccccagccaggcataccggcaaagcacgtttataatgacctggcccgcccgactggcccggctctttacgcccgctcgtatcggctgaatcgttacaacgctaatcctgttaaccgccgtaatcgtcacctttctcatttttatctgtgacccggcgcacagtgctggggcatttgtggattctttttccagcaggtgaggcgaatcacgtttcggttaagtgcaaatcagtaaattcccttaacgactgaaaaaacgattcagcttaaggaaggaaagatgaagactaaaatcgcacttgccgtattcgccgtgatgatatcgggttccgtgtcagcaaaaacctgggtgctgacgagtgctgaacaaggcacagacaaaggaaactggcaaataaccagcagcgagctgaagttgcagggcaaaccgttcagcatcgaacagaaagtcctgcacggcggtaaacaagaaggcagtaaaatccttgagattcgcagtcaggatggcctgaccatcacgctgatccccacccgaggaatgaacctgctgcgagtagaaggttttggcacccggctgggctgggattcccccgtgaaagaggtggtgaacccggcttacatcaatcttgaaagccgaaatggcctgggttggctggaaggtttcaacgaaatgatggtgcgctgcggctatgaatggaccgggcatccggtgaacgacaaagggcgcatttatacgttgcacggtaaagcgggtaatacaccggtatcccagcttgaagtcgaggtagccgatgcggctccgcatgagattcgtattcggggtttgatcaaagagagcacgttcaaaaaagcggatctccagacgcttaccgaactgcgctatgtgcctggcagcaaccagttcagcctgcatgacgtgctgactaaccattcagattacccgcatgattacgagattatttatcacagcaactttagtacgccgattctggaagaaggcgctcgtttcctcgccccgatgtcgagcatcagtccgtttaatgattacgccaaagcggggttgaaaaactggcaaacctatcagggaccgaccaaagactttgatgaaatggtgtttaacatcaagccgctttccgacaaggatcatcacacggtcgctgccgtcgtcaataaagccggaaataaaggcgcctccatccagtttgatacccaacaactgccactgctgaccttgtggaaaaataccgacacgctgaaacaaggttacgtcaccggtattgaacccggcaccaactatgcttatccggtgaccgttgaacgtgaacagaagcgggtgaaacagctggcgccaggagcaagtacggcgtttgatctgacctatacgctattgcacaacagcgagcaggttaatgccgttgaaaaacgcattaaggcgattcagggcgacacgaagattgatgagaatgctacgccaatagcgacagagtaaaacatcctgcctctctgcggggaagtttgtcgtctctcagaacggacagatgatgaatcacactgacgggcatgattgcccgtcagtgcatcaacgaagcctgggcgcgtttacttcgacgccctgttggctgttcctcataatgctgtttctgcgaaccgaagatgcatgagatatcatcgataaatcagcaggttaaacctcacgggcgaggcactttacttcagggaatgttgaatcagttggatgctgtttttaatttcatgctgaatcttgttctcatcccagtccgccagttctggcgcaaaaggttcaaaggcataaatgcctttatagcctcgttcttcaagctgtttaacctggcgacaggtgaacagacgatcttccggcgttaacattatgcgctcggcatcggtcaggctttcacgcggacgtttgtcctccacgcccgacaggtgaaccagaccgatttgggcgatatccacctgactgaattcggcgtcagcatcgggatagagatgatgatggaaggtatcgattaataatttaaagggaacatgggcatcgcgaataagattctgcgcctgcgctgccgaacgcagcgagctttgtgggaagcccagcggctcaaccagtccggttattccataggtcgcgaacagcggtgccacatcgcgcagcgcgtttactgttacctctggcgtaaccgacgagccgtcgttcaggggacaaagcaccagcgaacgcgcccccaccgctttggcatcagccagtaaggactcggtcagttggcgaacctgttccgtacgctgattgaagggataaacggcgtttatggtaataatgtcaatgctatagcgttcagccagtgcgcaaacctgggcagcactcaggttgtccatcactttaccgctgggcaagtcgttacgaagttcaaccttattcaaccccaaaccgttcaccagcctgaagaaggcttcaatgctcagcgagggggcgatctttctgttgatacaaaaacgttctgcggcgatggtcatgcgactctcctgaacccggtaacatcaagcgaacccaacgggataatgaaaatatttgtttcattttagattaaaaggaaaataaatttctttgatgactctcgcaaaatacgttaacgcttggttagaaaccttagaaaaaaaagaacaaaacccgccatttcccttaattaacaacagaatattcaccattcttcgcctgacaaaaaaccggcaggttcacgtggaaaaatgcatccctgatgaaatggaaatttcatttaaatgccctttaagcaccctgcgaggacagcgacagtcaggtgtgaatcttttaccgatgtcaggccagtacctgattatcgtgggttaggttagtagtggagagcagccatccagccattacagtgtggtcatcggggcgatagcctgcgcgccgttgccggttgggcgaccagaatagttgaagcaacgggcgacatcttccggcctcgccgcgctttgccgggcaacggaagcgacgggcagccgctccataacaatgacgtcaaaccgcattgaggcggcatttgtgagcatgtcgttttgcgcgccttgccgggccgggtcatcgatctgagcgcgttccgcatgggggcagtgatcgcccttgcatggactttacattccagaattaatttaaatgaaatataaatttaaacagtgcgaatgcgctgtcactttttcctctgcgcctggcgcgcgcggccattatgacgtgccaatgcatcccaataggcagcctgtctgaagtggtatttttattttagaattcaaaataatgccgcattcctcgatctttcatgcgtatgctttgctcacccggcaggcactgccctcccgcatcccaatcggaatagcagtagagtttgatcgccctcgcaaaatgaaatctttcttctgtattatggtttaatgaaaaatatgtttgcctataatcgggcattatccagatttaaggtacaacctcttaactgcgtcaaggcaaacaccgcctgacagagcaaggggccgggcgacaggctactaccgatcaaaacaggaatgagcaaaatgggcaaagtgagactgacaatggcgcaggcgctggttacgttccttgataatcagtatctgaaagtggatggtgaagagctcaaatttgttaaaggcattttcgctatattcgggcacggtaacgtgctgggactgggtcaggcgctggagcagaactgcggcgatctgcgggtgttccaggggcgtaacgaacaagggatggcacatgcggcaaccgggtttgcgaagcaatctctgcgtcgtcaaatcattgcctgcacctcttctatcggccctggtgcggccaatatgattaccgccgcagccacggccacagcaaaccgcattcctttattgctcctgcccggtgacacttttgcaacacggcagcccgatcccgtgctgcagcaaatcgagcagagccacgatctcagtatcagcactaacgacgcgtttcgcccggtaagcaaatactgggatcgcattactcgcccggaacaactgatgagcgcctgccttaatgcgatgcgcgttctgaccgatcccgctgaaaccggcgcggtcacactctgtttgcctcaggatgtgcagggcgaagcctgggactatccagagtccttttttgcccgacgggtgcacgtgttagatcgtcgtccggccagtcaggcgcaactggatgacgctattgctgctattaaagcaagccaaaagccgctgatcgtctgcggcggtggggtgaagtacgcgggcgcaggccaggcattgatgcattttgccagccgttacggtatcccgtttgtcgaaacccaggctggcaaaggcaccgttgtctcatcacacccttttaacgcgggcggtgtcggagaaaccggctgtctggccgccaaccaactggcgaaagaggccgatctggttatcggcatcggtacgcgcttcagcgactttaccacctcatcgaaatggattttccaacatccgtccgtccgcttcctgaatatcaacgtcagtaattttgatgcctggaaactggatggtatgccgcttctggccgatgcgctcacggcgctcaacacgctggatgcggtgctggaaaaagaaacctggcgcgccagttggggcgaccgtattgccgagctgctcactcaacagtacaaagaaactcagcgtgtctatcaggcagtatggaaggaaacgtctttcgtgcctgaaatcgacgaccatctggatcgcgagtcagtctaccgtgaatttcgtcaaataaccgactcaaccctgacacaaagcagcgtactgggcgtcctcaacgaggtgcttcccgaagaatcggtgattgtggccgcagcgggaagtctgccgggcgatttgcaacgtgtctggcgcacccgggccgaaaatacctatcacgtcgagtacggttactcatgtatgggttatgaagtcagcgccgcgctgggcgtaaaactggcacagccgcaaagcgaggtctatgccctggtgggcgacggctcttttatgatgctgcactccgagctcgtcacatcgctgcaggaaggcgcgaagattaatatcgtgctgctcgataacatgactaacggatgtattaacaacctgcaaatggaacacggcatgaacagtttctgcaccgagttccgctaccgctcgccggaaaatggccgactgaccggtggcctcgttcccgtcgattttgccgcaattgcagcgggctatggctgcaagacctggcgagtcaccagccttgatgaactgcgtcaggcgctcgatgcctcgcgccacgaagcgggcagcacactgattgatattaaagtgttgccgaaaacgatggtgcacaaatatggcagttggtggaacgttggcgtcgcgcaaacggcgctttcggaacggattcgcaaggttgccaaacagatcaatgaaaaacgcgcgcaggcgcgcgattactgagtgccgtcctgatcctgaagcctgtgaacatgtgggcgtaagatcatgacgttacgcctcggtgtcacaggtgctggcctcatcggtaaagaacgtattcgccgtccctcagcctgggatggctatgctgcatctgttgcggccgatgccagcctgaaaacagcggaaactggcgaaacggtaagcgttacgctgcctgaacgccactctttttatcagcgttaagcgctggcctaccatccatttttactgacaggtaacaatgatgaaaattgcatttgacgtagacgtgataaaagatctgggcgtgacccggatggtgcaccaggtcgcggattggggttataagtacatcgagcagtcgccgcatccccagatcaatcctttctataaacatccgcgcgccagccgtgaaatcattacggaatataagcgggcgctgaatgaaaccggtttagagatatcttcatttatttgtgtttatcgctggtcggggcctgatgaactgcgtcgtcaggccgccgtgaaaaactggaagcgcctggttgaaatcgccgtcgagatgggcgtgcaggtcattaataccgaattctccggcgatccaaatcaaccagaaatctgcgacgaaatgttctatcgttcgatggaagaactgttgcctgtttttgaacgcgagggcattcgtgttgagattcaggctcatccgtgggatttttgcgaagagaacgacgggacggtcgacgtagtgaaatcgtttcgcagcgataacgtcaaatatatctacagcgtaccgcacaccttcttttacgacaaaggaatcggtgacgtcgcaagaatgttgcgctatgccggtgacgatctgtcccacgtgctcatcgctgacaccatgaaccacaccaggcactgtcgttatatcgttaatcctccgggtgttgatgccaccatccaccagcatgttgccgtaggtgaaggtgaggtggatttcgacgcgctgttccgtaccctgcgcgaaatgaaattcgccgagaagaccttcaaagtcggcggtgaatctatcgtggccgcgtccctttttggttatccggaaaagatgaagtaccaggctgtggaaacgcgtgaattgattgaacgcgaattgctcggtcaccaggatacctcagcagtataacggtaagacgttcggtaaagagcaagcgggctcatgacaaggatgtcattgattttcccatgtattccgctgacaaaaagcgtctggcaaaaaggcatcaagcgctggagaggcaagagcacagttacgctcgctcagccggcaggcaacgcacgcattctctggatgaaaagtgggcacagcatcgttgataacaaccgtcgtgcgtaagcgcctcttaccacctgacattgattttctacccgctactttgtgaaagaaaaattccaaatactccacttaattccagtctcgttcaggccggtttaatgccgacagcgcggtaaattttcacgcgtttgaatcgaataatatcaatatcctggcatcacgctggtccagcatgctgcgttcacattttgttcagcacctctcctcttcctgtcgtttcataaaaaataattaacaaaacatgatccataactcaaacataaagtttcatagttaacattgatgaaatttttgatctaaattaatgctgtaaatttaggtgtactgaggtgaatgctttgcgcctggacaaattttagatttatttcttttacatcaggtgactggagtcttgtatgacgaaagaacaatttctcacactgaacaacgcatcgggcccaaacagtaacgcacctacttcgccttttgtgaaggtcgttgcgctcatcgcaacgctaggtggtttactttttgggtacgataccggcgtgatttctggcgcgttgctttttatgggcgatgagctgcatctcactcccttcacaaccgggctgatcaccagttctttgctgtttggtgccgcctttggcgcgttgttatcgggccatctggcggcaccagcgggcagaaggaaaataatcctctacctggccgttatttttgcgattggcgcggcaggcacgtcactggcaccagacgtaaactggatggttttttttcgtcttatcctgggcgtggcggtcggcggcgcggcggcgaccgtgccggtttatatcgcagagatggcccccgccaataaacgtgggcagctggtcacgcttcaggacctgatgattgtctcgggtcagctcctggcttatatctcgaatgcgaccttccacgaaatatggggaggtgaaagcacctggcgttggatgctggtggtagcaacgcttcctgccgtattgctgtgggtcgggatgatgtttatgcccgatactccacgctggtatgccatgaaaggccgcctggctgaggctcgcagcatacttgaacgcacgcgccacaaggatgaggtggaatgggagttgatggagattaccgagacgctggaagaacagagttcgctgggtaaaccgcgtttacgtgaaatgctgacgccgtggctgttcaaactttttttgattggtgtcggtatcgccgttatccagcagctaaccggcgtcaacaccattatgtattatgcccccaccgtgctgaagtcaatcggtatgtcggataatgccgcgctttttgccaccatcgccaacggcgcggtctccgtcttgatgacgtttgttggaatctggatgctgggtaaagtgggtcgccgaaccatggtgatgacgggacagtttggttgcaccgcctgtctggtctttattggcacggtgagctatctgctgcctgaaacggttaatggtcagccagatgcgctacgggcttatatggtactggcgggcatgctgatgtttctcagtttccagcagggtgccttgtcacccgtgacatggttgttattgtcagagatatttccgacgcgactgcgtggcatctttatgggcggtgccgtattcgccatgtggatagcgaactttctgatctctcttttctttcctcttcttcttgcccgggtgggtctggcgggtacgttctttattttcgccgccattggactctttggtgccatctttgttatcaaatgcgtgccggaaacccgcaacaggagcctggagcagatcgagcattatctgaaaggctggcttgatgatgaaaatcgccatacggccaacaatgccgttttcgtttcaaaaagccgctaatggtaggcgcttaagagttggcaatcgcatgtgccgtaatgaggacgttgaagggatgacagtgctcaatgttatctgacgatgtcccgtagatgacagcgttccaatcttaacgctgcgctgggcataacgaagattgatcaccttctgcgccaccagttgagccgtcatgcagtataaccgccccggatacagagacaggctgatatccggggcgttattaattaccgtcaggcgctgagctaagcaccggtgttccccctacggactaatttaggggaaagccgctaggccgaaaagcgacaaggacgatcaagctcgtcgagcttcttttccaccagccattggaacgttttgccatccgggcgggaatacagcgcttttcttagcgggacgagcgctacccacttttgagcaatcgtcatttttctgacatcggctagcggcagcccatgatgttcgcttatcgcccggttaacggcctgctcggcggtgacgccggtccagttacggttgcgcttcaacgcttcgccaaaccacagcaggcgaaaactctggtgacgttcaatcagccctttcaccgcactgacgcgctgccagaacgttttactgagggtatcaatgacatcctcaggaaagaaagaatccatggtggttctcctttgcagatgaatgttcaggtcgttatgtgccgctctactctgtgttatcggcaaacttccgacagagatacagcggcttatgaaaggaatgataggccggtcacaggcagaatcctcgcccttttacagccttttacgtcctttacactatctaaagagagatgacatgacgtgtgaatgaaaaaccccgtgtctggcgcatttcccgtgatcactaaactggcagtggggttatagggtcagcggctcgtccagcgcgttcagttgctgccgcgcaaaccctaaaaatacttccagcgcggcgctgcggggccgaccggaaggcacctgcaactgcaaattgcgctggcttagctgatcgatgcccacggatcgcaaaaccaggccgtgcgcttcggcttcctgtatcacgctgaaagcactacaaatggtgacggctaacggcgtatgcagcaggaactgaaacagggttgaaaagttatcgcaggtgacgaccggttcaatcagattgccgctcatgtggctcgccagctcgaacagctgccgtaccgtggtgttttgctgcggcagcgccagcggataatggctgatatcgctgagtgtcacctgcggcgcgctggccagtgggtggctctgatgcatcaccaacagcaccggtgcaggccaggaaccgaggatctcaactccgtgctcagcgtgcaggctgaactgtaacgccaggtcgcattctccgttgcgtatcagttctgatacgccctgcgggctggcgactttgatttcaaaaagaatgccggggttatcttcccgaaaggcggcaatcatgcggggcagcaacgtaaaggccagtccatcggtacaggccagccgaatcaacgtacggcgcacggctttcagccctttgatttccgccagcgcgtattccatatccagcatatttttgcgcacgtgatgagcaaagatttccccggcttcattcagcaccatgccacgcgcgtgacgctcaaacaacggcacgcccacctgtgtttccagccgctgaatctgtcggctgattgccgacacggcaataaacagctgctcactcgccgcgctgagcgagcctgtattcgcgacggcgaggaaatagcggatttcattactgatcatgcggtcgcctcatgctggtgcatgcctcgaaaacgggcacatttgctttgctctaaaagcaaaccttactagataaattgataatggtggcaaagcagcgtttcagcaatgatgacaaaaccataatatgaataaaagacgagcaaacatgacagcccaacaagcggtagaccaggccaccgcatggttcgacagtggcgagtttcaacggctactcgcacgccgtgtttcgcagcgtaccgagagccagcgtcaagatcgcgacagcgaattacaccactatttacatgacgaaatcggcccacagctgagtgcattgggttttaccctgcgcttcatcgagaacgccgaagcggcccatcgtccgtttctggtcgcagtgcgcattgaagatcccactctgcctaccctgctgagctacggtcatggcgatgtggtgtttggcgatgatgaaaactggcgcgaaggattattgccctggcagctcgttgaagaaggcgatcgctggtacgcccgtggcagcgcagataacaaaggtcagcactgcgtgaatctggccgcgctggaacaggtgttcattgcacgcggtggacgtctgggcttcaactgcaagctactgttcgagatgggcgaagagatcagttcccccggcctggcgcagttgtgccagcagcacggtgatctgctgaaagccgatctgtttatcgcctcggacggtccacgcctgaatgcagtgcaacctaccctgtttctgggatcgcgcggggccgtgaatttccgcctgacggtgactgcccgtgacaacgcctatcactccggcaactggggcggcttgctgagcaatcctggcacccaactggccaacgccattgccgcgctggttaatgcccagggcgtgcttcaggttgaggcgctgaaacccaactcgctgaccccgcaggtgcgcgacattctcagccagattaacgttggcgggatgccgggcgatcccgagatcgatccgaactggggcgaaccggcattgacgccaacggaacgtctgtatggctggaacacgcttgaagtactggcattcctgacgggcaatcctgcgcgcccgatgaacgccattccgggtgaagccagcgccgtctgtcagctgcgctttgtggtgggcaccgactggaagaacctggcgcagcacgtcagcgaatatctggcgcagcacggctttggctacgtgaaggtcgagtttattcgcggatcgccggcaacccgccttgatcccaccgatccgctggtcgactgggtgctggccagcatcgccgaaaccagcggtaagaaaccggctctgctgcccaacctgggcggatcgctgcccaacgaggtgttttccgacatcctcggcctgcccacattgtgggtgccgcactcttatcccgcctgcggtcagcacggcgtgaacgaacatatgctgaagtcgattgcgcgtgaaggtctgcaaatcatgacccgactgttatgggacttaggcgagcaaggccgcgaactggtggcgaagcaccgtcaacatgccggaggtgacgcatgagcacactcaacacggctgcaccgctgcacgcgaataaacccagcctgcacaaaacccttttcgccacctgcatcggtaacgcgctggagtggtttgatattgcggtttacggcttttttgccagctatattgcccatgcattcttcccgaccagcgatccgtccgtttctatgttgctgacctttggcagtttcggtgtctccttcctgatccgtccgctgggcgcgattgtgctgggtaactatgccgatcgccacgggcgtaagaaggcgctgctgttgtccatcaatctgatgatgctgggcggtgccatcattacgttcatgccaggctacgcgagcattggcctggctgcgcctttgttgattctgctggcgcgtctggtgcagggcttttctgcgggtggcgaatttggcagctcgacggcgtttctggtggagcatttccccgagcgcaaagcctttatcgccagctggcagtttgccacccaaggggcaagtacgctgatggcatccgcgtttggtctgggattaacgcagattcttactgaaagccagattcaggactggggctggcgcattccgtttgcctttggtctgctgattggcccgctggggatttatattcgtcgccacgtacatgaacctgccagcttcgccacgcggcagcctgaagtcgccccgcttaagcgcctgtttggccgtcagaaagagctgatgctgctggcgattggcctgatggtcatctctacggcggttaactacatgctcaactatgtgccgacctatgccacccgcaacctgcacctgcccggctccgtcgccttcaccgccaccttgctggcgggcgtgatcctgaccgtagtaacgccgattatgggcctgtgggcagagcgcgttggccgtgtcccattgatgtggggatcgctgattttactgatcgtcaccatctatcctgcctttaagctggtggtgaatcacaccacgcccaccacgttgatcgttatggtctgctggatggcgttgctgaagtcgatttacttctccacggtgccgtcggtcatggccgatctgtttccgatgggcacccgcgccagcgggatggcgatcagctataacatcgcggtgacggtatttggcggatttgcgccgctgatctgtacgctgttgatcaccgccaccggcaccagcctggcacccggctattacctgatggcgatgtcggtgctgagcggcctggcgctgctgcggagccagaagcggattcggtgagagaacaggtgcacagggttgtagcacctgacggattttatcgccgtgatgaacagacagcgtgattttggaaagggattcccatttttgtcatccatgtcagatttccgcagttcgtcatggcagccttaatcgtttacgcgttctggcgcatggttcatctttacggtgtagtcagcagctcggtccgatttcagcatgaccgggcttcactctttttgttgcatcatgccctgtcattaaagtgtttacctctctcataacaaggatgatggaatgacaatatctaaggaaaagaccaaaacagatcagtaccaaatccgactttctcacgaatttcgagcgcagctcgaagaacaggcgcgtgaggatggtgacatcaacctggcgacgtggataaagcggatactgaggaaagagcttaaggcaaggggcgttaagccgaaggggtgaggaggctagcaattagaatttataagttatttaaagggattttataaactgtaaccttaatgtgacatataactaattatactattccgccaatccttatagtctaaatatttctataataataaagtttttacatgttaatttgtaaagccctcctttttatcaagagggccgataaattttagttcagatacttatacgttaccatcagctaaaatctcattactttttctaaattagtagttccgtcaatcctaaaagaaagaaaaaacacataagcaaacattgcacaaacgaaaaaaacaaatataatcaatattaaaataagcaatgggtaatggaaatgatagaaccgattcaattctatgctaaaaattataaagcatacaaggaaattaagttagacgtaaagaaaatcaacatctttatagggaaaaatagcgctggcaaaagtgcactggcaagattagcgcctttaatcttgaaatcgttagatgttagcccaggaaatgttcttgactacagtccattaggtatagatatcggcgcatcttacttggatattgtccacgggcatactgaatataccagacttgttctcggagctacctttaggattaacgaattaaacgtctcattcaccacggaattaaatttctcaacagaattaaaatcattactggtttcgaattttaaagctacaatcggagaaactcactatcaggccgaattggatttggaagctttaggaaaagatggagttataagttaccaatccaacggaaaagcgcagaatttaatttttaatggccttttacccacaaacttagatgaatcagaaaatgagttatttagcacattagataaaataagaaagaacgaatttgacataagctacttaggcccattccgctccgaacttcaaagaacttacacatcaaaaagtttaaaaaatttagacattggcgatagagggcaaaatgcaccatatattttcagggaagtggattataaatataatggaatattaagtaataaagtgaaagaatggatgtatctcaacttcgataagaaatttttcggattaaaattacatgacggttcattttcagtaatttgtagcaatcaattcaatgagtcaaacatcgtagatgaaggtatgggttttgctcaaatatttccatctataattaatcgaaacgttcgtgatttaaaaaaaataaaaggcattgaaataattgaacagcctgagctacacattcaccccgcagcatgtggtacaatagccgatttatatttaaaggcaagaaaaaataacattatttttgtagaaacacattcaaaagagtttattttaagaatcagaaggcgagttgcagaagggattgattgcaaggaagtgaatcttttatatattgattatgacactattgataaaacggcaaaaatgaaaccaattaaaattaacgatacaggtggagttgaatggtggcctaaaggtatttttgaagaggatttcgatgaagttatagctcttagcaaagcgggagcatcaaaatgaatataaaatgtgaccctgatgtatttaaatccgactctgagagaaacttttttatttcatgcatggtttctcataacaaatctcattcgctagatgtaggcaacatcgatgaattgcttgagcatcataaccttagcgattccgaaagaaatttaatgctaagattggctgtccactctgcatattctaattactcactaaaaatcaccatttcaaacactcatactggtaacggaatattcccctgtgaacaattaaatgatattttaagtcgtaaggctgttataattttagagaatgaatttagcgatgcacgtttcattgagtctgtgataaaaagtcaaaataaagattatcttctcaaaactaaagacatatcttgggaattttgtggtgcaggaggatgcggtgagatacctaaacacatacgtagcaaagtagaaaaaatgaaaaatctaaaaagaattttagtcgtacatgactcagacaaactacatcctgatagtgaaatcagtgaaattcaaagaaaaataatcgaacaagccaaagaatatgatattttttgctacactttagaaaaaagagaaattgaaaactacattcctgatgaaataatttacaatatagattggacacgaaaaaaaataatagagtctttttcaaagttatcatcaactcaaaaggatttttttgactacaaactcggctttaagaaaagaggtggatataaaaagaaaaatgacacttcattaaacggattatatgaagatattgatgacgaagtttacaatgaaatcaagaacggttttggaaaggaaatatctgatgcagcatacaacgaacacgtccgtatttcaaaagatgatttttccttaagatgtgataatataaatcatgaattttttaaaatctgtgaggctattgagaaaatattatgaataatgataaaaatgaaataccttcagtaagccccgaagtaatgtttatagacgatttagtttcgcatattgaaaatggtaaaatcgttttgcctgagtttcaaagaccatatgtttggaaagaaaaagatataaaatatcttttcgatagcatttataaaggttatccaataggatctatattactatggaatggaggaggcaaagacatccccactcccaactatgttggagggcgagttgtgcatcaagcaaatggtgataaatattacatagttgatggacaacaacgcttaaccacgcttttttgttgtctttctgatgatatagatgatgaagaaggtaagtgggatttatatttcaacctcaaggatgaagcttttacacattcccccggcaacaaaaatgcagaccctcaccttataagtataaagtccttaaggaaaacaacatcatttttaaaagaagcaagaagaatcattgaaattaccgaagatgatactttaattgaaaaggctgaatatttagccgataaaatacgaaaatataaaatggctgttatcaagcttgacggtggtgacttatcagaggtagtagaggtattttcaagattaaattcattgggaaaaaacataggtcagaaagatttggtatatgcactaacttatgatggtaattccgatagtggcatcaataaatttattaatgacatcaaaaaatgttttggtgattatttcattgaagaaagtaataaaaatgaagtttaccttcagttagtcaagactgcaattggctttgaagtatacgagcaagatagaaacaaaatagttgaaaaactaaaaataattaataaaaacaacccttctcaacttacagaaatcataacctcactgaaagaaacattgcatttctttgttgaaacaatgttaataaataaattatcactgttgccatacacaactcttttctttatggcatttcactattttcattcatataaaggccaaaaatcaaacaagactttaagcaactggctatatttaatctcaatttatgagcttgggagagttagtccttctaaaatagaagggattatactttttttcaaagccggcctaaaaaaagaagaactaatcatacatcaaaatttgattaaaaaattaaaaagccctaatccattagatatttctgtgaagtatacagccggatctgcatcaggaaaaacattagcaatcgttctcaaatcccatatcaattcaattttatcaacaaaaaatattgatgccgatgtcaatgctttttctgttttcccgccacaaagcttgtttcgttcaaacttaagtaatttcctcgggagtaaggttttctttttgaataacgaaattaaagataaaattataatagacatcattgaagatgccatacctacaaactcgctatctacgattgagaaaaataaagaagaaataattgaaataagaagaaatcatattgaaattatttataaaagctttgcacttgatgtcacatctttcttacagaaagagtatctttgaatgatttaataaatattaaaaatatgctccactgttgaaaaatagcagtgaggcatatttacccatttaatgaaaaataaaatttcacctatagtgatcgtaaatacaccttattattttattgatattcttagtcaaacccattcataataaatgaatttacttcatattaaaccggctaaccattcactataacacacaacttagcaaaaaaaatcaacattttcggataagaaaaattcaaaattatattagtaactctctatttccagttctacgctcaccggtagttttatcactggctttcgcattttaccctggcaaagtacttcattcaaaaattcaattacacattgtaaggttaaaataaaatactggattatcatcaaatggtaattctctcctaatagaacagcactttcaaattcccatcaagtagatgtcgtaaaagaatttttaaaatttgccataaaaagggagttcgaagggtggctaatttattctttgccacactaacttccaatacagttatattcgatcaataaacaactcatctgaaataccggcgaataattcattaatctcttgatagactagattataaaaattacgacgctcgaaaaaaaatccgtataagaaatattttttattgaaacaaatagacagaccatactggctacagacgcaacacccccaaacgcaaaaacccccgccgaagcgagggtttcaaatttgtggtgcccgaacccggaatcgaaccagggacacggggattttcaatcccctgctctaccgactgagctattcgggcaacggggcgcattaaaccttatgcaggccccagcgtcaaacgcttttcacaaaaatgaaatcaactgacgggttttccatcaacccggatagtcacggacgaaaatttagcgatgcgctcaaaaagacaccggattttcgcgctgccgaacgccctctgacaggcgttttttcgctgctattttgctttatccacgatttatccgcgctctttttcccaaccgtttttttgccataaatccgtcatctgcgctcattactctacgattattcctggacaatcaagagccgcatcatgcagttacccgcctctgtgaatactgtgatttccgcctcaagccgttatgacgcacgggtgctctgcattgatgttccttttgtcagccccgacacggataaccgtgccgtgatggcgctgtttgccgagcataaagatcttattggcctgcccgtggttgaaaacggcaagccgtttggcatgattaaccgccatatctttttgtcgcagatggcgcgcccgtttttccccgaactctatgaccgcaaaagctgtatcgcctttatggataagttcccgctggtaattgacgtggaaaataccctggaaagcgtcgcacagcaggtggtggctaacggcgataagtctgtggccgatgggtttatcctgaccgagcacgggcactatatcggcattggtttagggatcgatctgattcgccgcgtctccgatttgcaggcgcgccagcatcagcagattttacagagcattgattatgcgcgggtgattcaggacgcgatgctggaccgctccaaccagttaatcgcttccctgctcgacgactggtgtttgtactggcaaccgcgtgacggcgtgggtggcgattactatgcctttcaccgtcacgacagcggctggctggcggtgatcgccgactgcacaggtcatgggattcccggtgcctttatgacggtgattttgcagtctgcgctggaaaacgcgctgcgcgaggccgatctccaggccccgtccagcatcctgcatgcccttaaccaccatatcaaacagacgctcggccagctgaatgcctcccagcaaacgtcactgtctaacgacggctgcgatgccatcgtgatatcggtcgataccgagcggcatcagctgcgctgggccagcgcccgaacccaggcgtttatgctcagccacatcagtaaagaaattacctcgctcagtcaggatcgcgtcggcgtcggctataccgatacgccagaagactatcactggcctgagcagagcttagcgtttaaccgtggcgacatgctgtttgtgctgacagatggcgtcaccgaccagccgggtggcgagcgcaatatcatgtttggtaataagcgcatccagtctctgctgatgcgttatcagcagttgcccatgccgcagttatcactggcgtttcagcaagattatttaagctggcaaggtaaccaggcgcgacgcgatgacgtcacctggtttggctttcgctattgaccgcaccgggaagaaaatgaaaaacgagtcactacggggtctgcccttcaataccgaatcgcagtccggccttattgcactacagtacaccggctttttttcaccccagaacatcacggcaatgggtgaagtggtcaaactgtttctggaaaaccatgagcagtcgcaaaaggtcagacggcggctgttctccagctttgtcgagattgcgcagaacattttacgttactctcaggacagccgggcgctgagccataacgatcagctgtatcgctttggttcattgagcctgcgctacgatgacggtcgctattatctggaaagcgctaacctggtcgccagtgacgccactcatcagctgcgcggtgatttggattcgctgcgggtgatgaatgcggatgaaattaaacaagcttatcgaaaccggttacgcgctgagagtccggtctggagcaaaggcgcaaatatcggcttgcttaccctggcgcgcgacgtcagtgaaccgctggaatattgtttccagccactggaggccagcgagctctctgccttttggttaaaggccactatctgccatgactgaagaaacccttatgcaaaccattcaacttaccgccactgaatgtacgcccgccgtagagtttgactttgcggcccaccgattctccctgaaaggagaatcctggcccgagaacgccgccgccttttaccggccgctgcaaagcgcgctggagtgctggcaaccgcaggccagccaaccggcagaggtgaatattgacctgagctatttcaacagctcaagcaccaagatgctgtttgggctgttcgatcagttcaacaggctggcgcaaacggctgcacgataatactcaactggttctacgatgccgaagacgacgtttcggaagagtttggtgaggagctgtcgctggatttcaccgcgttaaccgtgaagctgcatgcggaacagcgccaatgacgcaacttaacgagctgttcctggaagaaacccaggcactcaatcaggccagccatatcgcggcacagcaaagcctacacgccgaagagtatcgccaggcgttgctgcagcttaacagccactaccagcggctgatgcgggaaacctatcggctaatctcgcgcagcgatcgggcagagcgtgagctgaaccgggtgaatgaacaacttaacgagctggcaacagagctggagtacaaagccacgcacgatcccctgaccaatgtctggaaccgcagcgccattattcaacgcatcagcgacacgctggatcaaacaccagcggccttaatcatcctcgatatcgacttttttaaacgcatcaatgatgaatacgggcatcccgtcggagataaggtgatttgcgagctggtgcagcgcattcagcgtaatacgcccgacatggccagcatcggccgtatcggcggtgaagagttcaccatcatgttacccaatacctggctgggtgatgcagtgatcgttgccggggccattcttgcctcattaaacgcctcgccgcttaatgccctgccagagcggctggtcacggccagcctcggcgtcagttggggcgcggcgggcacccggtttgaaacgctttacacccatgccgatgcggcgctctacgatgctaaaaagcacgggcgtaatcgggtgttcttccgctagcctgcccgatgctgtaccacctcgaccggcggtgtggtggtcggcggcaggaagatatggtcaagcagctggcgcatgaccggcgcggcaaccacgccttcacctccgccgttttccagaatcagggccaccgccactttgggatcgttgaagggcgcgaaggcagtgtaaaacgtatggtcgcgcagccgtaccggaatcattttggcgttataggtctggttttctttcaggctgaatacctgtgatgtcccgcttttcgctgcaatgccgtagggcgcagtatggaaatatttatagcctgtcccgttcggtgcgttggccatgccaaacatggcatgtcgcaccagtgaccagtacggtgaatgcggatcgccaacctgcgcctggggcagtttagcctgatagagctgaacgctggtgccgcgctgcgatttttccagcagatgcggcgcaatcacccggccattattaattaacgtcaccagcgctttcaccatctgtatcggggtggcaatccagtagccctgcccaatccccaccgacaccgtatcgccctgataccacggctttttatgcactttcattttccagtcgcggctcggtagcagcccgctgtactcttcgttcaggtcgatgcccgtgggctgaccgtaaccgaatttgctgagcatggtgtgaatacgatcgatgcccatcataaaggccacctgatagaagaaggtgtcggcagactcttcgatagctttggtgacatcgagcgtgccgtgcccgctttttttccagtcacgatagcgacgatcggtgcccggtaaggtccatgtcggcccaccaaaaaaggtggtttgcggggtaatcacatgagttaacagcgcagacatcgccatatagggttttacggtggaagccgggggataaagaccctgcgtgacacggttgatcagcggcagatttttatcctgcagcagcgttttgtacgccttgtagctgatgcctttcacaaacgggttaggatcgtagctggggctggaaaccatggccagcacggagccgtcgtgagggtcctccaccagcaacgcggcacgctgcccggccagcaggctttcaatatactgctgcagatgcaggtccagcgtcagggtgatgttcttacccgccaccgggggcacttctttcagcacccggacaatgcgcccatggttatctacttccacttcctgataacccggcttaccgtgcagcagggattcataatagccttcaatcccctgtttaccgatgttgtggtcagccgcgtagttttctgcaataccttctgcattcagccgtttgtagtcgttgtcattgattttagaaacgtagccgatgacgtgtgccagatcggccccatagggatattctctgtcctgataggtatcaatgctgacgccggtaaagcgaaactggtttaccgaaaagcgcgccacctcttcgtcggtgagttcctctttgaggataaccggcttatagcggctgctctggtgaagatcgtgctgaaaacgttctatatcgtccggggtcagatcgataagcggcgtgagctggcgcagcacgtctttcatatcatccactttatacggggtgatggtgatgtcgtaccaggttacgttgcgcaccagcggaatgccgttacggtcaaaaatcagcccgcgcgtgggcgcgatagggatcatcttgatgtcgttttgatttgaacgtgtctggtaatagctgtgatcgcgtatctgcaggcgatacaggtttaaaccaagaatggtgaagcagatgcagaccagcacaaatgccatcacggcacggcgtacaaataacttctcttcagcgtcgaaatttcggaaattcatcaggcaggtattttcagtctggcatattgttatttattgttcgtcttcatgatagtgacataagcgatccttgccagtgccaagatgcacaagcctgatgaaaagtgtgtcatttgatgagaatgttgcgaaaagaacgggaagcgtaaattttctgacgcgttaacccggcaacagcgcgctgccgggttaaggatgacattaatgacgtcggggtttaatcacccagcagtactgattccagcgcaatcttaatcatgtcattaaaggttgtctgacgttctgccgcagtggtctgctcatgggtacggatatgatccgacacggtgcagatagtcagcgctttcgcaccaaactcggcggctacgccgtaaatgcccgcggcttccatttcaacgccgagaatgccgtacttctccattacgtcaaacatctgcggatcgggcgtgtagaacaggtcggcagagaagatattccccacgcgcgcgtcgacgcccagatttttagccgcatcaacggcgttacgtaccatatcgaagtccgcaatcgcggcaaaatcgtgatctttgaagcgcatacggttgactttcgagtcggtagacgcgcccatgccgataacgatatcacgcagtttcacatcggcacgcacggcaccacaggaacccacacggataattttcttcacgccaaactcggtgatcagctctttcgtatagatggagcaggagggaatacccataccgtggcccattaccgagattttgcggcctttgtaggtgccggtataacccagcatgccgcgcacgttattcacctcaacggcattttccagaaaggtttctgcaatgtgcttcgcacgcagcggatcgcccggcatcagtacgacgtctgcgaaatcgcccatttctgcattaatgtgaggagttgccataattctctatcctttttaaaaatttcgctgtttttacagcatgttcttgccgtagtccatgggggacaggtcaaaatagtgcgcgatcgtctggccgatatcggcaaaggtttcacgatagcccagcgatcccggctcaacctttggtccgtaaattaagatcggaatgtgctcgcgcgtatgttcggtgccctgccaggtcggatcgcaaccatgatccgccgtgaggatcaaaatatcatcctctttgacccattccatgagctctggcaaacggcgatcgaacagctccagcccgcccgcgtaacccgcaacgtcgcggcgatggccccaggtggaatcaaagtcgacaaagttggtgaacacaattgcctgatccggcgcagtcttcatttcctgaatggtcgcatcaaacagcgcgtccagcccggtggctttcacttttttcgtgatgccctgctcggcatagatatcggcaattttaccgaccgaaatcacatgaccgcccttttcgtccaccagctttttcagcatggtcggcgatggtggctcgacggccaaatcgtggcggttgcctgtgcgctcaaagctgcctgctttgtcacccacaaatggacgggcaatcacccggccgatgttatagccgccttcggtcagctcttcgcgggcgatttcacacagttcatacagccgctccagcccgaaggtttcttcgtggcaggcgatctggaataccgagtccgccgaggtatagaaaatcggcttaccggaagccatgtgctcttcgcccaactggtcgaggatcaccgtacccgatgagtgacagttaccgagatagcccggtaaaccggcgcgttccaccagtttgtccagcagttcctgcgggaagctgttctgcttatcactgaagtaaccccagtcaaacagaacaggcacaccggcgatttcccagtggcctgacggcgtatctttgccagatgacagttcacgggcgtaagcataagcgcccgtgatcttagcctcagggtccagtcccggcggaaaacgcccggttgaaagcgctgccgctttgcccagccccagcgcggtcagattcggtaagtgcagcggccctttacgacctttatccgcctgaccgttaaaacaggcttctgcgatatgacctaacgtatctgaacctgcatcaccgaatttatcggcatctttgctggcaccgattccaaaggaatccagcaccataataaaagcacgtttcatgccagtctcctgcgccaaaagcgcgcgacaagtcaaaaaaaagcgatcagatcagtatacccgaatcctgtgcggtatacagtcgctatccgcgtcaacccgcctcagtcacccggcgatacacgacgggcgtggccgctggcgcgctgtcacccagcgtgatggccgcttttacggcggcagcggcctgctgccagtgcgcttcgctgctggcatgaataacggctaacggacgggaggcatccacctgctcacccagggtaatcatgtcgctcaacccgacgctgtaatcaatggcatcgctggcgcgctggcgtccaccgcccatcgctaccaccgccatgcccagcgcgcgggtatccatatgggtaacacagcccgcgctgtcggcataaaccgctttgctcatcgtcggcgcaggtaaatagctgtcgtagcgctcaacaaaatcgctcgggccgttttgcgccgccaccatgcgggcaaacacctctgcagccttgccgttatccagcaccgtcattaatttttcgcgtgcctcagcatcattttccgccagtttgccggagatcagcatttcgctgcacagcgccagcgtcacttccagcagtcgcgggttacgctgcgcaccggttaagaagcgcaccgcttcacgcacttccagcgcgttaccggctgtggaggccagcacctgattcatatccgttaacagcgccgtggttcggcagcccgcgccattggccacgccgacaatggcctgcgccaggttttcagacgcctcataggtcggcataaatgcccctgagccgactttgacatccatcaccaatgcatccaggccctcggccagctttttcgccaggatcgaggcggtgatcagcggaatggaatccacggtggccgtgatatcacgtgtggcataaaaccgtttgtccgccggagccagggagttggtctggccgataatcgccacgccaacctgcttaatggtctggcggaagtggtcatcactggggaaaatatcaaaaccaggaatcgcttccagcttatctaaggtgccgccggtgtgccccagcccgcgacctgagatcatcgggatataaccgccacaggcggccaccatcggccccagcatcagcgacgtgacatcgccgacgccgcccgtggagtgcttgtcgaccaccggcccgttgaggttcagggatttccagttcagcacggtgcctgagtcacgcatcgccatcgtcagcgccacccgttccgctagcgacatatcgtgaaaataaatggtcattgccagtgcggcaatttgtccttcggaaacgctgttatcgcgcacgccgttaatgaagaaacgaatctcgtcttcactcagcgcgtggccgtcacgtttttttcgaatgatttcttgtgcgaggtacaaagttgcccccttacgtcagggaaagaggagaaaaggcggccggatgccgcccagagatattagtagcctgactgtcgagtatcgctgctgtgtccaagcgtgttcagcaggcttgccaacaggctggaggcaccaaaacggaagtggcgcgcatcagcccagtcagcgcccagcgtatcttctgccagttgcagatagatggcggcatcttccgccgtgcgcacaccaccggcaggtttaaaaccgacctgcgctttaacgcctttatcgcggatcacgctcatcatgatctgcgccacctctggtgtcgcgtttaccgccactttaccggttgaggttttgataaagtcagccccggcgtcaatggcaatttctgaggcctgacgaatcagcgcttcctgtttcagctcaccggtttcgataatcactttcagcagaacactggcgtcggcgcaggcggttttacacgccttgaccaaatcaaaacccacctgagcattgcccgccatcagcgcgcggtacgggaaaaccacgtccacttcgtcggcaccgtaagcgatagccgcacgggtttcggccagcgcaatctcaatgtcgtcattgccgtgggggaagttggtcacggtagcaatacgcacatccggggttccctgctcacgcagtgttttacgggcaatgggaataaaacgcggataaatgcagacggctgcggtattgcccgccggggatttagcctgatgacacagtgcaatcactttctcatcggtgtcgtcttcattcagggtggttaaatccatcagtttcagcgcgcgcagggcctgctgtttgatatcggtcatagcgatctccagaacatggggtgaatcgttgaatcacccttgcatgtgataatagtaacaattcggggccgggtaatatgtgccatacgtcacatcaaagtatgaaacaactgcaatatctaacaagaaagtggattaatgcacgctatccggccgagtcaacccagtataagccagcgctgagaatgttactattataacatttgggtgagaaaggggtaaaccggcgggattacggaagaagaaaaagtctgtggctgttatgccatagcgcatcggcgatcgtctcgggcgattcgtcacgcagttcacacaacacctgccacacctgaaaggcacgctctggccggttaggctgtccctgaaaaccgttgaggggcatatccggtgcatcggtctccagcaacagcgaggagagcggtagctgcgcaatggtctgccgggttttactggcacgaggataggtaatggtgccgcccacgccaatcgcatagccgagtttgataaatgcctgtgcctgttgcaggctaccggcaaaaccgtgcacgacgccgcggcgcggaagatcgtgacggcgcagatgcaacgccagttgatcgtgcgtgcggcgcgagtgcaggattaccggcagatcataacgtttcgccagcttcagctgcgcatccagaaaatatgtctgctgatcaaaatggggatcttcacgataacgatccagaccgatctcaccgagggcgaccagtttagcgggccgctgttgcagcaacctttcaagctcagcgaggtgcggctctttatgatgttcaatcacaatcggatgcagacccagcgcagcataaaggggctgatgctcgcgggctaactggcaaaccaggtcaaagcgcccggcctctaccgacggcacaataattttttcaacgcccgcgttcgcggcctggcgcagactggcatcgacctcatccacgaacggcggaaaatcaaagtggcagtgggtatccacaaacctcatgccagcgaacctttactgtaggcatcatcgttgcctgccaacggcgtgatcaccgccgcgcgctccggttcattcgccaccggcgctgatggcaacacgatatccagcccggttgcgggctcggcatcgctcagccactggcctagcgtggccataaaatagcggccacagcgacgtccaagatggtagtcctgattgagcgaagcgacccggctgcccagcgcgttactggctaaggcgcgcggcgggaagatttcgatgatgcgtaaatcacccggtggcttctcaataaactgctgggtttcacggtagctctgctcgtgatgatgcaggatattgatcatcggctgcagcgcactgccgttgaaccagcgctccatgcgcgtcatccagcgcggcgtgtcaaacatctgcgagggcacggtgcggatcaccacaatggtatccgcgccgcgttttgcggcctcccggacgggaatcgcgtcactgacgccgccatccagatagcttattccttccagatccacgcccagccgataaaagcccggaatcgcactggaagctttaataatttccagccagttatcactggtgggcgcaaaataactgggcgcatagtcatcactgcgacaggcacacatatagaattcgcgcccgttcgcaaacagcgtttcggcactgctcatcgccaggggaaattcacttcgggtaatatcgatcaaccagtcgaggtcaataagattgcccccacgtaagaaacgtagcggatcgaaaaacagcttgctggtggtatagcgcgtaatgacccgacgtgcgtagcccggctgtgcacacacaaaggcagacaggttctgtgccccggctgaggtgccaagcagtaactggaaggggttgaatttagcccgctgaaactcatctaaaacgccagcggtaaagatgccgcgttgaccgccgccctcgcagactaaggcgattttcctggctttaaaaggtgtgagagcaaggggttcaatcgcccccagcgtcacgggaatacgtatacccaatgtaccgacctcagattgggttcccgatagacaaatgtagggaatgcagggagtagaattgtgggtcgatactagcacggagaaccagctatggtgtccataaattgtgctattggcgttgcgccgtttaacacatcgttgcgaatatgaagcatcctttgcttcacaataacattcgctacaaataactggtctccgtttaatactggctacgccagcattaaactgtctgggtcatcgctatagctttttacggccagtgaacaagctgatgaggaacagaataatacccaccacgaagaccactttagcagcccaggctgcggtaccggccaggccaccaaaacctaatgcagcagcgatcagtgcaatcaccagaaaaataatgccccaacgaaacataagcctctccttcaccattttaatattgaactgcttgtttcatcccaacgatgggtatttttatcagtgcggcctcgcgaggaagccgcaccgggtcgtgttaagacttgaccttcaggtcatttttaacactttttacgccttcgatagctttagcgatgctctcagcacggtcagactgtgcctgattcgccacttcacctgagagctgaaccacaccatcggtggtttcaactttcacgttacgtgaaggaaccatgtcatcagctaatagcttagctttaatttcgctggttgtagcagcgtcaccggcataacctttcattgactgattttttgcgtctttcacgtgcagtttgtcgctgacggatttcacgccttccacttttttcaccacggccacggctttttcagcctggtcttgtgaggtgacaaaaccgctcagcgtcaccacgcccttatgggttttgacagaaatgtcggtgcttttgatggaatcgtcatcaaccagggccgctttcgctttggcggtcacggcgctgtcatccataaagccgcccactgatttcattgagctgtcgattttagaaccggcgctgtcagccgtctgtgacgctttctgagacgcggattcctctgcaaatgcgcttccgctcagcagagcagtaccgatcatcgcagccatcaatgttttagtaatcttcgttgtgtgcatcgatatcatccttctatctggtaactcgcccaaaactgtgggcgcaagagcagcaaacagtgctgctgcggcactggacgcagggagaaataagtctctttaaccgtccgatgaagtaatcatagtcgggatttagagatttgcttgggtaactggttgatcgtgcgtcaaaagcgaggaaaaagcgtgttttaggagggttctgtatctgttaaaacagggccatcccgcgctggaatggccctgcaggcgcggattaatgttcgcgggttttgcggaacgtcacatcaggatagcgttcctgcgtaatgttcagattcaccatggtcggcgcgatataggtcaggttatcaccgccatccagggcgaggttaacctcgtttttacgctggaaatcttcaaattttttggcgtcactgcactcgacccaacgcgccgtagagacgttaattgcctcatagatggcttcaacgttgtactcgcttttcagacgcgcaacgaccacgtcaaactgcagtacacccacagcgcccacaatcaggtcattgttatgcaccgggcggaacacctgcaccgcgccctcttccgacagctgtaccagccctttcagcagctgcttttgcttcaacggatcgcgcaggcggatacggcggaacagttctggggcgaagttcggaatcccggtgaacttcatgttctcaccctgagtaaaggtgtcgccaatctgaatggtgccgtggttgtgcaggccgatgatatcgcccggataggcttcttccacatgcgaacggtcgcctgccataaaggtcagggcgtcagaaatcaccacgtctttgccggtgcgcacctggcgcagcttcatgcctttttcatagcggccggaaaccacgcgcataaacgccacccggtcacggtgtttagggtccatgttggcctgaatcttaaacacgaagccggtgaacttctcttctttggcttcaaccttgcgggtatcggtatcgcgcggcatgggacgtggcgcccacgctaccaggccatccagcatatgatctacgccgaagttacccagcgcggttccaaagaacaccggagagagctgaccgctaagaaatgcctcttcatcaaattcgtttgaagcaccctgcaccagctccagctcgtcacgcaactgagcggccagctcttcgcctaccgccgcgtcgagctctgggttatccaggcctttgacggtgcggacttcctgaatggtgtgccctttaccggtctgatagagataggtttcatctttataaaggtgataaacccctttaaacaacttaccgcagcctatcggccaggtgatgggcgcacaggcaatttttaactcgctttccacttcatccagcacttccatcggatcgcggatgtcacggtcgagtttgttcataaaggtgaggatgggcgtatcacgcagacgggtgacttccatcagcttgcgggtacgatcttcaacgccttttgccgcatcgatcaccatcagacagcagtcaacggcagtcagcgtacggtaggtatcttcagaaaagtcttcgtgccccggcgtatccagcaggtttaccaggctgtcacgatagggaaactgcataaccgacgtcgtaatcgaaataccacgctgcttttccatctccatccagtcagacttagcatgctggttagagccacggccttttaccgttccggcggtctgaattgcctgtccgaacagcaggactttttcggtaatggtggttttaccggcatccgggtgtgagataattgcgaaggtgcggcggcgtgccacctcttctaaaaagggattagacatgagtgaattcttctcaacgtagccacgcactaacaggcgcagcagataaatcacggtggccggcagaaccttaccggcaggtaaacggtgccaaatgcgactttatgtcgtcgcggggtgagcgcaaagttacattggcgtgcttccggttacctggtcaactttaaggcggcatagcatacaatattttgtgctaatggcctacagcgtaccgaagagaaagtcacgtcggcctgaaactccgctcaacgaggcttagcacggatgcggcggcccaggcgcgcggcgcagtcatcctgccgccagccacggctgtgaaagtgaaaacccccacgtcactgcggcccggtgccggttaatccaccaattcaatccctaagctttccagcagagacaccgcctcaaggcgcgaaaatttggctttagtgaccgtattgtttaagacatcaatgctgtaattccatgcgtcggtaaaatcggcgccccgcaacagcgtgtgattgaataagctgcctgtcagctccgatccgctgaacgttgcgccagtcagatcgcactctctgaagtcaacctccgccactctgcacgcctccatttttagcccctgaagcttaaggccataaaaggacgcgctggtcagcatgcagttcacaaaatacagctcatgatccagatgaaaatcaggccagtaggctttagtccagtcgatgccggtcagcttgcactccgtgaactgcaggccataaaagcgggtattcggcgcatccaacaggctcagattacagtgactgaaagtgcagttaatgaacttacaggcggtaaactgcgcagaggtgaagttgacgttactaaagtcgcagtcttcaaaatgggtttcagcgatggtcagaccggtgaaatcctcttttgaaaaatgggtatcataaaattcagcgtgactgtcgatacgttgcatattcacccttatcggttaacggtggcattttaccaaaagcttatgcgattttttcgcgacagaaccttctcacgatcacccttcacattttgcctcatgaaccgtcatcgaacatgtctgttcagcgtggcgggcaaaaaaacgcgcggtccgatcgcgtacctgattttcctctgtcgcctccccaggccgcatacagactgcgcctcagccgtccgcaacatcgcagaggatcggcgcacgccccgcctggctaacattcagggagaaaattgaccgcgcgaaaagcagaccacaatgataatcgctcgcattcaacagttgaaataattctttttaaatcaatcagataaattgcaactttttcaacaaaaggcttcccattcgttaccagactgttgcataattcaccactaatttaatgactatcaaaaggacgcggccatgctgactgctgaaatgactggacgtttaaacgaccagctgaacctggaattcttctccgccaatctctatttacaaatgagtgcgtggtgcagcgataaaggctacgagggcgcagcgtccttcctgaaaatgcattcgcgtgaagagatgcaacacatgcagcgcctgttcgactatctgagtgatacaggtggtatgccggtgctgggcagcattgctgcaccgcccgttgcttacaattcgctgaacgaagtgttgattcaggcgctggatcacgaaaagctgatcaccagcaaaatcaacgaactggcgcactctgccatgacgacgcaggactattcaaccttcaacttcctgcagtggtatgttgcagaacagcatgaagaagagaaactgtttaaaaccgtgctggataaactggcgatggtgggcgacagcggtaacggtctgttcctggtcgataaagaccttggacgcatgagcaccgaaaaccactcagcctgaacataaaccggcccacgcaggtgggccggttatcaatattgcggatgacgacagcctgatgcgctatcgcttacgccagccgataacatgacgtcctttcaccgttgatccacagcgaacgctgctcacccggcggcaacataatcgctatctcacgccacgccggcagataatcgccgcgcttttcaatggtcagatccagccgtgacgcgctactggttaaagaccagttcaaccataacgccttgcctttctgccaaccgtgggtttcgccgtcgtcatcgaacacctcaccctgggtggtggcatcgcccggcacaggccaaatctgcagctcacgcacgttatcacgttgcgcatcggtggtggtttcgcactgtcccagtgggagtgcggccccggcacggaccagcaacggcaaccgatccagcggtgcatccagcgtcacggtttgtccgcccgccagccagttgccggtgtgccagtcataccagccgtgggtattttccggcagataaacctggcgctggcgtgcgccctgctccaccacgctggccaccagcagatcgcgtcccagcataaaatcatcgcactcgtcgtacgtacggggatcgtcctcatgatcgaggaaggtcggccgcagcatgggttcatcctgctcgctggcctgccaggcaagcgtatacagatagggcatcagacgataacgcaggcggatcgcctcgcggatcatcggtgtggcttccggatacatccagggctcgttcaccgtatgatcgtcattccaggagtgaatggtaaaccgtggatgcatcacgccattctgcacccagcgtacaaacagctccggatcgggtttatccccggcaaagccgcccacatcgtgccccacgttaaacaggcctgacaggctcatccctaatcccatgcggatgttgtagcgcagggtttgccagtttgtccggttgtcgccgctccaggtctgcacatagcgctgcatccctgcacagccagagcgcgagatcagatacggccgtttctctggggcaaagcgctgctgagcttccatcgaggcccgcatcatcagtagcggcatcaccggacgaatatgcttgatggcgatgggctgaccaaagccatagcagcgcgcttcaccgtcccagacttcatattcgttattgtcgttccaggttgaatcgatgccttttttcagcaactgctcagtgacgttttgctgccaccacgccacggtttgtggatgggtaaaatccagatgcgagccttcgtcatcccagaacaccgagcgttcaggccggtcatgttccgaatcgcggataaacagtccctggtccgccacttctttgtaacggggatgatcctgcagcagacaaggcttgatattggctgccagcttcatcccggcctgatggaaagaagcgctcatcccctccgggttcggcaccttgtcgtagttccagttaaacacgtagcgtttgttgttaatggaggtgtaacccgacgacagctgaaacgaatcgcagggaatttcatgctcacggcacagctggataaaggacaggagttgctgctgcgcatcaggcgcatccgtgtagtgcatggtggaaccgctatagcccaggctccacttcggctgaaacagggtacgaccggtaaggcgaacaaaggccttggtgacgtccagcagcgtcgggcccagcatcatgtagtaatccagatcgcccgcctccgcacggtagcgacgataaggcagatggtaattatctaactcattgcccagatccagccagctgctgctgaggttatcgtaaaacaggccaaagctgacgccgtcacgctgggtcagcgtgaagggaatatgcttgtagagcggatcggtactggccgcgttatagcccatggcgtccaggttacgcatctcataacgacggttaacccggttgaggtcgccacttttttcacccaggccgtaaacccgatcctgcggctgacggcgctgataatgttccacgccatcgccatgcatgttcagcaggtaagccccggtatggcgatcgaccgccagcggttgccagccagtgccgtcaaaatgttcccagctgaggcacagcggataatgcacggtgacgcgcagccggtcagtggccagacggatttgctgcgcctcctgctcaacggtaaaagcgggcagcgtgaagccttccagcgattcgcgatcgcgtccctcccatggcacatcctcctggggagcaatgctccaggtgcggttgagtgccagctctccatcgcgtttcagcagcacgcgcatcaggccattttctaatacgtaaatacgtaaaaagtgacgttgctcgactttcagttcgacgaaattcgccgcctggtgatgaagcgtccatgtcttaagcgttttcatcaggttaccctcaatttttagcagtacgttggcggcgttcggcgataaacatcaccaggaaaaccgcgccaatcaggtcaaaaaagcccatggcaataaacaggggattaaagccaatggtgtcggccgtgacgccgataatcagcgagaaaataaagctggcgatccaggcacaggagccgcgcatcccgttaaccgttgccatctggcggcgatcaaaacgctcgaccaccagcgcactcaacatgcaggagatcacctggtgaccgaacccgccgatggagatcagggcgatggccagatagggatctttaaccagcgtcatcagtgccagagagatcatcagggcagccccggtcacagaactggcaacgatagagttgacgcgggagcagccaaaccagcgcacatagagtttggtcagataaccactggcgatgctgcccagatccgcagccaggaagggtagccaggcaaacatcacgatctgtttcagatccatgccgcgttcgttggccaggtagagcggcacccagaagctcagtaccgcccatgcgggttcagccagaaaggccggaatggcaataccgtaaaatttcttctctttaccaatctctttcatggcggtgaaaaacggcagcttttcgccgatgacttctttgtcctgggtgataaacgcccgttcttcctccgacagacgcggatgatgttcaggtgagtgataaccccaccaccagagcgcgacccagatcaggcccagcccaccggtcagcagaaatgcgccctgccagccaaacgagatatgcgcgacataaataatgggcggtgccagcatcgcgccaatggagaaccccacgccagcccagcctgctgctaccggtcgttcctttttcggaaaccattccccaatggctttggcattcgcaggcgtggctgcggcctcggatgcccccatcacaaagcgcagtagcgccagatgcagccagcttccggctccggcgtgcagcagacaggtaatggaccagataacggcgcagattaaaaagcccatcttcaggccgataatatcgattaaccaaccgcaaagaggctgaaacagcgtataggccagctgaaaggcggctaccacccaggaatattgttccgtagtcatattcagggtgtttttcagttcgggggccaaaatgcccagggagttacgggtgatgtagttcaccgtcacgcccagcaggaacatacccagcatccaccagcgcagatttttaataacccgcaccgtgcgcgatgcgctggtgcgggtggtcgagtcgagactcatgatgaaactcctgtagccagtaataaccgcgttgccgcgaagcaaacctttttgtctgatccgaccttaaaaaagcgcaaaacgtgggtacagcccattttttgcaactcttttcatgacactatctggaaataacaaaaaacccctctcagaccagtagggacacgattcagcacgttatgaaaattttttcatttgcagatttgagggcgatcacagaatgaaacaaagcttaaaagtgagcgagattgccgccctgagcggcgtgtcagtcagcacggtttctcgcgtcctggccgggaaagccaatatccgcaccgccacgcgcgataaagtcctgcgcattgcccaacagcaaggcgtactggacaaccttcatcatgggcggctgctgcttaatgatctgatggtgtttgcaccaccgcgcgcgtttgatatccgcacggatatcttttattacaaggtgatccagggcatcagcgaggccgtcaaaccgcacgatgtccggctgcgctactgtccgctggaagaggtggaaagcgatgccgccctgtttatcgacaagatgcagcagacggaggcggcgctgttaatcggtatcgacgacgagcacatccatcagttggcagccgaaatgaataagccctgcgtgctgatcaatgcccgcgatcgccgaatgcggctgccctcggtatcgcccgatcatcagctcattggcgagttttcggcgcgctatttgtttgaacagggtcaccggcaaattctgtcgctgcactgtttgcgacgttacaccatggagcagcggctgcagggagtgcgcgatgcctggcatgccatgaatctgcgcttcgacagccgccagcacctgattacgctcaacagctttagcagcagcgaagccagcgcctgtctgggtgaatatctgcgtcattgtcctcaggcacagcggcccacggcgattctggcaagtggggattatattgcggcgggaaccgtgcaggcattacaacaggccggcctgcgggtgccgcaggatgtgtccgtcatgagcatggatggttttaatctggcgaccgtacaggagattccgttaacctcggtgcaggtgccgcgggatgagctgggagaagccgcggtcaaagtccttcaggccctgcgtttagacccggacctgccacccggcaatctgctgctgaacggcaagctggtggtacgcgactctgtccgccgcatccgggataatccgggccatgcctcggtgcagcaacacgggctttacagctgaggaggcatcgcgcgctcaggcaaagctttcccagcgggatgacagcgtgaaatgacgctgccagttcagcgtcgcgggcgttcgggcgattaactgctgacacaacgccggctcgacaaaagcggggatcacctgttccgccccgctgtgttggatcagcgccagttgatcgtccagtggtgggtgaacattccagggtagccactgcgccaacccgttttgcagcatctcgaaggcccgcgtgccgcgcgccacatggctactaaaaatcagattgaattcgggtcgctggctcagcgtggcagccaggccactgtctgccaccgcatcggctgcgacaataatgctgtcaggccgccattgcgttggcgtcggctcgcgcagtagcggcagtaacgccagcgcggtagcggcaggtaatgtattttgcgccagcagctgtgacacttcctcacgtacctgcgggcaaagcacgacaggtaaaccctggctacgcagccgtaatgccatctccggacctctgccatgcaacggcgccgtgaccaccgcgccttttcgggctgcctgcaccagggcatcaacctgctgatccagacgctgattgcggtcgccgtaggatgcatcggtaatcagccagcgcgcccgtggcggccggtcaaaaggcagcagcagcgactcacagctccagtctcccatataggtaatcccgcccgcgaccgccaggtgcaaccagacggagccgggcgagtggccgctccggccggtaaacaggttaagcggccccatcgcgcactgcccgtgcaacggcagagaatgccgccagcgggcgggcaccgggcaagcagccaactgctgccaggtcagctccgtagcataaaccggcggcgatcccagttgttgccagctgtcgagcgcaccggcatggtcgccgtgggagtgggtaaggcaaatcgcatcaacctggcctgtcttagtcagatccggctttacgcccggttcaggccccgcgcccaggtcccacaacaggcgatatccctgaatctcaagcaggaaagcggcgggcaatttaccgcccacgccgctcaccaccgtcaggcttgccatggcaatactccctgcggcaggcggcgcgtcagacgcgttgccagcagcattaaggtcagaacaaccagaatcatcaggcatcccacggcggcagccagcggggcggaaccgccttcatcgagaaagatgatggtaggccccagggtttgtgtgtcagacgtcaccagcagcaccgatacctgaatttcatttagcgcggtcagaaacaccaacaggcttcccgccagcgccgacggtgccgccagcggcagtaaaatatcgcgcatacgacgcataaaaccagccccgcacagacgggcggcttcgtccagcgacggctcaatttgtgcgaagcctgccagcgtgggccgcaagactaaagccagaaagttggacagataggcagcaagaatgatccagaccgtgccgtaaatcgacacctccagcagcggaagcggcggcagaaagaacagtatggccgccacgcctgtcacaatgccgggcagcgcgtacgtcagttcactggcaaaccacaggccgcgaaccagccgggtgcgctgccagctcaggaaaaaagccagaaacaacgccatggtggtcaggatcagcgtcgccagggaggtcagccacaggctggtcgcgaaagcatgacggattgcaggatagccccacagcgcctggtaaatgttctccagcgtcagggtttgccacgttaaagcctgaccaaaaccccgcgtcagcgccgtggtcagcagcgcgctgacgggcatgatgagcgtggcggccatccacagccaggccatgatttccgtgggcaggcgagcgccttttagcggttgatggaacgggcgcggcgagccactgacccggacatcctgtcgaccgcccagccaggcgcttagcatcatgccggtcagcgtgatcagcgcaatcagcaaggaatagacggcggtatccggcaacgcgctggggccgatggcgttgagctgttgatagaccagggtaattaaggtcggtaaacgcgccggaatgcccaacatcgcctgaataccaaaattaccgacggccgccacaaatgccagcgccgccccggcaaaaatggcggggcgcgccagcggcagaatgatggtgcgcaggatttgcccgtgcgatgcaccgctgatctgcgccgcctccaccagttcggcgggtaaacgccgaagaccggctcgcaccgtcagaaacaccagcggcgcattgtgcaaacccagcagcaacacgattccgccccatgaacagagcggctgctcacccggcgcaaaccagggtaaatccagccgctgaaacagcgatgccagcaggctacccggtgccagtgcctggagccaggcgagcgccgtcacctgcggcggaatcattaacggtaagataaacgcaaagacccaggccgctttggcgcgcatatcgctcagcgcgaccagccaggcggcaaatgtgccgagcagcagcgacagcagggtggcgctcagcccgacgcttaacgtatttagcgtggcgctgagcacccgacggctgaccagcaactgcgtcagccgggccagatccggcacgccctgcggcgccaccgctgtccagatcagccgcccaaagggcgcgacggagagcagtccgatcgtcagcaccagcagccccagcacccacggctcggcgcgaaaacgccagcgtgcgggctgcaaacggcggggccgacagtcgttactcagcacgctcatgctcagccaccaaacagcgcggtaaactgctcccgcacctgcgcatcgtccgcaaccgccttctcaacgtccggcgtcaggagtttgatctggtcgacagggacaaatccttcaggcgcggcaacgcggtcatcgaccggccggttaccctgctgcaccaccagtttctgcccctgttcggagagtaaaaagtccacaaaggctttggcggcaggcaggttatgtaccgatttcataatggcaaccggttcggtgacgtaagaaaccccttcttcgggataaaccaggtcgatgggcgaaccctgttttttggcccggatgatgtcagcatcggtaatcacgccatatttatccatcccgctggccacggcttttaaagccggtccgttgccgccctgcggtgcaatacccagcgccgccaactgcttatagaagttccagccgatgtccggcgtcgtaatatcggtgtgcagtttatacagggccgccccggagtaaagcgggctgggtacggctatttgccctttgttatcagcattgagcaacgctttccagctgttgaccggtttggcacgttgcgtgttataggcaatcacggtggcgatgatcttggtaccaaaaaaggttttatcacggtcataaaacgcaggcttcaggtgatccacgggcgcatcctgatacgcatacagctgcttctctttcttcagcgcgccgaggttgatggcatccgccaccagcagcacgtcaggcttgaccttgccgctcatcatttccgtgtgcaggacattcattaactgcgtggtgccgttgcgcgtccattccacctgaatcgcgggataagcggctttgaacgcatccatggtttgctgcgcaatttcctgtgcctgcgaggtgtacaccaccagcttgccgctgggcttgtcagccgcctgcgccagcgttgaacctgtcagcacagccgtgaacagtagcgaggtaagaatgacctttttcatattgtctgaagtcctttatgcgggaagaatccagccgtcattaacagcaatacttacggtgtcgttcaccgcaagcgcagaaacatcatcaagggccagggtgaaagagacatccggctgcgccagcgggcacaggtgaatgtcgtaatgaccgccacggtagataatgcgttcaacctgcgcgttaaactgaccgcgattaacaggcgtcaggcggaagctggcacgatgaaagctggctttaccgtggggtaacgttgcctgctgcgctgagcagcgcagcagcagtcgtgcgccgaacagcatgaccgatgcctgcccctgtcccaccggttcaatatcctgtaccggcagaacccgtccctcatcaatgaaggtggcgaccatctcgttggcgggctcgcgccacagcgtttggggcgaagcaaactgcatgacctgccccgcattcagcaccacaacgcgatcggccagcgccatcgcttcgcgctgatcgtgggtgatgtagaccagcgttgccccgctgtgacgatgaaagcggcgaaactcctcttccatcgcgctacgcaaatgcacgtcaaggttagccagaggttcatcaagcaggaccagcccgggctttgccaccaggcagcgggccagcgccacgcgctgacgttggccgccggacagatcggctggccgacgctcggcaaagggcagcagatcgaccagcgtcagggcttgccggatacgatctgcccgctctgtacggttcacgccgttgactttcaggctgtagcccacgttttcggctaccgtcatgtgcggccagagcgcgtagttttgaaataccacgccaagatcgcgactttcggggggaagatgaaaaccctgagtggcaaacaaggtgtcgcctacccagatctcaccgcgatccagagtttcgaatccggctatcaagcggagtaaggttgtcttgccgcagccggagggacccagcacggcgataaattcaccctgctggatctccagcgataccgcgttaaggaccggctgcgccgcgaaggctttatgcagcccggagagtgaaattgcggccatgattacgtcgcctgtgccataaacgttctatgcaaaacgttacgacacattgatgacaacaccgtgacagcaggctacttcggcagatggaccgccacgtagcgctcatagcgcgacggcttaattttggtgagatccgccagaaccagcccgtcaatacagttgttgaagtcggggtcgctgccaaaatcaataaactgcacgccgccgggttcgtacacttcgcaatactgtttgtaaagcgtcgggatcgccacgccgaggttgctgagcaactgcttcagccgctggagatcctctttgtaatcattgccgctgaactgggccagcacgtcaggcagcgaggccggataaggacagcgcgacgtggccagggggaagtccgtcggaaaatagatgcggtagaacgccaccagcaaatcacgtgccgccagcggcatagtgccagagatagagaccggtccgaacagatagcgcacctcagggtatctggcgacgtaggctccgatgcccagccagagataatccagcccgcgtttgccccagtaagcaggctggataaagctgcgtcccagttcgatgccctgacgcaggatagggatcatgcgttcgtcgtaatgaaacaggctgtggctgtagagtccttccatgccgcggcgttccaactgttcgccaccgggaataaaccgataggcaccgacgatttccagctctgcatcgtcccacaggatcaggtgatagtagtcatcatcgtagctgtctaaatcacgtcggcggccgctgccctcgcccacggcacgaaaggcaatctcccgcagtcggcccagctcacgcagtatcggcaccgaggtggccccgttacgtcgccacagatagatctgcttgccatccggggtattccccaacagttcgctttgcagcagcgcttttttcaggtcggcacgatcttccgccagcgcaatggcggattcagtctgaaaaaggcccttttttccctgccccagacgatagacatgtttacgcacgcgctttgccagctctttgcctggcgtgtggccgtcgtgccagtgcgcaaacggaatctgcgcaccgatacgcagtttgatacgcattccgcgctgtttaaacatttcccgcaccagcattaacattgccacaggcggtgcgactttggcggtagcatagaacagccagctgtttcggccctcaacgtgtaccggcaccagcggtgcccgcgctttcgccgcaagacgcaggaagctgtgatgccattcacggtcacgcacgcccgcactgctaagacgggacacttcacccgccgggaagataatcagcacgccctgattgctaagatgctgctgcatgctctgcaactgctggcggctggtacgattcccaatattgtcgacgggcaacatcaggctgttgagcggttccagcagcataatcaaccggttcgccacaattttcacgtcggggcgcacctgtgatatcgcatgcagtaacgccatgccgtcaatggttcccagtggatggttggccacgatgaccactggcccacgcggggggatctgctccagatcgcgttcgctaagctcgcaacgtacatcgaggtgctccagcacctgctcgaccatatccaggcctttcaggtgaggatagcgcgcggcaaatcgctggaattcatcttcacgtaagatccacttcagaatccgtttctgccagttggcgggatgctggttgggccagaaacgctcaataacctgatcgactgaaaacatagttaacctttcgtgcctgtcccggagatacagcgaaagtaagtcgcattgtttgcacttttatgaataacgagtggtcgagagacaaatatgttggcgcagtcagcgacacatgggtgccgcatcaggtttttagccacaaaaacagagggataaggcaggatatttcaccggggcgatacggtgtcgggacatgaaaaatcttaatactgctggcgataacggcattcgtacccgttcgccaccgcttgacaagaaaaggcggaaccggtttccgctgcctgtttgtcggcagcggcactgtcattaatcctgagcagccggtcccgtttcgcgttactggttgtgcatcatggtcgcaaccgggagccagatctcggtcatcgcgcccgctttaccggtgaacgggtcccgtttcggcagcgctactgttttcactttttcctgggacagcttcaaatgggcaatttcatcgcgcaggatttcaggcttcaggccttccggataggcacccaccgccaggaaatcttcgctggctgacacctgtcgatgtccgacaccggccgggatcagcacggcatcgcctgcccgcagagtaatcatacgaccactgtcgccaccaaacagcacttccgcccagccttcagccacgccgaggagctcatgcgtgttgggatggtaatgcatgtaagggaacagctgatcgcgccagtcgggtggccagccatttttttcaaacgtctgctcgaaccaggcggcaatatactcttcatcctctggcaccacgcgcggccagataatgagcggtaacggattattcggcacgccgccagacggactggcgaacatcaaatgctgagggttatctgatgccccggctgaaaatgttcctgctgcgaaagacatcagcaacatcagactggaggtttgggcagtcatacaatgtctccttttttctttagtgtgacaaaggtcgcagggtttgtaatgtgcgctatgcatcacaatttacacaaccaccctaactcgctaaccaaagccaaattagttgttaacaatttcaccctaagtaagtaagtctcttttacgtggtaggattaatctgtaaaagagacaacgcccgtggttgcacgctgaaccggcagtcgctgcgcagccgtcaaagtgaagattaaggctaataaccccagaaaatgacgggccgatgacaaggcatcaatctgtttcgcggcgacaaaaaaacccgccagggctggcgggtcgatgcgcggtgatggcctgtggctgacgccattttcaggctcgcctgactcagtaaacaatgccgggtggattgacggtggaatgggcgaccgcttcatcctcttcgccccaacgctggagaacctgctgatactgcccgccggcaatggtgccatccagcgcggtttgcagcgccgccgccaggccgttgccctttttggtggtcaccgccacccaggcgcggaacggcccctcgccgactattttcgtttgcccgcgcgacgccactttccatgccgccgtagaatgcggcccaaacagcgcatcggcccgcccggagagcagagagagcgtcgccgaggcatcatccgtcaggtagatgggttggacaggcggcaaccctttggcccggttctgcgcgtcccaactgagtaaaatgcgctcctgattggtgcctgatgccacgatgatgcgcttgcccgccacgtctgccggtgagttgatcgtgctgacaggactgtccgctttgacgacaaaggcgtggttatcggcacgataggtggcaaaatcaaacttctttttccgctcttcggtgaccgcaatgttaaacatggccacgtcgtagcgtccggcgcgaatccccagcggccagtcctcccaggacgcgggcaccagcttaagtttcagccccagactgtccgccagcaggcgggcaatgtcaggatcgctgccaatgcgggtcaggttatccgacgccagcagcgccagcgggggcgaattagtggcagaggtcgccacggttaaggtgcccggctcaacaaaatgaaaatccgccgggattttttttaccgcgtcgggattcaccggcgcatgaatcggctgttcattgttggcggcatcccgtttttccccggcaaacaccacgccgctcaccagcatcgccaacagcgtcagatacgcatatttcatctcggcctcttataatacgcgagccagaaagcggcgcgttctctcatgacgtggatggtttaacacttgcgtactgctgccctgctccacaattttaccgtccaccatgaacaccacgttgtcggccacctcacgggcaaagcccacttcatgcgtgacgatcaccagcgtcgtacctgaccgggcgagctttttaatcacgtccagcacctcccccaccagttcggggtccagcgctgacgtcggctcatcgaacagcatgacgcgcggttgcagcatcaaggcccgggcaatcgctatgcgctgctgctgaccgccagacagatgacgaggccaggcatcggctttatggcgcaggcccacaatatccaggagctcgcccgcccgggttatcgcctcgcgctttgagagctggcgatgggcgatgggcgcttcgattaaattttccagcaccgtgagatggggaaacaggttgaagttctgaaagacatagccaacattgatgcgctgacgcagaatcgcccgctccttcagttcatacaaccggtcaccccggcgctgatagccaatgtactccccgtcaatctgaataaatccttcgtctacccgctccagatggttaatggtccgcagcagggtcgattttcctgacccggaggggccaagaattaccgtgacggaacccggctccagcgccagggagacatcgtccagcgccttgagcttgccgaaacgtttgctgacgccggtcatgctaatggccccctgcgcaggggataaacggtaatcaatggcttcggacatggctgatctcctcaacaggattaagcggtgcgacgcgcgtgcgccattgtcgccagcgcgacggttgcggttcacggctgacgctgcgagccagccagcgttcaacgctgtgctgaatcactgacagaacggtggtgataatcagataccaggctgcgccgaccatcagtaaggggatcacttcctgattgcggttgtagatcatctgaatggtgtaaaacagctccggcatcgccagcacatagaccatcgccgtgcccttcgcgagactgataatttcgttaaaggcggtcggaataatggcgcgtaaggcctggggcaaaatgatgcgaaaagtacgccgcgaggccgacagccccagggcagaggccgcctccacctgaccgtgatcgacgcctaaaaagccgccgcgaatgatctcggcactgtacgccgcctgaaccagcgtcagaccaatcaccgctgcgggaaactgccccagcacgttaatcgtctgaaagtggccccatgacaggtgggtaaaaggcaccccaacggacaacgtgtcgtagagataggagaagttgtagagaatgatcagcacgacaatcaacggcagcgatcgaaacagccagatgtatccccatgccagactgcttaacagccaggaagaggagagccgcgccagcgccagcaaaccgcctaacagcaggctgaacaccgtgcccagcagggtcaaaagcagtgtctgccccaggccatgcaaaatcaccgggtcgaagaaccagcgggcaaacacgccccattcccagcggggattaaacgccaccgactgtacaacgcctgccagaataaacagcgccaccacggcacccagcgttcgggctggatagcgggcgggcaccacctgtaactgttgatgatgactcatgagcgatccttagcttgcctgcgcaacgctgtgcacatcgataattttgataaaacgcaggcgaccatcgtggggcggctgaccaaaacgttccagatcgccattcaggtcgaactgcggctgataaccgtggccgatatacaggcgcacggcctcgggctggcgaaagccggtggtcaaaaacagacgctgataacccgcccgttttgctcgccgctccagctctttcagcaccaccagcgctaatccctggcggcgcagatcgccacgcgtccagatccgtttcagttcggcggtttgtgcgtcataaggtttgtacgcgcccatggcaataatctcgtcgtcacgctccagcacaataaataagccgtgcgggggcagataccattcggccagctcctgttcctggtggcggctaaaataatcgccatagcgggccgcatactcaccgaacaaacccgtcaggatcggcaccagttcaggcgcatccggtgacagctcgcgaaattgcagttcactcatggtgcgctcctcagtcacccaaacccggtggattaatctcggaatgatcgatgcgttcaacgccttctccccagcgatccagcaccttctggtagtcaccattttgcatgacgccattcagggccgtgctgatgggttccgctaatccgctgccttttttgaccgtgacagcaatgtgcgcggcgttaggccagccgccatccacactgccgaccaggcgggttttaccattcagtgacgccttccaggcgccaatcacgtttggaccaaaataggcatccgcacgtcctgcctgcagcgccagcgtttgggcggcgtcatctttggtataaatcggcgtaaacggcttacggcctttggcctgattttctttatcccaggccagtaaaatggcctcctggttggtcccggaaccgacaatgatgcgcagcccggcgatatcttcggctttggtcagcgactgaatggggctgctggttttcacataaaaccccagagaatcttttcggtaggtggcgaaatcgaacttctctttgcgcgccttcgtcacggtgatgttggtgatggcggcatcatatttccccgatgccacaccaagcggccagtcttcccaggaagccggcacgacgttaagtttcagccccaggctgtccgccaccagccgggcaatatcgacttcgctgcccaacaacgttttgttgtcatcagagaaaacggtcagcggcggtgagttcagggccgccaccgccacggtaaacgcgcccggtacggcgaagcgatagtgggcaggcagttgcgccacggcttgcgcatttttaacggtgtggatgggggttttattggcctcaagactgacgcgctgaccattcacggcaacacgggttccttccgcaaggctgctaccgctggcggtcagcatcagcaaggcgataagcatatttttctgcatagcaaaggctcttattgtgatgtgaattgattaaccggctgcgacagggcaaagctgtcacgcagcgtggagcccggatagtgacggcgcgctaaaccgcgcgcctgcaacacaggcaccacctggtcaacaaaacgttcaaaagtgtctggcgtaccgccattgataatgaaaccgtctgcggcctcgctctcaaaccacagttgcagaccgtcggcgacctgctcgggcgtgccatgaaacagcggacgcggcgttgccgcttccagtgccgcctggcgcagtgaatgaccttgctcacgcgctttgtgtttaatctcgtcggtggtactgcggaaactgttctggccgatgtcgccaatatcggggaaaggcgcatcgagcgggtactgggaaaagtcgtgatggtcgaagaagcggccaagatagttgagcgcatcatgaatggaaaccagcgcggcggtggtttgatattgctgctccacgtcctcagcatcgttgccaacgatgacgctcacgccctggaaaatatgcagatcctgcggctgacggccatttttcgcctgtagcgctttgacgtcacgataaaatgcctgggcttcctcgcgcgtcggctgatgcgtaaagatggcatcggcatgacgggctgccagctttttaccgtcgtcagaggcgcccgcctgaaaaatgatcggtcggccctgtggcgtgcgtgaaatattgagcggtccctgtacctggaagaagtcgccgtgatggttaagggtgtgcagcttagcggggtcaaaaaactggccgctgtctttattgcggacaaacgcgtcctgttcccaggaatcccataatcctttcaccacctcaaggtactcatccgcaatgcgataacgcagtgcatgttccggatgctgctgccgtgagaaattcttggccgatccttccagcggtgaggtcactacgttccagccggcacgtcctccgctcaggtgatccagactggcaaactgtcgtgccacggtgaagggttcgctgtaggaggtcgagaccgtgcccaccagccctaaatgttcggtgacaccggccagcgccgacagcagcgttaagggttcaaaccggttcagaaagtgggggatcgatttttcattaataaataagccgtcggcgacaaacagaaaatccagtttgccctcctcggctttccgcgcgatttttttcgcgtagtcaaagctgatgctggcgtccgcctgggcggccgggtggcgccaggccgacatatttccggacgcgccatgcaaaatggtacccagtcgaagctgtcttgtggtcatgatgtgctctcttttatgcgtcaggatgccaggcggttgtccgggacagccgctcaggcaagtcagaaagttgaacttaattcagggcgggttcacgacatcggtcgtgaagatggtgcaacgcctgccgggcgagctgtgcaaagtagtgggcggcgggcgctatcgaggattcgtcgggcgtaaaaccggcatgatgcaggccaaagtcgctggcgctgccaatgctgacaaacgcgcccggtacctgctgcaggtagaaggcaaaatcctcgccccccagatgtaaatcggcagtctgtacccgatagcccacctggcgagccacctcactgctgaactgcgcccagcgcgcgtcattgatcagcacgggcggcccggcgtgccagctcaggctggcctgcgcgccattggcctgcgcgatgttctccaccagcgtgcgtacgcgtttttccagttcggcgcgcaggtgcagatcgtgagtgcgggcggtgccgccaaactccaccgttcccggcagcacattccaggttttaccgccgtcaatgcgggtgatactgagcaccaggctgtcgagcgtgttaaagctgcgactggtcagcgtctgaagagcctgaataatctggctggcgaccacgatggcatccacgccctgctctggatgcgccgcgtgcgcgcccttacctgtcacgtggataacaaacttgtcggcgttggcataaaacgccccgtcacgcgtggcaaaggtcccgctcggcaggccgggttcgttatgcataccaaaaatagcctgtacctgatccagtacgccggcctggataaactgtctggcaccgcgtgcaatctcttcggcgggctgaaataagatgcgtacccgaccgcgcagttgctgctgctgtgcctgcagttcaagggccgcgcccagcatcacggcactgtgcagatcgtgaccacaggcgtgcatcacacctggctggcgagagtggaaactgacgccgctggcctcatggatcggcagcgcatcaatatcggcacgcaacgcaatcaggttttcaccgttgccgatttccgcgaccacgccggtttcaagcgggtagtcgagcaagcggataccggcgttctggagccactggcgcaaccgtgcggtggtggcaaactcctggccagagagttcgggccaggtatgcagctcgcgtcgccacgcaattaactgtgcttcgttcagactcatggtgtacctcggctaacacatcatgctcaggcggcgacccactgatgggttgccagtaactccagcgaccggtaacgcgcgcgggcatcggcaatcggcgtgtcgataacaaactcatcaatgccgaagttatgctgtagcgcgtcgagctgggcatgaacctgggacgcggtgcctttcagcagggatggcgtgcgcggctcaatcagataatcggtaaagccgccctgacgaacatagcgttccgcctgttccaggctggcaacgttgacgcccgggccgcctttcacctgcacgtggaaatgtttgagatcggcaaccagcaaatcggcctgcgctggcgaatcagccaccacgacctgcactgctaccagcgcccgtttaccctgtgcctgccgtgaataggcctgcagggatcgctcaagacgctggcgatcgccattgatgtgcgcggcaaaaacaaactgccagcccaactgcgccgccagttgggcgctctgctcgctcccccccaacagaaaccgctgcgccggacgcgcgggcaagggcgtggcccgtagcctttcgtcgtcgtgccgttccacatcaggttgcagccagctgtccagttgctgaagctgctcggcaaaactgcccttttcatcctgatgcaccccaagctgtagcgcccgggttgaaagcggcaggccgccaggcgctttaccgatgcccagatcgatccgccccggtgccagcgacgccagcaaattaaaattttccgccactttataggggctgtagtgctgtaacatcaccccgccagagccaatacgaatgtgctgggtttgcgccacaagccaggcgattaaaacttcaggtgacgggctcgccagctgttcaatattgtgatgttccgccagccaaaaacggtgatagccccatttctcagcctgtttcgccagctgcaacgtgcgctgaagcgccgccgccggtgtttcaccttctgccacgggcgatttatctaacagacttaattgatatgccattcacctgtcctcactcatttccgttaaggctcagtgtggcgatgcgggtatatttcgtaaaacaataaatatgacaatatgaagttaaaaagtggcaatagaattaaatgaataaacgcattccgcgatggcattatttattgccttcctaccaaccccgccagaatcgatattaattccgcgtttaaccatgctgtatttgctaattttcgctaagctttgattaattccttactttatcgactcacggtattgcccgatgatgatccatcgggtcaaacaggtgagagagagggataaagtatgttaaaagtcagtaccttattacaaatgctgttcccacataacagcgagacagcttgccagcatagccccgttaaaaagccccgtgcaggtgcttgctctgggtctgacagagaattatccacccgcgattattcaggcagagagaatgaaaatcatcattatgatgcgtactcgacgtcggtatcggtgttatcaacccaggatcatgccctgacgcaattgcccgattacccctggcaacccaataacctgtaacggctaagcaggaatatctaagattgcgttggactgtttgaacaaggagactcatgacttcatttttactggaacgactggtgcagtggcgtcgtgaactgcaccaacatcctgaacgctcaaatcaggagtttgccaccacggaacgtattacgcgctggttgcagcagggcgatattcgtttgctgcccttgccattgacgaccggcgtggtcgcggaaattggccagggcgaaccccttattgccctgcgcgccgatattgatgctctgcctgtcgacgaggccgtgcattctgcctggatgtcccaacaacccggcgtgatgcacgcctgcggacacgatattcatacgtcggtgatgctcggcgttgcccatcagcttaagcaacgtgaagccacgcttccgggccgggtacgtattctttttcagcccgcagaagagacgtttgaaggtgcccgacagctgcttgccgcaggtgcgctggacggcgtgcaggccatatttggtatgcacaacgcgccggatctgccactgggtacgctgcgaacccggcctggcgcgttttacgccaatgtcgaccgctttattattcgggtgcacggcaaaggcgcacatgccgcccggccccaggaaggtattgatgccattgtgattgccagccacatcgtgacggcattacagacgttacctgcgcgggtgtttagcgccctggaaacggtcgtgctgagcgtcacccgtttcacggcgggtaatacctggaacgtgcttccgcaggaggtggaactggaaggcacggtccgcacccaccatgctgcgctgcgtcagcaaatccctgaacgtatgacggcgctgattcagggaatcgcatcgggctttggcgctcgcgccgggctggaatggatagcggggccacctgccctgataaacacgccagaatggacagaaatggccctggatcaggccgtccaaagtggttatcgcgctgaacaggccgttacgccgctaatgggcggtgaagattttgccttttatctgcaacaggtgccgggggcctttgtgaatattggcagtgccagcgaatatggcctgcatcatccggcgtttaatcccgatgaagccatgctggggcccgctgtcgactattttacacagttggcaccgcgcgccctggcgcaggtggcggcgcagtcggtcagcaaacgcgaaactgttatataaaaaatggcctaatctgtgtctgaacgccttgactgttatctgttctaatagctatcagttgaaagtgaggggaacgatggacgccattaaacagatcttgatcgacgaaattaatacgctcaaccgtgaagaacgccgggataacctgccgcgcttcagcttctcttttttgaaaaaacatcccggactgtgggcagtgatgtacctgtgctacggcctgtgcgtggcactgattttttccactgagatgctgggctggccagccttctggttcgcgaccgcctttgtactggtgatgagctttctgatgttgctggatatcaatcccaaataccgttttgaagatatcgatgcgctggatctgcgggtttgctacaacggcgaatggtattacgtgcagccgctgcctgaacaggcggtatcgcgcattatgtctttgccggatgcgccagagcgcgtcaaaacagggattgaccgtttgctgaagcagaaaggggaagtggacttttacgacgtttattacctgacctgggggcaccgccaggctgcgcaggtttaaccgcgcgccatgtcggccatgatctcacccagggtgacgaccgccgcctcggctcgcgaatcccagggccaggcggtgttaagccggaaacagtggctgaactgttcaccggcggcaaacaactgccccggtgcaatactgataccttttgccagcgcgcgctggtaaagctgggtggtattaatactgtccggtagcgtcacccacaaaaagtagcccccggcggcgtcgctcaccgtggacggtgcgggcagcaccttcatcagtgcctgacgcgccagttgctggcgctttgccagactttgccgaagccgtttcagatgattatcgtagcggcgggtcgccagaaaatccgccagtgccaactgcatcggtgcactggtcgaaagcgtactcatcaactgcaggcgttgaatacgttgagcatgctggcccgcagcgacccatcccacacgaaaccccgccaccagcgattttgaaaaagaaccgcagtgcagcacattgccatggctgtcccaggcttttgccggcaggggcggcgcgccctcacccgacagctcagcgtacacatcatcttcgatcagcggcacccgatgacgggcaagcaattccaccagctgctgtttacgctcgggggtcagcgtggcacctgagggattttgcagggtcgtcattagccaacaggctttaacaggccagcgctgaagcgcgtcctcaagctgctgtaaatcaatgccgttctgcgtgtcgacgggaatagccagcgccttgagcttaagccgttcaatcgcctgcagtgcgccatagaaactgggctgttcaatcaccacgtagtcgccgggttcggtaagggattgcagactgagattcagcgcttccagcgccccgctggtaatcacgatttcatcgggagataacgtgatgccctgacgggcgtaacgctgcgccagcagctggcgcagcgtggcgttgccggggggcagattatgcaatgcatcggtcggcgtcagctggtgtgagacgttcgccagcgaacgcatcagctgacgctggggaaacaaagccgggtcggggaacgccgaaccaaacggcacaatggccggatcgcgcgtggcctgcaaaacgtcgaacacaaagtcattaatatccacccgctcgctgatagccacgctgagcggtgcggctgccagcgcccgtggcgcgacgtaataaccggactgcgggcgcgacacaatccatccctgactttccagcaattcataagcatgcagcacggtcatcaggctcagcccctgccgggcgacctgctggcgcagcgaaggcaaacgggtgcccggcggccagataccggcttcgatttgctgctgaatgtcatccattaactgctgatatttcgccacggcatgtcgctcctgatgctgaggcgtcactttatcatgttgatcacctgtaacaaaaaaagccgtggcggttaacgccttagcactccagcgctgcgggtttgtctgcttcagtgccaacaaactcgttaagctcttcgatacgttccggtggaagggggcgacccaacagatatccctgtagcgtgttgcagccaagttgggtcagaaaggcctgctgctcgggcgtttcgacgccttcagccacgacttttaactgtaaagactgcgccagcgccacaatcgccgagacgatggtcgcatcttccgactggtgctgaagctcgttcacgaaggcccgatcgatcttcagctcactggctggcaggcgtttgagatacaacaaactggaatagccggttccaaaatcgtcaatcgaggctttgacgccgagctccgtcagttcggtcagaatacggacgctttcatcgggattacgcattgccgtcgtttccgtcacctccagcgttaactgcgtggcgggaatatggtgcagcgccagcgccgctttaaccgtttcgaccaggttgctctgctcaaactgcagcgcagacaggttcaccgccacggaccatgccagatggccctgcaggtgccactgatgcaattgacggcaggcttcgttaatcacccagttaccgatattcactatcatgccggttttttccgccatcggcagaaagcagtccggcgtcagcaagccgtgtttcggatgctgccagcgcagcagggcttcaaagcccataatcgggccgtgcggtgcacagtatttgggttggtaaaacagccgcagctcgttgttatccagcgcatgccacagatcgttattcagctgtaactgactttgcgccagcagattcatggagggctggaaaaaggtatagccgttgcggccgttatttttggtgtggtacatcgcggcatccgcattgaacatcagctcgcgctcatcctcgccgtcaccgggatataccacaatgccgatgctcaaggagaccactaactcgtaacgggaaatagagaacgggcgaaccaccgcttttaccagttgatcggcgaccgccgccgcatcatttggctcggtgatttcaatcagcaggacaaattcatcgccacccagacgcgccagcgtgtagtagcctttcatctgttcactcattctttccgtgacgctgaccaacaaactgtcgccaatgtggtgaccaaaggcatcgttgaccgctttaaacccatcgagatccataaacatcagagcaaactggctgctctcacgattggctttattcatcgcctgttcaaggcggtcttccagcaggatgcggtttggcagtcgggtcagattatcgtggagcgccagctgggccagttcacgattggcctcagccagtgaactggccaggatagaggtacgtgcctgcatgcgcgcatccagcatggaaaccagcagggtgataccgagtatggcgatggtcactacggtgaccacaatggctaaccagttgctgttaacgcccgaagacatggtatggctgcctgcagggaatgaagccgccatcatgccggtgtagtgcataccggcaatggcggcgcccatcaccaccgatgcacacagccgcagtgtcgcgacgcgtccctgatgcccttcacgcagcttaaacgccagccacagggcagcaacggaggcggccagcgcaatgatcaccgaaatcagcacccagccccagttccagatgatacgggtcgagagcaccagggcggccatgccggtgtaatgcatagcgacaatgccgctgccgaggacaacagcaccgccggctaagcgcggcagaggcaggtccccctgacagaccagccacagggcgaaaatggatgcacacaccgcaataccggcagacagcgccgtcagggatgcgtcataactcatcatcatgtccaggtccatggaaagcatgccaataaagtgcatggcccaaataccaatgcccatggcaaagccaccgccaaacagccacacgagtgcgaccttaccggttgaagtggctacacgtcccgccatatccagcgcggtaaaggaagccagcatcgccactaataccgaaatgacgacgatgaatgcgttatatgaggccactagcatagtgtttatccgaacagcgccgagcgcgcagctgtgatgttgacgttgaaaaagatgttttgtcttatttaccggttatcggcgcgaaaaaagactaaattaggcttttttaatagaggttcccaatgcttccgagcgtccggaccaatcaaccttgtctgccgaacagggaaatctgtcgttgtccgcagggcgctatccaggcgattaccgctctcccggcatgaaacgacaggcacagaaacacagaaaaaattaaaaaagactgctattccaataaattataattaaacataccgccaactcgtctgctcgcccctgtccacatctgcttatcttagacgattattctgaaaccgtttctgatcggcgcaagaccatcccacctgattcgaaagggtcacggtgcgcaaaatatgcccctgtttttattttcatttgccaagaatgaacggccatgaagggtgtccgggggcacgaatgtaacaaattaataaaaaatttatcgtcgggtttcgctacaacggccaggctgatgtatagtaaaaaaaattaatataaatcgacttacctgttttctggattgtcggaaaaacaacggcaggatgctgacactctacggttaggttttcttttctctggtttttttgtattacgccatcaggtgaaaaagcacaagtcctgaataatcggtaaggaatgattatgaaattcaagctttttctgttagctgtcagtttcaccacggcgctgccgtccgtgacgtttgctgccaccaccacgggtgcaattaacgctacgctgacattaaccacaggttgtctggtgaacggccagtcagccaccacgggcgtaaactttggttcgttgaactttggtagcagtgccgccaccttcgatactctgaatgccaccctggtgggcgcggcaggaaacggtatctacgtccgttgtactaccgggcaaacgtttaacgtccaggtgaccagcagtaatgcggcaccgggaaccgtctacggcaccgtgtcatctgcaccgcgctatctggtgctgggcgcggataacacccagggcatcgcttataccctctacagcgacgcctcctttagcaccgccattgcgaataacaccaatattgcgccaagcggcacgaccgatcccacgcttggcaccaattacgcgatttacggacgcgtggtgggcggcggctttaaccctgtgattccggctggcacttacaccgataccattaacgttgccgtgaactactaagcgcccgtgtttgagtagcggcagatgacagcaacctggtcacctggttcgatcaccgctggcgggttactgttcctggtgagtgtgaatgggtggagcattacgaccagctccacgacatttcaggtttcagcgtcaatcgttgcaggttgtgtgatctccggaaccaatacggggatctttggcacgcttaattttggcacccagtccgggctggcaaacagcagtgtcagcgccagctatgtgcaaagttcaacgattaacctcgcctgtacacccggcaccaccctgagcatgaccatcaacggtggcagtaactacaccgcgacccgcaacctgaagctggcgaacaataccaacacgattccctattacctctttagcaatgcagcacgcaccatcccgattccggtgaatacggcagtgccgctgagctacagcaatgccaataacatcacgttaccgatttacggcgtgctgcagttacccggcccgacgcgcgccggggtttattccgacacgctcagcgtcacgctgacctggtgataaaaagtacaaaggagctttaccatgccatccctgcgcgccctgttttttctgttcacactcgtgttgttgccacaggcgcagggcgctaactctgtcatgatttggcccatcgacccggcgataaacccggaggagaaagccagcgaactgtggctggaaaaccgtggcagcagcacgacgcttatgcaggtgcgcatcttcgcctggcagcagaccaacagccaggagcagtatcaaactcagcagcaggtcgtcgccagcccgccactggtgcgcatcgaacccggtcagaagcagctcgtccgcctgattaaacagctaccgcctgccgcgggtaaagaggtggcctaccgcgtggtgctggatgaaatccctaccccgcgatcggtcagcgacaaccaggccgggctgaattttcagatgcgttattcggttccgctctttgtctatggctccggtctgagccgcgatgacgcgaagtcagcactcagctggcgtcaggtcaacgcgagcggccaacgctatctggaactgacgaatcgcggcaacggccatgcacgactcagtaatgtcaccgttggcggtcagcgacttggaaacggactttatggctatgtgctggccaacagcacgcagcgctttccgttaacgtcctccgtaagcggtgaactgagcgcagagaccaataacgggcagtggcgcagcgctgcggctcagtaagttgcaatgatgcagttttcgccgcatcccgtcgcgctggctatcgcgggactgtgttgtctgacgcccggttatctctgggctgaaacctttacgtcgctaccgccccctccgtcggtggataaccgccctaccggccagcgttacatgttagagctggtagtgaaccagcaggcgcggggcgatatcgtgccggtcgagcagcaaaacggccattttctggtgcgggcgggcgatctccagcgtgccggaatccctgccgaaaaatatcaggggcagcagcaggttgatgtcaatcaactggcggaggtgaaagtggattatgacgatcgccgtcagcgcttgctgctgaccgttccgcccggttggctgccagcccagacgttaggtgagagcaacaacgggccgcgctttcctggacgcgtcagtaacggtgccctgatcaattacgatctctacgtcacgcgcaccgacgtggcgggcacacggctggcggcctggaatgaactgcgtctgtttggtgaggcagggcatttctccagtaatggcgtctggcaacagcagttggaagggcaaaatcgctaccaggatgagggctatatccgctatgacacctggtggagcaatgagaatgaaaacgccatcctgagctggcgggttggcgacctcactaccgatgcgctggcatggaccagcagcgtccggcttggcggcatacaggttgcgcgcgatttcagcgtacgaccggatctggttacctatcccctgcctgccttttccggtcaggcggcggtgccctcgacggttgacctgtttgttaacggctatcgatccactcaggccaacgtccagcccggtccctggtcgctgaccaacgtgccctttgtgaatggcgcagggaacgccgtcattaccaccacggatgccgtcggtcgccaggtcgtcaccacgctgccgttttatgtttccagtaatctgctcaagcccggcctgtccgattacgccttttcagcgggcgcgatacgtcaaaattatggcatcaaaaatgccgattacggtgcggcagccctgagcggctcgtggcgctatggcatgacggactggctcacgctggaaacccacgcggaaggcagtaatgagctgggaatgggcggcgcgggcgcgcagttcaaagtgggcagttggggcgtgattaacggcgcagcggcgcagagtcgtctggagggtcagtcgggtgcgcagtacagctggggctatcagtacaacaacagccgtttcagcctgggcacccagcacaccgtccgcaacgccggctttggtaatctggccctgctgagcaaccagcgcaacagtgcctatgctgacaaccgttacagcctggcgcgacggaccgcgcagtacagcgccagcgtatcgctcaatcgttatggcagtctgggcgcagcctatatcgatatctccagcggcgataaccagcgtaccagcctgtggaacctgtcgtggagtaaaaatctgtggggcaatgccagcctgtacatttccgccagccgtgacaggcaacagggcgaatggagcggtgccgtctcgctggtgatcccgtttggtgaaaacagtaatgcctccctgagccttgagcgcgatcagcaaggccaaaataatcagcgggcctatttgtcccgcgccatgcccagcgatgggggagttgcctgggatgcatcctgggcgaatcagggcggcaacagcggcgattatcgtcagggcagcctgcgctaccgcaacaataagatcgatacctccgctggcttttatggggatgatgacaacacgacgcagtgggcagatttatccggctcgttggtgttgatggataatcaggtgtttgccgccaacaccattaacgatgcgtttgtggtggtcaaaactaattacccggacgtgaatgtccgctatgaaaatcagtcgatggggcgcaccgacagcaagggctacctgctggtgccgtcaatcagcagctactacgcggccaaatacgacattgatacgctcgatctgcctgccgatatgaccacgcccaaagtggagcagcgttttgccgtgaagcgtcagagtggatttttactggattttccggttgaacgtttacgcgccgccagcgtgattctgtttgatggcaataaccagccgctgccggtatccagccaggtgatccgtccgggacaggcaaccggctacgttggctgggacggcatcgcctggctggacgacctcagagagcacaaccctatcaaggtcatcgcccccgatggccgaacctgtgaaaccgatctgacactgcctggcggtcaaccgcaggcattaaaaacctacgggccgctgacctgccccctaccgccgctgcccaaaggtgcaccggtgcccaatcctgataacgctaccgccggaatgacgccatgaaaaacctgatgctactcctttgcctgctgttgttgccctcgctgggttatgcagcctgtgccctgcctgcctccagcgccagctttggcacagaaacgacctttgttgcaaataccagcgtcagttccacctccaccaacgctaacgtcaactgtggttcaggcacggccctgaccctgctgagtaataaccagattacctttcagttgaccagcgccagcaacaccaacggtacacgcggtacgctcaaacgaagcggcgataccggcagcgacaatattccggtacggctgtgtaccgacagcgcctgcgccaatgaactcacgattggcgggtcggcttttgtctacagctcggcgacgttgattaatctggcggggttactgggcagcctgaactttgcgattcccgtctatttacgcaccgtcgccgggcaaaccgtggcggcgggcagctatacgctgacgctgaacatggccgtcacctataacgtttgcaccagcctttccgccctgggcgcttgcctgaccccgcagaccggcaacggggtcattcccattaccgtgacggttgtcctgactaacgactgcaccgcgattaccgcaccgaatatcagctttgggagtgcaccgctggtcgccagttttggggcggtttcgcaaaccatcaatgtattatgcagtaaaggcagtacctacacggtgggcttaagcaatggcaacaacgcttccggcagcgtacgcaatatgacgagcggcacaaaccttctgagttacgaaatctacaaaggaaccagtagcgatcgttggggaccgagcgggacagaacgcgttggcagtgcggcggcgaataccgtcagcaccgatggactgacgcgcagctttaactacactgcgcgcgtcctcaccacccaaaacacgccgcctgcgggcaactacagcgacagcgtggtggtcgatattgccttttaaagtgcggcgctgaccggcgtgccgccgtggcgcgcgcggtactgtttgaccattcgaccaatcagcaaggtgccaatcagtccacaaatggccgcaaaggtcagccatacgcccggcatcgccttatcacccgtggcgtgaatcagataactcgacaccgctggcgtgaagccgccaaacagcgcggttgccaggctgtaggccatggagaaaccggcggcgcgcacttctgccggcataatttccgccagatagaccaccatggcaccgttgtagctggcgtagaggaaggagagccataattccgcctccagcagatgggcaaagctcggcgaacccaccatccagtgcagtacgggccaggccgtggcaatcattagcacggtaaacgtcagcaacagggggcgacgaccgacgcgatcggacagtgcgcccatcaccggtagccagaacaggttggagatgcccacgaacagcgtcaccataaacgcctgcttgtcgctcatcatcaacaccgttttgccaaaggttggcgtaaaggcggtaatcatatagaacatcacggtcgtggtgacgaccatcagcatgcccgccagtaccagtgcccagttgctggcaaccgaacgcataatttctgtcatcgccgggtgatgtttacgttggctgaaggcgtcggtttcttccagcatacggcggatatagaacaggaaaggcacgatcaggcagcccaccacaaagggaatacgccagccccactcggtcacttcatcatgggaaagcagatggttcagcgccagacccagcagcgcagcaaaaatcacggcgatctgctgactgcccgattgccagctcacaaagaaccctttgcgtccttttggggccacttcggccagatacacggacacaccgcctaactccacgccggctgaaaagccctgcagcagacgacccagcagaatcaggaccggtgccgccgcgcctagcgtggcataacccggtaccagcgcaatggtgagcgtacccactgccatcaggccgagcgttaacagcaaccctttgcgacgaccatggtggtcaatgtaagcccccagaataatcgcccccagcgggcgcatcaggaaacctgcgccgaaggtcatcaacgtcagcattagtgaagagaagggatcgtcaccggggaagaaggttttggctatcgcggtcgcgtaatagccaaataccatgaagtcgtacatttcaaggaagttaccactggtaacgttgaaaatggttctggccgcgctcttgggcggcttttgtaaagtttcactatggctcatcacggcttccttggttttttatccgttttagcctgccagaagccaaattaatgtgacactgatcaccattgcactttacaaactcatgagcttccgtaacaagaaattaacaggagagttacagcagcatatctgcctgcgttcactgacaaaaggctatcgaagattctgcaaaaaggctgagataaaaaaagcgctacagagtgagcgctttttgaggagggcttaaaatgcggggacaggtaagcgtattaactgcatctgagaagtgaaaaagggtcaaggcttgcggttcacagcgggcggctaaccgggtttaccccgcctgactcatcacttcttgaccgtttccattcccattaaaccgatttttaaataaccggccgtgcgcagttcatccataacgctcatcagcgtttcataatccacagacttgtcggcctggaagaaaatcgtggtgtctttcttgccttgcgtctgctgcgtcagcacgttaatcagcgacgcattatttaccgcctcgttgccaacatagagctgtttgtcggctttgatagagaggtaaaccggtttttccgggcgcggctgaggcgcactggtggacgccgggagattcacacggacatcaacggtcgccagcggcgccgcgaccatgaagatgatgagtagcaccagcatcacgtcaataaatggcgtaacgttgatttcgtgcatttcaccctcggtttcggagtggtcgtttaatcgcattgccataacgcttaccctacacgcagtttttgcgcggcggcaggacggttggcttcaggctgtgccaagtttcccaggtcgatatcgcggctctgcagcagcataatttgcgcagcaacatcccctaacgaggctttgtagttggcgatcatgcgggcaaacacgttgtatatcaccaccgccggaatcgccgctaccagaccgatcgcggtcgccagcaaggcttcagcgatgccgggggcaaccacggcaagattggtcgtttgggttttggcgataccaataaagctgttcatgatgccccagaccgtgccgaacagaccgataaacggcgcgacggaaccaatcgttgccaggaaaccattgccgcgacctgcgtgtcggcagaaagcagcaacgcgacgttcgagccggaaagcggtacgatctttgatcccggccgtgtcttcaacgcctgcagagagttccaactcgttttgcgcgtcgttaaggagcaccgcactgtggctggtggttttaaactgctgggcggcgcgcgcggcatcattcaggttgcgggcttcacccaatgccagctgttcacgtttcaggcgacgtttggccgcgctcagctcagcatacttaccgaagaaaatggcccaggtcacaacagaggccaataacagaccaatcatgacgaccttcaccacgatatcagcatgctggtacatgccccatacggaaaggtctgcttgcattaaatcactggctaccacgcggcttctccaacttcatattcaggatgcggaataagtgcagatgatagcaaaaatcaatcgaattgatagtggttctcattagtatttacaatctaccgcgcctccacgctatggagccagcactggaaaaaggacgcttagtctcagggcctgtacgcgctggctttattacgctcgtcttgggatggcctgcattacgcctgagccgccagtgcttcaggcgagcggttcacaggcccgcggcgctcttttccatctcgccccatacgtcagctttcaccacaaggtactgtgtttttagcacaggaacgatagcagctgcccacttcgccttattgccgccggtttcatcaaaccctgtttcacctgtcaacggtcaacgtgagtgtgccggtgcccgacctcgccgcatcgctctgctggaatacgtggtagcagctctgccattgatggtctgaagtggaggttccctcgttatagccatccgcgcacacccaggcgacataacggcctgcaaggaaataacgcagggctttgggctgcggcggcgagttgattttaccaggccaccaggcccagacaatacgcttcgtgccgcgttgcacacagatggcgtggcgtgactgtcgcgaccacggggcttttggcttttggcttttggcttttggcttttggcttttggcttttggcttttggcttttggcttttggcttttggcttttggcttttggctgacaccctgagcagaggttgctcagttagcccagcgtttttaccgcctccagatgcgccaaaacggctaattagcgatcaatctcataaaataagtttttcgtttcggtgaatgtaaaaattatgttgcggccaaaatccccctgcagcaggatgagtagaacgttctactaaaacgttctacctgctataaaaacgctaataacagcgcaacattggggaaacctggcatgagactgctctcaggatttgttaagtcgttatcaaaactatcaatgattggccgggcgctcatgctgcccatttcgttgctgcctgccgctggcttgctactggcatttggtaataaatttgagttgccgctgatgatgaatgccggcggggtaattttcgataacctgccgatgctgtttgctatcggctctgcggtagggctggcctccgaatccggtatcgccgcgctctctgccgcggtttccgtctttgtgaccaatattaccatcggcactatgttgcatatcacaccggaaatggcggctcagggcggaaaatatgccatggtcgtcggcattccgacgttgcagatgggtgtgtttggcgggcttatctgcggcattctggccgcctggtgctataaccgcttccataccctgcagctcccggagtttctcggtttcttttccggtaagcgttttgtcgccattgccaccgcgtttttatccttcctgcttggcctgctgatgccgtatgtctggcaacatattcaggcagggattgatgcgctgtcggttatcgttaacggtgataatcaggcggcctcaacctttattttcgggctggtcgaacgcgccctgataccgcttggcctgcaccatatctggtatccttcgttctggtactccttcggcgattacgtgaccaaaagcggccaggtgatccatggtgatcaaactatctggttcaagatgctggaagagggcgtgaaatcctttagcagcaacacctaccaaaatgcgggcaagtttatgcaaggtgagtacccgctgatgctgttcgcgctgcccgccgcctgtctggcgatgtatcacgaagcccatacgaaaaacaaaaagatcgccttcggtatcctgttttcggcggcgctgacctgctttttaaccgggatcaccgagccggtagaattcacctttatctttgtcgcgccgctgctgtatgtctttaatgccatcatggcaggcctggcgtatatgaccatgtacctgctgcatgctcatatcgcgaagtccttttcagccggaatgattgactacattacctttggcattgtgccctcacttaacggttatcagactcactatctcagtgccgttatcgtaggcgtgccaatggcattgatttattatttcaccttccgcttcgtgatacgccggtttaatgtaaaaacgccgggacgaaccgatgtgacggccacgaccgatgataaaaccgatgcagagctggcaagcgacattatggttctgctgggcggcgagcagaatatcagcgcggtgggcgcctgcattacgcgccttcggcttgaagtggccaacagcaatgaggtcgaccgtgaagggcttaataaccttggcgcgcgcggcgtggtttttgtcggcgataacggaatacaaattatttttggtgccagagcgcaatttattgcccagacgctgtccgggatggtgggcaaatcctagcctgcgtttctgcaggcgacgggcaaagcggtatcaggcggatgacgtgaatgtcagggagcaggtttgaagagagtcagcattactgacgttgctaaacatgccggtgtttcggtttcgaccgtttcactggtgctgcgtcagaaaggaaaaatatccgatgccaccatcaggaaagttcacgccgccattgatgcgctcgactatgtgcagaatgtggccgcggcgaatctgcgcgccagtacctctaaccttatcggtttgattctgcgcgatttcagcgacagtttctctgtcaaggtgatggcaagcattgttcagcagcttgaaaagcagggctacctggtatttctgggccagcccactgacgacgacgaatcgctggcacgctgcctgctttcgtttaaacagcagggcgtcgccggggtcgtctatctggcgtcaaacacgcgaaacgccagcctgcccgagcaactcctgcactgccctttgccgctggtggtggtatcgcagtcgctgctggcagagaagtgcaatctggtgatgcgtgataaccgccaggccgcgcacctggcgacgcgctatctgatagaacgcggtcatcgcaatattgcttacattggcgggattgaaggggatctgatccggcaacagcgcttactcgggtttcgcagtgccctgacccagcacgggctggcactacgggaagggtttacgccgtcctgtcgggccgatacccaggcggccgcttatgccactcgccagttactggagcagaacaacaccattaccgccctgctctgtcactcgccggatgcgatcattggcgcgatttcagggattcatcatacggggcgcaccgtgggtaaagatgtgttcctgacccaacaggtcgcgctggtgggctttgaagacatgctgcacgtgaacctgacctcgccctctttcacctatgtttcttccgccagtgaagaatccgggcggcaggcggcggaacttatcctgcgtcaggtgaaagaacccgaacggcaaacgcagcgtattttattatcgggccaattaattacacgagagtcagcataaatcggcatttccattgtcagagaagcgagtcagtgaaaaatcgctttcgtgagcaggggaatccccgcgaacgattgttgcgcaaacagaatgataaacagcctatgagcaatgcaatcataaccagcctactttcgcttttacgtcggacaataccgtggctttcattacgaggccgccgtttaccgcatgaccacgctgaccttactcgtgagggagatcgcccatcacgcctgtctcccgcttccgttttcgccgggcctgacggcaccctttctcacgccagtaacgccttaacccaggcaagcgagacgtcatccgatccctgcccgccgccagaccggacgatgctgctctggctgtctcgctgttttttgtttgtatcactgctgctacccggttcaaacatggcttcacactgttcgggagcctgctatgccgccaccaataccctgatcactttgcactttttcaggcgctgttatgaatccggtaaaccctcatccgggatggttaaatgttttagtcgccagttgcgcagcgtggcactgattcgttttatccatgcctcacgcagcgcggccccgccgggcaggttaaagcgttttcgtcacgaccatcactcaggtaagaagaaaagaagccaggtacgtccgcccttccgggccgatcccgagccagagcagcctgtccgtgccagcccggcagaaccctctttgttctcgcctgacgcattgctcagacagcacccgctgccaccgtcgtcgccctgcacaggacggcaatatcaagaaatgccatccggggtgagcccgccgctgaacacgccgaccacctcaaccggctgtgtgccctgagcggacagcatctgggcgtaacatagccctgattagcggatatcccctgggctaattccccagcgggaaggcgtgcttctgctggcggcctggcgctgctgataacgtccttttgccgtaatcatcgccaccgttaacaacgccggaatagccagtacggcaaaaatggtggcaaatccccagcccagcgccagcatctccgccccgaccaacgcgctcagaatcgcgccgacgcgtcccacgccgtgcatccagctggagccggtcgcgcgggcctcggtcggataaaagctggccgagagcgcattcattccggtgttagcgccaccgatgcaaaagccgatcatcatggcacaaccgcccagcaacaccgggtgcgcgagcgaaaatcccataccgaccgtgaacagcgcgcccgcaccgtaaatcagcgacagcgcccggtgcgactcaatcctgtccattaaccaacccgaaaacagcgaaccacaggtgccgcctgcctggaacagcgcagtaataatcgccgcctgtaccacgtcaaaaccgttatctttaatcagcatgggtagccagctgcccagggtgtagaacaaaaacagggcggtaaaataggcgccccacagcatcaggctgccaaaccggtattggtcattgagtaccacttttactggctgcgcgttcgctttgctgacgggcggcagctcgacgctgcactgttgcaggtccagatccggcgccagcttagccagaatacggtgaatttttttgctggcggcacgcctgaccactaaaaagcacaccgactccggcagcgcccagagcagcaacggcacgaacagcatcggcaggatgccgcccagcatcagtacggcgtgccagccaaagtgcggcatcagccatgaagcggcaaagccccccagcgcggcaccaaaggtgaagccgcaaaacaccacggtgatgagaaatgcccgccgtctggcaggcgcaaattcggccaccagcgtacccacattgggcatcgccgcacccaatcccagaccggtcaggaagcgaaacaggatcatctgctccatgttttgcgaaaaggcggtgatcagcgtccaggcaccaaaaaagaacacgctgttaataatgaccactttgcggcccagcctgtcagacaggggaccagagagcatcgcgcccagcgccagtcccaccagcgctgcgctgataatcagccccagctcgcggttggtgatcccccagtcggcttttaattcaggtgcaataaatcccatgatggcaatatcaaatccatcaagggcgatgatgcagaagccaaacagcaccaccatcttttgccacatccccagcgggcggctgtcgattaacgcccgaacatcaattgttttgctttccgccacggtgactctccggtgaaatacgttatgtggggttactatatgcaggcgctgtagggcgataaacggcgataatcgaaattttgtgcgtttatcgcgcaacaatgcgttaaataaagttcattatcgcgttaccagattgttatataaggcaatttttctgacagcatggctcccgttatccgctaaggattgtgagcgggatcgggcgtgttttcaggcggagggatgcgctacagaggagacaggtgcaggataacgggccagcgaaactggcccgtcgaaggattaccgcatggcggtcagccgcacgggcgcattggccgcgccaaagccgcgatagccgccacgccgttccagcaattcgaagaaaaagcggcctttttcatagggaacggtatagacatgcagcagttccccgccctgttcatcacggtcatacaacacatcgtagcgttgcagctgcgccagaaaatcggcatcgagatcgaagcgcgccatcaggtcctgataatagttatcgggaatcggtaaggtttttagaccgcgttcgcgcgcggcttttaccgcgctaaacaggtcgtcacagccaaaggcgacgtgctgtaatcctgcgccctgataggtcgttaaggcacgggcaatttgggtttcccggctgaccgacatattcagcggcaggcgaatcgcatcgttgggactccgcagcacccgactgcgcaccagacccagcggatcgggcagttcccactcggtatcctgcacaaaacccggcacgctgcgcaggaacataatccagttatcgcgtgtgtcatcgggcagggcaatcgccaaatgatcgagcgtctgcatcgcgggctgcggcgcagtgcggtgcgttaaatgaaaatcgctgtggtaaccgtcctggcctgctggctcatcttccaccagataaatcaggctgccgtcgggggcacataacgccggtatctggcgttcgttcgggccggtctctccctgccagatggcgtaaccatagtcctgcgcgcgtttaatcagcttatcgactccgcgaacccgccatgccaccgcacacagcgaaatgccgtgttgatgataatacccgctggcctggctctccggctgggcattcaggatcacatgcaccttgccgttgcgatacagcgccacctgcttggagcgatgatcccccgcatgaaccaggccaagctgcgtcagccattgccccagggccagtgcgtcgttgtggctgacggcaaattcgatgaactccagtgacagcagcggcggctggggcgcagagtgaaacagcccgtctccggccagggaagccagcgcactgggcagcagcggctgtttgatcagccagtcgcgcgtttgctcctcaagccacagcagcgatcgataaccgtcctgggcggtcggcactaccggcgaagcacggaacccgtcgttaaaaatctccagcgaccaggcatcccggtaaccatgggcagacagctgcgtcataaactgggtcagattgaattcgccctggccgggaaagcagcggaagtggcgactccatgacagcacgtccattttcagcagcggcgcatccgccagttgtacaaacacaatcttctctggcggcaccacgtccagcccgtcaaggctgtcgccgcgcgacaaaatgtgaaaactgtcgagcacgatgcccagcgctggatggttgacggcctcgactctggcccaggcatcgcgccacaggctgacatggcgtccccaggccagcgcctcataaccgagagtaataccgtgttgctcagccagctctgccagtgccttaagatcgctgacctgagtggcgaaatcgtcactgcagtcgggtgagacgttgctgcagagcagcatccgctgacagcccagctgttgcatgacttcaaacttccgcgccgcgcgcgcaaggttgtgcgccagcctgtcacgcgggccgccctcgaagtcacggaagggttgaaacagcaaaatctccagcccgagctgttcacacagctggcggatttccacgggtgagccgggataatagaccagatcgttatcgaaaatttcaacgccatcaaagcctgcggcggcgatggcccgcagtttgtccggcagcgtgcccgataccgagaccgttgcgatagaacgtttcattgttgcctccagataaacggtcaccgggtgaccttaaagcagccagtcagcagcgaggcgttccactgacggagattggcaattgttatgaaccagttggaacatttcgtcaatgtgtaactggtcatgatttttggttatgacaaagccgacaatttttcacttttcttttacaagttgcgcttcctacacttcctgctctgtagccgaaaaataataaaggatgcctggatgaaaaatgactggcccgcccgcgaactggtccatcgtgattaccgtgatcacccaccggccctcgcgcccttgtataaaacaagcctgttgcgatccccgcgcaatgcgctgatttcgttgcaaaactcattatcagaaatcaccgcgccggtgtttacccgccaggagcttgggccacgagacagtgacctgatcctcaattacgcgaaagagggtttgcccatcggcgaacgcattatcgtgcatggctacgtgcgtgatgcgtttggtcagcccgtaaaaaatgccctggttgaggtgtggcaggccaatgccggaggacgctatcgtcataaaaaagatcagtatcttgcgcctatcgatcctaactttggcggttgcggtcgtatgctgacagacgacaacggttactactgttttcgcaccatcaagcccggcccttatccctggcgcaatcaggtcagcgactggcggccggcgcatattcatttttccctgtctggcgaagcctttgcccagcgactgattacccagatgtattttgagggcgacccgctggtaggccgctgtccgattgttcagtcggtaggcagcgaggacgccgtgcgaacgctgattgctgaactggatacgcattccgctgtgccgctggattgcctggcctatcgctttgacctggtcctgcgcggtcatcgtgcgacctggttcgaaaaccggacccagggagccgcatcatgaaacgctatcttgccgaaacggcgtcgcaaaccgccgggccttatgtgcacattggcctggcgccccatgcggcaggctttgatatttttgaaaataactttagtgaggtgcttacccagccggaaacgcgcggcgagcgcattgtggttgaaggctgcgtttacgacggttccggcacgccggttcgcgatgtgctgattgaagtgtggcaggccaatgccgagggacgctatcagcacccggctgaccagcagcacgataaaccgctggacccggcgtttcgtggctgggggcggacctgctcggattttgacagcggtatctggcgtatcgacaccattaaacccggtagcgtgaccgggcgcgatggccgccccatggctccgcaccttaacctgtggattgtggctcggggcattaacatcggcctgaatacccggctctacttcgccgatgaacaggcggcaaatgccagcgatccggtgctgaatttaattgaatgggaaacgcgacgcagcaccttactggcacagcgtgaacagcgcggcgatgagacgatctaccgcttcgatatctggctgcagggtgaaaaagaaaccgtgttctttgacatctgattcttaacttccttgcaacattgttcttgccgcttcggcggcaaattcataacatgagccatggatagggtttcccggtttagtcagcgcgtgcgcctgcgtcatcttcacgcttttgttgccaccgcgcagcaggggacgctgggtcgtgccgccctccatctgggcattacccagcccgccctgtccaaaacccttaacgaactcgaattccttacctgtgagcaactgttgctgcgaagccgccagggaaccgagcttaccgccagcggcgcgcgtttcctgcacgacgccattcgtattctggatgccctgaatattgctgaccaggtcatgcgacccggctgcacgcctcagcccgcgccgctgcaccttggcgcgctgcctaccgccataatcagcgtcgttgcgccagtgttagccagcctgcagcagcactaccccggctggcgcatccaggtcagcacgctggcgaacgatgccctgctgatggggataaaatcgggacagatggcgctggggattggccgcatggccgaaccggtgttgatggaggggctgaatttcgagctgctgtatctggaaaccctgcgtctggtggtggccccgcatcatccactgttgcacgccggcgtgacgctggccgaagctctcagctggccgctgatcctgtctcctcgcgggacagtgccgcgccagaacgccgaatcactgatgaccagccatggcctgaccttaccggatggcgcagtggaaaccctgtccaccacgctggcccgccgcctgacgctgggtcacggttacgtctggctggtgccctacggcgcggtgcgcgacgacctgaccagcaaccagctacgcaccttgccgcttcccagccagggcatggctgaagcggtcggcatcctgacccgccagcagcaaacgccgccacctgagcaactgcaactggtagcggccttgcggcaacgggtgctggacgtgcctgtctgacatcgccgtttaccgcgcgctatcctgctcatcgaataccgtctgcgccagatggaatgcggcgttggaagccggcaggccgcaatagagcgcagcatgcatcagcagttctttaatttcatcccggctgacgccgttattgaacgcggcccgcaggtgcatcttcagctctgcttcccggttgagcgcaatcagcatgccgatggtgatcaggctgcgcgtgtggcgagtcaggccaggacgggtccagatctcgccccaggcgtagcggctgataaagttctggaactcgtcattcagcggcgacaggttttccaacgtacggtcaacatgggcttcgccaagcacggccctccgcaccctcatgccctgctgatagcgttgatcctgcgtcagctgagcgtcaataaaaggctgtagcgcgcggttaaacgccagccacacctccacgctggacagatgcgaggcgggcagcacgacacgttgcgcgcccggaatctgtgcaaccatcgcatccgcatcggccactgtggtgaccttgtcgtcccgtccggcaatcaccagcacaggtagcgaaatcgccgccagttcatagcgcaaatcggctgtcgccagagcttcacagcagtcggcatagctttcggcatcgcaggcgctgagctgcgatagcaggctttgtaccgtcgcgggcgcgcgttcacagaatgccggcgtaaaccagcgcgcagccgcgctctccgtgatagcggtcatgccgtgctgacggacaagtgccgcccgctgctgccaggccgcaggctcgccgatctttgccgcactgttggcaaccgttaatgtcatcaggcgttgaggatgaaaacgtgccagccagagtccggtcagcccgcccatcgagatgccgcaaaagtgcaccctgtcgatgcccagcgtatccagcagcgacagaaccttgcttccaagttgttccagcgaacgggtttgtccgtccggtgctgaggcaccgtggccgggaacgtcgtaacgcaggatgcgatactggttgatcagcgcatcgcgttgcggctgccacatctctgatgtggtgcctaaggagttgctgaacagaataaccggggcatcgtctggcccctcaagtacgtaatgcagcgtcatgattccctcgcagccgctaaaacctggtgaataaagcgcgatgcgctgcccgtggcggtggccggatcgagcagcgtctccagtgcaggccggctcaggtgcgagacaacggtgtcatctgcacacagaatggtcagcaaactctgctgcgtctccagcgcccggcggcagcactgctcaatatgatggtgtgcctgttgccgtcccagcgtctctgccagcgccagcgtgaccgcttcggccataattaatccctgcgtcagaccgagattgcgttgcatggcttcttcatgcacttcaaggccgtcgatcagttccgtgctgtgcaccagcgccgcgccactgagttctgtcagctgcggcaggctctgccactctgcctgccagccgcccagcgcacgctcgtgctcctgaacctggccagcatacaggcccgacatcagggcctggacccggttggcggcgctgagaatcgcggcacagagcaccggattacgtttgtgcggcatggtagaagagccaccgcgccccggtgcctggggttcactgacttcaccgacttcgctctgcatcaggagcgacatgtcccgggccagtttacccagcgtaccggtaagaccggcataccagccagccagctcggtgatcctgtcgcgttgagcgtgccagggcgtggcgctacgcggcagatccaacgcctcggacagtgcctgctctacgcgctcgcccttttcccccagcgacgccagcgtgcctgccgccccgccgaactgaagcgccagcacccggggccgcatggccaccagccgcgcgcggaagcgcaccagcgcatccagcgtgcccgccagcttcaggcccaacgtcaccggtaaagcgtgttgcagccaggtccggccaaccatcagcgtcgtgctgtgccgctcgcactgaagaaccagtgcggcaatcagccggtccagcagcaccgacgtgtcgttaagcgcggcgcgcagttgcagcatcagaccactgtcgatcgcatcctgactggttgcgccccagtgcacatagcgcgcggcgtcgggcgacgtcgccgccaccacggccgtaagctgtttcaccagcggaatcgcaaggttgccagccagccccgcagcctgcgtcagcgccgcccgatcgatcgcctgcgcccggcaacaggactgaatacagcgggcggatgcgtgatcgatcaccccggctactgccagcgcctgtgccagcccggcttcaaaatccagcattccctggagcagggccgtatcgctgaagctgtcgctaagcggagaagccataaacatggcgcggtaaagagacattggttatacccgttccagaatgagtgcgattccctgcccaacgcctacacacatggtgcagagcgcgtaccggccgccggtgcgccgcagctggtaagctgccgtcatcgccagcctgccgcctgatgcgcccagcggatgcccaagcgcaatcgcgccaccgttgggattcacatgggccgcatcgtcggctaaccccagttcgcgcgtcaccgccagcgcctgagcagcgaaagcttcatttaattcgatcacgtccatttgtgccagcgtcaggccactctgagccagcactttacgcacggcaggcaccgggccatagcccataatgcgcggctcaatgccacaggccgccatcgccaccacccgcaccagcggagtcagtccatgttctgccgccgcgcgctcgcttgccagcagcaaggcgcaggcgccgtcgttaatgcccgatgcgttacccgccgtcacgctgccttccgggctgaccacgcctttcaggcctgccagcgccgccagcgaggtgctgcgcggatgctcgtcacaggtgacgttcagggcgtcgcctttgcgctgcgggatgctcaccgccatcagttcgtcactaaacagccccatttcctgcgcccgggcggtacgtaattgactacgcagggcgaaggcatcctgatcggcgcggctgatagcgaactcgcgcgcaacgttttctgcggtttccggcatggtatcgaccccaaagcgggcgcgcatctgcgggttaatgaagcgccatcccatcgtcgtgtcttccattttcagggaacggctaaacgcgctttctgctttgccggtcacatagggcgcgcgcgacatactttccacgccgcccgcaatcatcacgttggcctcaccgcatttgatcgccctggccgccgtgccgatggcatccagccccgagccgcacaggcgattgagcgtagtgcccggcacgctggacggcagcccagccagtaacagggccatacgcgcgacgttacggttatcttctccggcctggttggcgcaaccgtaaatcacatcatcgatggcctgtgccaccgaggaaggctgacgggctaacagcgcggctaagggtaaggccgccagatcgtcagcgcgcaggctggcaagcgcgcccgcgtaacggccaaaaggggtacgtagcgcatcacagataaatgcctgttgcatcagtctctcctcaggcggtcgccagttcaggttgcaataagcgcaccggcgttaacgcctgcagcgcgtcgaaactcagaccggggcagcactccaccaccagcggtccctgcggagtaatatcaatcaccgccatatcggtataaagacgactgacgcagcccagaccggtgagcggatagctgcactgattcaccagcttgcactcgccttttttggtcaggtaatccatcatcacatagactttgcgcgcgccaatggcgagatccatcgccccgcccacggcgggaatcgcgtcctgtgcgccggtactccagttagccaaatcgccgctaaccgacacctggtatgcccccatcacgcagatatccagatgcccgccgcgcatcatggcaaacgagtcgccgtggtggaaaaaacagccgccaggcagcagcgtcacctgctctttcccggcgttgatcagctccggatcttcctctcccgctgcgggtgccggccccatgccgagcaggccattctcactgtgcagaaagatctctttgtccgcaggcagatagttggcaatgcgggtgggcaggccgatgcccagattaacgtaagcaccttcaggaatatcacgcgccacgcgctgggccagttggtctcgggtgagtttttgcatagtctgttcctcaggcggaaacggtcagggtgacgggatgcgcgacggccaccagccgctgcacaaaaatgcccggtgtgacgacgttttcaggatcgagatgcccaagcggcaccagttctgcgacctgggcaatcgtggtggtggcggccatggccatgatcggcccaaagtttcgtgctgctttgcggtaaacgaggttgccccagcggtcgccctggtgcgcttttatcagggcaaaatcggccttaagcggtttttcaaacacgtaatggcgaccatcgatctcgcgcgtttctttgccctccgccagcggcgtaccaaaggcggtcggcgtgaaaatcccgcctaagccgctcccggctgcctgcattctggctgcaaggttgccttgcggcaccagctcaagggcgatttccccacgccgatagcgttcgtcgaacacccatgaatcgacctgacgtggaaaggaacaaatcatcttatcgacgcagcccgctttcagcagcgcggccaggccgctttcgccgttaccggcgttattgctgatcaccgtcagcccacggacgccactgtcgatcagcgcatcaatcagttccaggggctggcctgcgggcccgaacccgccaatcatgatgctggccccgtccggtatcaccgcaacggcctctgccagcgttgccacacttttatcgatcatctgctgttcctttagcccggctcaggccggtttgtgttgaatagtcaaaaagtagatcgctctgtgacagcaaacaataccgataatcgaaatagtgtgcgattatcggtcaacgacagactgaaacggggcattgtgatcgcgcacacaggcgtgcacggctccagccactcacgggagaacatcatgacggatgaacaacaaccactgcgcgctaacagcgatccctggaaaggcgatcccaactttatggcctcactggcgcggggactggaggtgctacaggcgtttacgccacagcggcgtctgatgtccgtgtcgcaaatcagccagcgtaccggtattccccgtgcggccgtgcggcgctgtctctatacattgagcaagctggggtttgtgtatgcggaggatggtaaaaactttgaactgcgtccgcgtgtgctctctctgggtcacaactggttaggggctacgccgctggcgagcgcctcacagccggttttgcgccagctcagccagacgctgaacgaatcctgttcgatggcggtactggacggggatgacattctctatatcgcccgtgcgtcagcatcgcgcatcatgacgatcgacctgcatatcggcagccgcttaccggccagcaccacctccatgggaagagtgctgttaagtgggcttgccagcgaaccgctaaatgattatctggcgcgtttaacccaactgcgttacaccagccacacgctggtcagtagtagcgcgctgcgtgaggagctggcgcgcgtcaggcagcagggttacgccatcaacgatcaggaactggaaatcggactacgatcgctggccgtgccgctcagcgcgccggatggccggatcgtggccgccctgaatgtgggcgtgcatgccggacaggtttccgccgatatgctgcgccagcaccatttaccgctgttgcaggaggcagcccgcgaaatctcgctgttgctgcggcaataatctgtttagccgctcaacgccgctgctgaattcgtggtaacgtgaagtctgagttgcaagcggcaaagtagagagctatgaccacgaaaaaaattgataccacactcgtcagcgctggacgcaacaagcgttatacccagggttcggtgaacgcggtgattcagcgcgcctcttcgctggtttttgataccgtggctgagaaaaaacgtgccaccgcagggcgtgcgaagggcgagctgttttatggtcgtcgcggcaccctgacacatttcgccttgcaggatgccatgacggagctggaaggcggtgcgggctgtgttctctacccttgcggcgcggcagccgtctccaatgccatcctcgcgttcgttgaagcgggcgaccacattttaatgagtggggcggtttacgaaccgactcaggacttctgcacgaaaatactgagcaaactccaggtatccaccacctggtttgatcactgtatcggtggtgacatcgccgcactgattcaaccgaatacccgcgtggttttcctggaatcccccgcctccatcacgatggaagtgcaggacgttcccgctatcgtcgcggcggtgcgcgctaaagcgcccgacgccatcattatgatcgataacacctgggcggctggcgtgctgttcagcccgctggcccttggcgtggatatttctattcaggccggcacgaaatacttgattggtcacagtgacgccatgattggcaccgctgtcgccaacgcccgctgctgggatcaactgcgcgaaaacagctacctgatgggtcagatggtggacgccgatacggcttacatggcaagtcgtggcctgcgtacgctcggcgtgcgcctgcggcagcacgaagagagcgcgttacaggtggcagaatggcttgctgcgcgacctgaagtggcgcgtgttaaccatccggcactgccttcctgccggggacatgaattctggcagcgtgactttaacggcagcagcggtttattttcatttgtcctgcagcaaaaactcagccgtgaacagctggcgaattacctcgaccattttcatcatttcagcatggcctattcatggggcggttatgagtcgctgattttagccaatcagcctgaggagctggcggccattcgcccggccggtggcgtggacgtcgagggcacgctgatacggctccatatcggcctggaacatgtggatgatttacgggtcgatcttgaggcaggctttgatcgcctgacgcgctaaaatagtaaacatgatataaaccaggcgccgaccgtcgtgatataacacccggtcatggctggttagctgttaacattcagtttataaaaaaagtgttcagccagcagaagaaccgcagcattttacccttccaccgcacgctgttgcggtggtggaagtaagaggtcaggcaggtctgaacagaacgagtaagtcttattgtgacgtaatgggatagctaatgggtgttttacacgagattgtgcacgcgctttggcatcaagacttcgccgcgctggccaatccagatgtggtttggatcgtctacagcgtcatgtttatgacgctgtttctggaaaatggtttgttgcctgcctcttttttgcccggtgacagcctgctactgctggcaggtgccatggtcgccaaaggggtgatggattttttcccgacgctgttgattctgacgactgccgccagtctgggctgctggctgagttatctgcaaggacgctggctaggcaacacgaaactggtcaagagctggctgatgcagctcccggcgcaatatcatcaacgcgcatggaatatgtttaaccgccatggcctgatggcgctgttggttggccgctttctggcttttattcgcaccctgttaccgaccatggcaggtatatccgggctgtccaatggtcgtttccagttatttaactggctgagcggcctgctgtgggtcggcatcgtagtgaccatgggttacggtatcagccaggtgccctttattaaacgtcacgaagatcaggtgatggcgatcctgatgatattaccgatggtgctactggtggtaggactggtcggcagcatcatcgttatctggaaaaagcgtcgtcaaaaacacgcctgagcatgggctgcgtcagccggcggattcggctaccgtctgacgcacccgattcacttcttctcccggcgtcacgccaaaatagcgcttaaactcccgtgaaaactgcgaggggctttcatagccgacgcgcaccgccgccacgctggctttcaggccatcatgcaacatcagtagccgcgcctgatgcaggcgataacgtttaaggtactgcaacggcgacgtctgcgtcaccgccttaaagttatggtgaaacgccgacacgctcatattcacctctgccgccagcgcctccacgctgagattgtcagcatagtgatgttcaatgcgccgtaccgcgcgggcaatctggctgaactgcgtttgacgactgaccagcgacagcagcgccccgccgatcggcccggtcagcacgtaatagataatttcccgcacaatgtccggtcccagcacgcgggcatcccgtggttgtgtcatcacatccagcaggcgctctgcggcgcataacatcggctcggttagccagccggcgtgaataccggaggtaagcggctgcggctggaaaccttcatcatcaccaatcgccatcagcaggtcctgcaaactggcggtatccacgttcagacacatcccggctaagggctgttcgggtgacgcccaggtttcgcactcgaccggcagcggtacggtcagcatcaaatactttgtggcatcgtactgaaaaaccgtactgccgagatagccggttttacttccctgaaacaggataacgatgccgggctgatacatgatcggcgtgcgcgggcgatactgaccggcatagatcagcgagacgttttctaccgggcacagctgttcgcgcccgtgggtcatcaacgtgaccacctgttgagccagacgttggcacaatgcgtcgtggggcataatcactccagaaaataaaatagcagtttgccgcgcacctggttaattcgccagcaaaatggagaatcaggcaagaagttgacaggatcaggcagggttatcctgtgcggttcacaagcagcctgcaaattgttagctagacttaagcacagcgaagattcactggtttactgcaaatgtaaggagcatgtcatggcagaccaacctattatcaaactgcacgatggtaacatgatgccgcaactgggacttggcgtgtggcaagccagcgtcgaagatgcgcgtcacgccgtgctgaaagcgctggaggtcggctatcgttccattgataccgccgccgcgtacaaaaacgaagaggcgattggtcaggcgttacaggaaactgacgtcgcccgtgacgatatctttgtcacgaccaagctgtggaataacgaccagcaaaatgtccagcaggcgctggaaaccagcctggaaaagctcaagctggaccaggtcgatctgtatctgatgcactggccgtgcccggaaaacgatcactatgttgaagcctggaagaacatgatcgcgttccagcaacagggcctggttaaaagcatcggcgtgtgtaactttaatcagccgcacctgaagcgactgctggaagaaacgggcgtgacgccggtgatcaatcagattgagctgcatccgatgctgcaacagcgcaccctgcatgcatggaacgccatgcatcagattcagacagaatcctggagtcccctggctcagggtggcgaaggtgtattcgatcaggacatcatcaaatcgctggcgaagaaatacggtaaaaccccggcgcaaatcgttatccgctggcacctggacagtggtctggtcgtgattccaaaatcggtaacgcctgcgcgcattgaagagaacttcaaggtgtttgatttccgcctggataagacagaaatgagcgagattgccaggctggacagcggcaatcgactggggccagacccggacacgttcaacggctaacgcaaccgccttgtctgcatcttgccccatcaagcctctctgccccagagaggcttttttatctctggtgcgcgatgcccaatgcatggcgtttcaccgggcgtaccggtccgtatgggccaggtgactgcgcgcggtgatggccacgccgcaggagaacgcggcaagccgctttcccctggcatcaaccttaagacagcgtgggttgcgtcagtaactggcctgccgtgccgcgatccgccagttccagggtctgactgtggtagacaaaaggaaaatgctctgacgaactttgcgtaaagctgaccagcagctcgacgtcgccgtccacccagacggtatctttccaaccgcgatcttcgcccatcggctgggcaccgttcacgctcttaatcaggaacatcacgccctgaatatggaaggattgcggacgatcggcacgaataatccagcgctcgaacgtgccctgctgggcggtggagtcgatgcggttcatatcccatacggcaccgttgatgcccggcatactgtcgccaatgcggaattcccgcgtacgcaccgacgcaccgtccagaatctgatcggccagtaaacgcatcggcaggttatcggtgaccagcggcagcaggccggtaggccgtaacgtcagcaccagcgttgaggtcagaatcgtggagggttcaaagaaaccccgcaggcgatccataatgcccgccgccgtgcctgccgtgatggagacttcatccccttgcgacatatccactaagacttcgcgccgctcgcccggtgccagggttaagcgctgtaccgcaaccggtgacggcaagaagccctgatcgctggcgatcaccgtaaaggggcggttatcactgatgctcagttcataacgtcgcgcattggaggcgttcagcaaccgcagacgtacccaaccgcgcgagacctcaacaaaaggattgcggacaccgttgaccagcaacgtgtcgcccaggaaaccgccctcgcccggcgggtcataaaccggcgtggcaaagttatccagccgtttgtcctgaatgatcagggggaaatcgtccacgccatagtgtttcggcagcggtaactgcttgctgatgtcgtcttcaatcagccacatgcccgccaggccgttatacacgtgcggggccatacgatttggcgtgttggcatgataccagcaggtggcggcattctggcgaatcggtagcaccggtgcccagtcaacgccggctgacatcatacgcggcgcaccgcccatcagtgcaccgggcacctgcaggccgctgaccgtcatggaaaccggttcgttaaggcgattgctgtagatcagtttgacatcatcaccgctgtacacgcgcaccgtcgggcccagatacatgccgttaatgccccagaccgggactttattgttatcaccgttaaacgaccagtggctgcgctgcagggttaaaaacagcggctgaccacggcgcgattccagtagcggtggaacaggaagcggcgtgtcaccacgcgcagacgcggcacgcgccgcatgaggcataaccgtggcactgagcgccacaccggcagaaagctggataaactgacgtctgctgaaagacattgaatttcagaccttttacgcgtggcgctgaaacgccaactctgtttttattgctgtgctgcgtacacggcgagcgaaacccgccgtggggcatccatgcagaatagtccgacaaaggacttatcggttagattttaccgtttttttcacgttcttcgacttcggcgttcagctcttccagctttgccgccattaattcacgacagtgcgtcgccagtttacggactgaagtggcctcaaattgtttgacgtccaccggcggcagcatctccacaatcaccagtccgtttttcaggcggttgaggttaattttgccgtgagtattcgagaccacaatcggaatgaccggcacgcccgccgcaacggcggcatgaaatgccccggttttgaacggtaataacccgcgaccgcggctgcgcgtgccctctggaaacatccagaatgaaatgcgctttttattaaactgatctaccagctcaccaatcgtaccgtgtgctttggcgcggttgtcacgatcgatcagcaggttaccggccagccagtaaagctgcccaaaaaagggtatccataacaggctttttttacccacggtgaccgtcgtgggctgcacaatcttggctgccgtcaccatatcgtagttgttctgatggttagcgatgtaaatcgcgttgccatagttttccgcgccttcggggcggcgaagctctactttaaggccaaacagggtcgataatttgccaaacaggtgaccaaaggtcgcgacgtggcgcgggttacgtggcgagaacagacaccagatgcacccgaaaatacttaacagggttgaataaatcacgacgataatagtacgtaatatcagtaacatagtttcctcaatgtgacacggctggccatcagccagccgggtgaattacgcgtcgctgtccgcgctgtcaggacgtgccggtgcatccagttcgacccgatcaattttttgcaggccacgcggcagcagtgtgccacgacggccgcgatcggcacggaacttctgcaactcttcactgcgtaacagcagcttgcgtttgccaacgtgcagcgtaatcgcactgcccggtggcagtatcatcagccaggccagtttatcgactcccgctgcagcatccgccgacggaatggagataatcttgttgcctttgcccttcgacatttgcggcagctcgcctaccgggaacattaacatcctgccggcctgcgtaatggccagcaacatgtcgtcttcgtgatgcacggccattggcgtcatcacgcgcgcattctcaggcagggtcagcagcgctttgcccgcacggttgcgcgaaatcagatcgttgaaggtacagataaaaccatatccggcatcagaagccatgagcaaacgctgctcttctggctccatcagcacctgttcaacgacagcacccggcggtggcgtcagcttaccggttagcggctcgccctgaccccgtgccgagggcagcgaggtgggatcgagcgtatagctgcgtccggttgaatcgataaaggcgacgggttgattactcttgccgcgcgccgccgccagatagctgtcgccggctttgtagctcagccctgccggatcgatatcatgccctttggcactgcgcacccagcccatctgcgacaggacaatggtgacaggctcggagggaaccagctcagtttcgctgagtgctttggcttcttcacgctcacgcaatggtgagcggcgatcgtcgccaaaactgttgctgtcggcctgcagttcttttttcagcagcgtattcattttgcgttcggatgccagaatcgactgcagctgatcgcgctctttttccagttcgctctgctcgccgcgaatcttcatctcttccagcttcgctaaatggcgcagcttgagctcaaggatcgcttcggcctgggtttcactgatctcaaagcgcgacatcagtaccggtttcggctcatcctcagtacggatgatgtgaatcacttcgtcgatattgaggaaggccaccagcaaaccgtcaagaatatgcaggcgacgcagcacgcgatctaaccggtagttcagacggcgacgcacggtgtcgcggcggaacaccaaccattccgacaggatctccagcaggtttttcaccgccggacggttatccagcccgatcatgttgaggttaatgcggtagcttttttccagatcagtggtggcgaacaggtggttcatgacctgatccagatcgacgcgattggaacgcggtacgatcaccagccgggtggggttttcgtgatcggattcgtcacgcagatcctctaccatcggcagctttttgttgcgcatctggttggcgatctgctccagcacgcgggcgcccgacacctgatgcggcagcgcagtgatcaccacttcaccctcttctttcttccacaccgcacgctggcgaaccgagccgcgtccgttttggtagattttacggatctcttcacgcggcgtaatgatctcagcttcggtcgggaaatccggtccctgcacgatctccagcagcgcatccaggctggttttgggatcgtcaatcagggcaatagcggcctgggcgacttcacgcaaattgtgcggcggaatatcggttgccatgcccacggcgatgccggtggtgccgttcagcagaatattcggcagccgcgcgggcagcatcttcggctcctgcatggtgccatcaaagtttggcacccagtcggccgtgccctgacccagctcgcccagcagcacttcggcatatttagacaggcgtgattcggtataacgcatggcggcaaaggatttgggatcgtccggtgccccccagttcccctgaccatcgaccagcggatagcggtaggaaaacggctgcgccatcagcaccatggcttcatagcaggcgctgtcgccatgaggatggtatttacccagcacgtcacccacggtacgggcggattttttaaatttggctgtggcgttcagtcccagctctgacatcgcaaagacaatgcggcgctgcacgggctttaaaccgtcgccaatgtaaggcagcgcgcggtccatgatgacgtacatggagtaatttaagtacgcattctcagtaaacgtatgcagggcaagacgctctgcaccatcctgcgtcaattcgctcattaagtcctcatcctcacatcgtgacccgcaacggcggatcacccggcggttgtttggcgaggatagtaccttattcgcgggtgttagtcacagtcctgacgcagtcagctcagggttttttccctgtttattgcatgccaaaaacgacgctctggacaaaatgctcagcgtcttatttctaatagtttgtgaccgcgctcgcaattaattactggcgagcgtagcgcgtattaatcctgtcctgcttccgggacaacatttagtattgttgattcgcctttctcgccctacattccctttcatcgacatcaggttattttatttttatgccaggttggattaaacgaattgccacttaagcaccgctaacgaaataatagacaggtgactgaatgcagaatctgacttcacgacaacatcgcttactgaaattactgctacaggccggcacgccgctggctttaacacaattagcccagcaattgagcgtgtcggaaaaaagtatttatcgcgatttacagcgcctggaaatctggctgagtgactggcaggtgccgttgatcaagctgcccggacgcagtgtgatgctgcaaaccgacgacagagagcaacgcctgcttttacagcagcacctcgccagtgaagaaaactggtctgaggggctaagcaacaatgcacgccgggtgaaaattctgtcgcagctgctgagggatgccccgcgagaaacctcaatcagtaaattatctgaacgttatttcatcagccatgcctctatcgtcaacgatttaaaggtgattgaagagtggctgcagccgctggaactccaggtcgtgcgcagtcagagcggtacccatgttgaagggagcgaacaggcattgcgccaggcaatggtatcgctgattaacgatgttatgcagcataacgttggcagtaatacgccgttgccgcggctggacccgggcagttaccaggcgctgattcactattttggcgaagaagatgtggcctttgtgcagaccttactgcagcacatggagcagcagcttggctatcccctgagcgatgcttactacatcaatctgtcgacccacatcctgatcatgatccaccgcatgtcgcagggtaaggccttatccctgccgctggcgctgagcgcccaggaaatggacaaccgtatcctgaagattgctcggcaaatggtggtacagattgaacaacgtttaggacagtcagtaccggctgatgagatcggatttatttatcagtacattatttcttccggcattgttgttgaggaacgcggtagcgatatgctgccgcaatatcaattttcgaataaagcatcgcgcaatataacgcgtgaattaattcactgtttttcagatctcattcaacaggatctcaccaccgaccctttattatttgaaggtttactttttcatattaagccattacttaaccggcttaaatatcatattcgtattcgcaatccgttactggatgatattaaaaccgagctgagtgaaatttttacgctgacgcagcgggccatgcagattaccgcgacacgttttcattatgcgtccatcgctgatgatgaagtgggttatttgtgtgttcattttcaggctgcgctggaacggcaaatcgcccacaaacgtattctgctggtgtgttccagcggcgtgggcacttcgcatctccttaagagccgtattctgcgcgcgttcccggactggattattgcgggcgtcatttctgccagtaacctaggcgatttttgccagcaagagccggtggacctggtgatttctaccattcatctcgatatcgcaacgtttccaaccgtgtatgtgaccgcgtttttcaatgacgacgacattcgtcgtgtgactgacgccatgattggcagccaactgccgcaggccgttaacagcgtcctggctgaacattaactgaatgaggtctgacagatggatatttctcgcattcttacgccgcgccgcgtcaatctcaacctgcaagccagcagtaaagaggaggcgattgttgaactgaccgatttgctgttcagtgacgacgccatcagcgataaagcgacttttattaaggacgtctggctacgtgaggcggaaggatcgacagggtttgaaaaccatattgccattccgcacggtaaatcgtcagccgttaaacaaaccacattagccattgggcgaagccaacaggatattccgtgggaaacgctggatggcagtaaggtgcgctgcattatcctgtttgccgtgcgtcttgaagatcaaaatactccccatattcgcctgctgtcccaggtggccagtgcgctggccgatgatgaggtgatagcgcagttgctggtggaaaatgaccccagcgaaatcattcggctgttcagtcagtacgccgaaaccgacctctgttaatcctacacgtccgaggtagaccatgaacatcgtctgtgttgccgcctgtacggcgggcatcgcgcatacctacattgcgcgcgaaaaactgatcaagggcgcacatgcccttggtcacatcatccacgtggaaacgcagggcaccattggtaccgaaaatgccctggatgccgacaccatcgccgccgccgatgtggtcattctggcggtagatgtgaagatcaacggtgaagaacgctttcgcggcaaaccgatcgtcagggtgaaaaccgaagtggtgatcaagtcgccgatcaagtttctggaaaaagtggcggattcactggcgcgcgcctgaggagatccacaatgaacgataacaaaagacagtatgggcaggagatcaaaggccatctgttgaccgggatctcctggatgatcccgctgattgtcgccgccgggatctgtatcgccctgggccaggtgatcggcggaccggacgttggcaaacatcccggcacgatagcctggatgctgaaccagatgggcggctggggcatgggattgatcgtgccgttgatcagcgccgccatcgcctattcgattgccgacagacctggctttgcacccggtttaatcgtgggctttatctgcggtcagatcggcactggctttatcggcggcatcctgggtggcttcctggtgggttatacggtgattctgctgcggcgcactatccggctgccacagtcgatgcaggggctgatgcccatcatggtgttgcccgtgctgagcaccattatcgccgggcttctgatgatgacctttatcggtcaacccatcgtctggctacagaaggcgctgattgcgctgctggaatccatgcaaggcggttctaaattcgtcatgggggcgattcttggggcgatggcgaccttcgacttcggcggcccggtgaataaaaccatgtcgctgtttgcggatggcatgctggtcgacggcatttatggaccggaagcggtcaaatttgtcggctcgatgatcccaccctttggtatcaccctttcctggttgttaacccgccataagtacacccgcgcagaaaaagaagcactgaaggcagcctttccgatggggatctgcatgatcaccgaaggtgtgatcccgatagctgcccgcgatctgtttcgtgtcgtcggcagctgtgtggtggcgtccgccgtcgccggtgggctgattatggtctggggcgtcgaagcgcctgtgcctcatggcggtatgttcgtggttcccctctttaccaaaccctggctgttctgtctggcgctcggtatcggcagcacgatctgtggcgtgatgttatcgctgctgaaaaagccggtcaccgaagccgacgaggagtttgacgacgtggaagaccacagcgttcgcgatgacgacattaaattcacactggaataaggagtgcgtatgtacgcggcaatgaacgacctgatagcgcaggccgcccgtcaccaatacgcggtactggccatcaactgttttaacctggaaagcgcccgtgcggccgtgcaggcggcggaggagcaacgtgcgcccctgatcctgaatgtttatcagggacacagtcgtcattttccgcccgctgttgccgtgccgctggttcaggcgctggtggcggatgccagtgtgccggtcgccctggcgctcgaccatgggacagactttgcgctgattgggcaggcctttcgcgcggggtttaccggactgatgatcgatgcctcttccgagccattggcagaaaatattcgccagacggcaaaggtggtcgagatggcccacaccgctggcgtttgtgtggaaggcgaactggggcatatcgccgatgccccaacttatgcgctggcggacgccgcggtaaaaatgacacaggtggcggatgtgctgccctttctggaacaaacgggcatcgatctgttagcggtgtcggttggcaccgcgcacgggctctatcccgctggcgtcaaaccgcaaatcgactttcagcgtctggcagaactgcatgccgtctcgccggtcccccttgcgcttcacggcggcagcggaacgcctgcggaggcgattcgtcgcgtcagtcagcacggcgtcgccaagattaacgtcggtgcagccgtttttgatgccggcaagcaggcgatccaacaggcgcttaaacagcatccttctgctgaactgcctgacctgatggcgctgatggcgtccgcctgtcgcgaagtcgtacatgactatctgagcgactccggctccgcgaatcagatctgatttttttctgctgtaacccggtgcgcgtcgctgaacgtcagcgcagggcatcccattgtcgtaaaacaagctgaggaagatttaacatgttaatttcaatgaaagagatgttaagccccacccgtcaacaccgctttgctataggcgcatttaacgtggctgacagctgttttatccgcgcggtggtggaagaagccgaagccaccgacaccccggccattatctctattcatcccagcgaactggagttcgtgacggatgcgttttttggctatgtgcgggagcgcaccctgaaaagccgcgtgccttttaccctgcatctggatcatggtgcttcggttgcccatgtgttgcgggccatccagtgtggctttacatcggtcatgattgatggttcgctgctgccctatgaagaaaacgtggcgctgaccaaagaagtggtgaaactggcccatgcggtgggcgtttccgtggagggcgaactgggcaccattggcgataccggtacgtcggtagaaggtggcgtcagtaaggtgatttataccgagccggcgcaggcggaagattttgtgcagcgcaccggcgtggataccttagcggtggcaataggcacggcgcacggtatttatcccaaagatatgaaaccggaactgcaaatgcatatcctgcgggatatctcgcaacgcgtgtccattccgctggtgctgcacggcggttcggcaaatccggatgcggaagtggctgaagcggttacgctgggcgtgggtaaaatcaatatctccagcgatatgaaatatgcctacttccagaaagtccgcgaagtcttaacccgtgaaacctggtgggaccctaacgttatctatcccgaagcgattgaagctgctaaagcggtgatccgctacaaaatgaatttgtttggcggactgggaaaagcgtcgctgtattgagtactgaagggtaaaaatgtgtggttggtgttccgtgcggttcccaccgccacggtatcggatctgacgtcctcgcgccgctaacgcggtgccttcgcggcgttcgtcagcctgacgaaccagcggagacggtacttcctgtaccggctccgctttttgcccgcgtcctgcgggcaaattctggcttcctcgctctgctcagcgctgcgaattgtctgttccgctcccgtggcggtgggcacagtgacgcatgtgcgccgtttcggacggctatctgcagttttgaagcccggcgttaacacatcaggggaaccccctgctttctccttacttcatcacacccatccactgctgggcgatctgcgcatattccccggtcgcggtgctcagatgcagccactgatcgacatactgcttccagctcatatcatcacgcggaatcatataggccttttcgccatactggagcggtttatccgggttgagcgcacataacgtcggaaagcgtttttgctggtacagcgcctcggaggcatcggtgatcatcacatcggctttgttgtccaccagctgctggaagatggtcacgttatcgtgaaacagcgttaacgaggcctgaggtaagtggctgtgaacaaacgcctcgttcgtgccccctgctggctcaaccagacgcacgctggactggttcatctgttcgaccgtctggtacttcgttttatccgcacaacgcaccagcggaattttaccgtccacgcccaacggctgcgcaaaccaggcggtctgctggcgcttcagcgtgaccgatacgccacccagggcgatatcgcactgcttagccagaaagtcctgcgtcagggttttccaggtcgtgggaacccactgcaccttcgccccaagtgatgccgccagcgactgggccatactgatatccagcccctcatagctgccatcaggtttcagaaagctgtaaggcttgtagtccccggtggtgcagactttgagggttttactgctgaggatggtgtccagacgagactcagcctgagcgccggtcgccgccagcagtaacgtgattacgagtgtttttttcatcattatatttttttcgaagatgggtttgcgccgttatggtgacataaccccgctggttattgcgctattcgcaaaagtgttgtgatcattctcgcatttttctccggcacgtctccccctaagctatccccattgacgtataggggagagaagctgaatgagtaaaattttaattatcgatggcggtaaaaccttcgcccattctaaaggcgagctgaatcatacactgaccgatgtggccgccagccaactgcgtgatctgggccatgaggtgacgattaccgttgccgacagcgattatgtcgtggccgaagaagtgcaaaaatatgtcgacagtgacgtggtcatttaccaaatgccgggctggtggatgggtgagccctggaccgtgaaacgttacattgatgaggttttcaccgaaggccacggtaagctttacgccagcgatggacgcacacgtgctgacgacgccaaaaaatacggttcaggcggactgattcagggcaaaaaatatatgctgtccctcacctggaacgcgcccctcgaggcttttaccgaccccgagcagttctttgaaggcgttggcgtagacggactctatctgcatttccacaaggcgaatcagttcctgggtatggaagcattgccgacctttatctgtaacgacgtgatgaaacagcctgatgtcccacgcgatattgcacgttatcgcacgcacctcagcgagatttttgcttaaatagcgtttcatccagaaagaggaaaagtgaatgttaaccgtcgttgctgaaatttgtgtaaaaccaggctgtcgtcaaaaagtgctggatgcgtttcaccaggtgattcctaccgtgctggaagaagaaggctgtcaccagtacagccctctggtcgatcatcaggcgcaggtgccgtggaagcacaattcacccgattcggtttttatgctggagcagtgggaaacgctacgccatcttgatcaacatcagcagatgccgcatatggaagcccatcgtactgcgattaaagactatgtgactgacgtgaaaattctggtgcttgagccgggtaaatagttttttgcggcgcttacatgaaaaagccccggcgatggccggggctttttgcatctggcggcgaactacacttcaatgtccgctttatcgcctttttcctgtaaccagttgcggcggtcttcggaacgctttttcgccagcagcatatccatgacccgcaaggtctggtcaatatcatcgtcactgatggtgagctgtaccagacgtcgcgtattgggatcgagcgtggtttcgcgcagctgcagcgggttcatttcacccagccctttaaaacgctgcacgtttggcttgcccttcttgcgcttcagttgctccagcacgccctctttctcgtcttcatccagcgcgtaatacacttctttgcccagatcgatacgataaagtggcggcatcgccacatagacgtggccattttttaccagcgtacggaagtgcttcacaaacagagcgcagagcaatgtggcaatgtgcagtccatccgagtcggcatccgcaagaatacagactttaccgtagcgcagctgagacaggtcttcactgtcgggatcgataccgatcgccaccgaaatatcatgcacctcctgcgaggccagcacttcatcagatgagacttcccaggtattcaggatcttacctttaagtggcatgatcgcctgatattcacgatcgcgcgcctgcttcgccgatccgcccgccgaatccccttccaccaggaacagctcggttttattcagatcctgcgcggtacagtccgccagttttcctggcagggccgggccgctggtcagttttttacgcaccactttcttggccgcacgcatacggcgctgggcgctggaaatcgccagctccgccagctgttccgctgcctgcacgttctggttcagccacaggctgaaagcatcttttactacggcagacacaaaggccgcgcactggcgcgaggacaaacgctcttttgtctgccctgcaaactgtgggtcctgcattttcactgacagcacataggcgcagcgatcccaaatatcttccgcagacagcttaacgccgcgcggcagaatattgcggtattcgcaaaattcacgcatggcatccagcaagccctgacgcagcccattcacatgggtgccgccctgcatggtgggaatcaggtttacatagctttccgtcagcagctcaccgccttccggcagccacagtaacgcccagtcaaccgcttcaatatcaccggcaaaggtgccgacaaagggtttttccggcaacgtcggcaggccattaacggcttcacacaggtaatcggtcaggccatcgtcatagcaccagcgctgttcggtattgtttagcttgtctttaaagacaatttccacgcccggacacagcacggctttggctttaagcagatgggataagcgggataccgagaaacgcgggctgtcaaagaagtgctcgtccggccagaaatggacgctggtacccgtgttgcgcttggcaacggtgcccgttacggtaagatcctgcactttgtcgccattttcgaaggcgataaagtagatctcgccattacggcgcacgttgacttcaacacgtttggacagagcgttaaccaccgaaatgccgacgccatgcaggccaccggaaaactggtagtttttattcgagaatttgccgcccgcatgcagccggcacagaataagctccacggccgggacgccttcttccgggtggatatccaccggcatgccacggccatcgtcgatgacttccagcgactgatcggcatgtaaaatcacttctacgcgcctggcatggcccgccagtgcctcatcgacactgttatcaatcacttcctgacctaagtggttaggccgcgtcgtatcggtatacattcccgggcgacggcgaaccggctcaaggccagtcaggacctcaatgtcacccgcattatagcttgattgactcatgataactgtctgattagaagaagaaaatggttgcgatttccgcgttactcaagagtgattcaggcccagaaagtccagaatttgcgggaaatggcgctcgaatccagtaaatgcatgatttccgccctcttccaccgtatgacggcacgcgctgtagtagtcgagcgcctggcggtaatcgagcacttcatcgccggtttgttgcagcaaccacaataaatcaggtgcttccagcggttcaatctgcatcactttcagatcgtaaatgtggcgagactctaacacatattgctggccggtgtagggattctgattttcccctaaaaaatccaccagcaactcaaatggccgcacggcgggattgacgaccaccgcaggcaacataaagcactgtgacagccaggtcgcgtaataaccgcccagggaggagcctaccagccccatatcgcgcccgctgttgctcagcacaatatcttccagcatcgcggcggcatcggccggaaacgtgggaagctgcggcacaatcatctcaatatcaggatggttgtggctcagccactgtttaaacaacgtggcttttgctgaaagcggtgaactgttaaagccgtgcaggtaaagcagtgccttcatccgtcaatatccttcagcgtcaagatcgggacaaaacgcctgagtggtgagtcggttaacttccgtctctagctgaccgtcatcgtgcagcgtaaaccagcgccagcccggcgcaacggtatcaatagtgaagctggtgcagtgcggtttgaactgcacgcaggtggaaggcgttgccagaacgcgtcggccgtgccagtccacatccatttcctgatggatatggccgcataccaacgtctttgccagcggatagtgctgtaacacggcatcaagctgatgcggattgcgcaggctgtgctgatcaagccaggtgcagcctgaagcgagaggatgatggtgcagcagcaccagcgtatgacgcaggggaaagcgcgcgagcgcgttatggagccagtcaagttgatagtcgcttaacatgccatgcggcacgccgaagacctggctgtccagcagcaccacctgccagtgttcccccatcaggacatgtttatgggtgttaatcccggccttggccagcgtatctaccatcgcgggctgaaaatcatgattacccggcagccagacgcagggtttaggcaagcgcgaaatgccctcaacaaaatgctgataggcttcgaccgagtgatcctgagagagatcgccggtggccacaatgagatcataatcgcactgctgcgcgatgatcgcatccagcaccgcgtcataactcgaccaggtattcactcccagcagcgattcatgttttcctgcgaacaagtgtgtgtccgtcacttgcagaatccgaaactcggaccccgttgtcgcaggaagagttagcaggctatccaaagcgtttccttcgtctctacgccattcaatgcattatacgtatcagcaaaccggtactgccatcgcgccatgcgtcagacagtagcgtaaccagtcagcgaggaactgattgatttgatgtttttcatcacgctgattcatctttttattcgggtaatcataacgcgctttaaaccgatagatctgctgtgttgaacacacttcagcgaccatggcgtcatgatacagcctgacagacatcgacggcaggctccagtaactcaccgccgggaccgtctgacgaatttcgaccagcgtggtgtaacgggtggattcttcaatcgttaactgatagcgggcgccacttacctgatagatcaccgatgcgcctgcctcgtcatcgcgtggtagcagacggcgtaactgggcgaaattggtctcgcacagccgcatcatctcggggaaatcaggggtatagcgctgtttcatttttgcgtccactcttctcgaagttctttatggtgcagtgccagccattgcaaggcgatgacagatgccgcgttatcaataatcccctgttccatccagtggtaggcctgttcacggctgaccacatgcacgagaatatcctcattctcttcctccagaccatggcatcctgttgccagactggcatccacttcaccgaccatcaccgataaacgttcgctggtgccgccggggctggcaagatagttcaacacgggcttcacccggccaacgtccagaccggcttcttctaaggcttcacggcgtcctacctgttccggggtttcaccttgctcaataatgcccgcaatcatttccagtagccacggcgttgggctgcagtcaaaggccgggatgcggatctgttcaatcagcaccacttcatcacggatgggatcataaggtagcagtacggcagcatgaccgcgctcaaaaacttcacgggtcacttccccgctcatcccgcccttaaacagacggtgacgaaagcggtagcgaacgatggaaaaaaaaccgtcgtaggctgtttctcgtgcaataatttctacatcattttttgtgaaagtcacaggtgatgttttattgtccttcatcattgggttccttttgcagattgggatgacacagataaaacacaagcccaggcaccattcaaacagtcattactgagttatttacctgaaacacacaaatatggcacgttcagccaccttatctcacagttgccctctgctagaatctgcgataatttttggcttaccggcggcactatcattgcgatttgctgcaacaaaaggaatgcaaatgaaaaaactgctcccattatttattgggctgagcctgggcggtttcagcgtcgccagccaggcggaaaacctgcttcaggtttaccaacaagcgcgtttaagcaacccggatctgcggagttccgctgccactcgcgatgctgcgtttgagaaaatcaacgaagcgcgcagccctttattaccacagctgggtttgggtgcagactatagctatgcaaatggctatcgtgatagtagcggtattcattccaacacgaccagtggcacactgcaattgacgcaaaccatttttgacatgtcaaaatggcgcgcgctgactctgcaggaaaaaaccgccggtattcaggacgtcacgtatcaggttgctcagcaggatttgattctgaataccgccacggcctatttcaacgtgttgaaagctattgatacgctttcttacgtcgaagcgcagaagatgtccatctaccgcgaactggatcaaaccactcagcgcttcaacgtgggcctggttgcgattaccgacgtgcagaacgcccgcgcacagtatgacagcgtgctggcgaatgaagtgacagcgcggaataacctggataactcggtggagtccctgcgtcagatcaccggcatggactatctggcgctggcctcgctgaatatcgatcgctttaaaaccaccaaacctgatgacgttaactcgctgctcaagcaggcagaaagccgtaaccttaatctgctttctgctcgcctgaatcaggatttagcccgtgagcagattcgttctgcagagtcaggccacctgccaacgctcgatctgactgcctcaaccggcctgtctaacagcaagtacggcggaagccgcgctgaacagagtgcaaactcaaccgactcgattaccggaaacagtaaagtcggcctgagctttacgcttccgctatacagcggcggcagcgtgacctcgcaggtgaaacaggcgcaatacagctttgtcagcgccagcgagcagttggaagcggcgcaccgttccgctgtccagacggtgcggtcttcttacaacaacgtaaatgcgtcagcgagcagcattgcggcctataaacaagccgtggtttctgcgcaaagctcattagacgcaatggaagccggttatcaggtcggtacgcgtaccatcgttgatgtgctgaacgccacctcaaccctgtataacgcgaaacagcagttgtcagatgcccgttacagctatctgattaaccagctgaacatcagctatgcgctgggtacgctaaacgagcagagtctgggtattctcaacagccagttaggcaaagagatctccacgtcacctgaaaccgttcagccgcaaaacgttcagcaggtgttgggtgacgatcatatcgcgtcctcttcagaaaccgccacggcgccagtgcgccctgcggcccataagagcagccgtaatccattcggtcactaatcaggttgcgggctgctttgcggcccgcttctcttaaaaacgtataactaagtaaagatccccgtcctgcctggccgttagcttcatttctcgccactcatcccctattctatgcgctacctttgggcacaggatatttataatgaaacggactaaaacgatccgctatgccgcctttcgtaagagctggcaagcaagacacttaacgcctgttgctatcgctgtatcagcggtatttatgctggcaggttgtgaacaaaacgatgaaaccgtctcgctttatcagaacgctgatgattgcgcaaaagccaaccctggccagaatgcgcaatgcaccaccgcgtttaacaatgcgaaaaaagaagctgaacgcaccgcaccgaaatacgcaacgcgtgaagactgtgtggcggaatttggtgaaaaccagtgtcagcaggcacctgctcaggcgggcgtgggcagcactaacgccgagtcgcagcaaagcggcagcttctggatgccattgatggcgggctatatgatgggccgcatgatgggtggcggagcaggttttgcgcagcagccgctgttctcacctaaaacgccaaacagcccggctaatggtcagtttgtcgatgcttccggccgtaactacggtaacgccacttccggtaaaaccatgacggttcctaaaaccgccatggcgcctaagccgaccacgacctcaaccatcacgcgcggtggctttggtgaaacggtcgcgaagcaaaacagtatgcagcgtagcagtgccaccggcacctctaatcgttcgctgggaggctaaacccgtttatgcaacgcatcgcgatttcagagcgcccgggctggcgggaaaaagccacggagtttggttttcgttttcacaccatgcacggtgagccttactggtgtgaagatgcttactatcagttcacgctggcgcagattgattatcttgaggacgtcaccgccgagcttcatcagatgtgcctgcaggtggtggaaaaagtggtgaacagcgaagcgctgctcaccaaattccgcatccctaagcacacctgggacttcgtgcgcgactcatggcaacaacgtcagccttcgctttactcgcgccttgaccttgcctgggacggcaaaagcgatgccaaactgctggaaaacaatgccgacacgcccacgtcgctgtatgaagcggcgttttttcagtggctgtggctggaagatcagctcaacgctggacagctgccgcaaggcagcgatcagttcaacagcctgcaagagaaactcatcgaccgctttacggtgcttcatcagcaacaggggtttaactggctgcatttcgcctgctgccgtgataccgatgaagatcgcggcacagtgcaatacttacaggactgtgccacagaagccggactaccgagcgagtttctctacatcgatgagatagggctgggggagaaaggccagtttacggatgcccaggatcaggtcatcagcaacctgttcaagctttatccgtgggaatttatgctgcgcgagatgttttctaccaagctggccgatgcgggcgtacgctggctggaacctgcctggaaaagcatcctgtcaaacaaagcgttgctgcctctgctgtgggagatgtttccgaatcaccccaacctgttgcccgcctggtttgccgaagacgatgtgccaccaatggacaagtacgtcgtcaaaccgctgttctcgcgcgaaggtgccaacattcgtattgtggaaaacggcaaagagatcgcccgtgtggacggtccttacggcgaagaaggcatgatcgtccagcagtttcaccctctgccgaaatttggtgacagctacaccctgattggcagctggttgatagacgatcagcctgcaggcattggcctgcgtgaagatcgcgacctgatcacccaggatctttcgcgtttttatccgcacgcgttcatcgattaactgttcttatccaggccagtacgctggcctgttttcacgctagccgacctgcaccgacaacatactgatagcgcccatttccataccttcgacagggacggtgacggcctcgtctgcatggcgagatcccagcacatacagcagcggcaggaagtgttccggcgtcggattagataacgccgcatccggatgctgcataaaattcaccagcggatgtgcatctgcctcggcctgaaccgccagattatcgcgcacatagtcgttgaatccggtcgcccagtcataagcgtttccgccgccccacagaaccttacgcaggttgtgcacgacattgccgctggcgacgatcatgacaccgcgatcgcgcagttcagacagcttttttgcccatctcaaaatgccaggccgcaggcttgccgctgtcgatactaagctggactaccggaatatccgcctcaggatacattttaatgagtacgccccacgagccgtgatcgaatccccatgcatggtcctgataaaccggcacaggcgataatatctcagcgatttcgtttgccagttcaggtgaacccggcgcgggatagcgggtatcaaaaagcgcctgcggaaaaccgccaaaatcatggatggtgcgcggcttatccatcgcggtgaccgccgttccctgggtgtaccagtgagccgaaatggccaggatcgcccgtggtcgtggcagcgtggcaccggcttgacgccaggcttcggtgtaacggttttcttctagcgcgttcatcgggctgccgtgtcccaaaaacagtgccggcatacgtacctggttcatagcgatccttaatatgttcactcaatgaacactacgatacgctgtttgcagacgttatcacgcggataagcatgatgttgtctttcaggaaatttgaataatatggaagggtacaaaagagggaaaaacaggcggtgccaggtgaaacaatcaggccagaatatctggcctgatgagaaaacgcttagctggcctgacgcgtttcatgctcgcgacgataggcgaccaggtcttcgatggtaaccaccggcatagcatgttgtttcgcgaagacgatgacttcaggcgcatgggccatcgagccgtcgtcgttcgtcagttcacacaacacgcctgcaggtttaaagcccgccagcgtaacgagatcaatggtcgcttccgtatgaccgccacgggccagaacgccgccatcgtgtgcacggagcgggaaaacgtggccaggacggtttaagtcttctggcttagcgttatcggcaatcgcggtacgaatagtggtgagacgatcctgggcggaaacacctgtggtaacgcctttcgccgcttcgatggtgacggtaaaacccgtgccgtaggcgctggtattgttttccaccatcatcggcaacgccagctgctggcggcgttcttcggtcaggcaaagacatacgataccgctgccgtggcgaatggtgagcgccatctgctcgacggtcatggtttcagcggcgaaaatcatatcgccttcgttttcacgatcttcatcgtcgagcaccatcacaccgcgaccttcgcgtagcgctgcgatagcacgttctacacgctgtttcggcgtgccaaattcagaaagtagagtctgattcatggtaataaaaccttataaatgtattgggttaccagaatcagggcaagcttaggagtgacgccttaaagacgtagcaatgacgcaaaacagacataatgcctgacaaatgtcgttaccctctcccatccggactttaaccgtcggccccggaatttcaccggatctgctgaccttcaccatgagagtgaagcgctcgcgggctgtcagcctgggctgatttaccgccggtggggaatttcgccccgccctgagaataagcgttttaactataacgcttcccattcggggcggcaatgcagaaagccattattgctttagcattttttgcgctaaggatttcaggtttaaccttttcaattcaggcattacacttaagtcaccatagcgttggtaaaatgctgccatagcaacccgtaatcaggaaaccatcatgatcgacacgaaaaaaattgaacaaatggcccgtcaggttcatgacgcgctgccgaagggagttcgtgaatttggcgatgatgtcgagaagaaaatccggcagacgctgcaggcacaaatgacccgcatggatctggtcaaccgtgaagagtttgatgtacagactcaggtgttactgcgtacgcgggaaaaactggcggcgctggagcaacgtctggctcagctggaaagcaagagttcggcttctgccgcgcccactgccaccagcacacccggcccggcaccggcaatcgttccggcagccaaccctgctgacaagaccgctaaataaagggatggcgggcgcgcaggctcccgccatcatcattcagtcgccgcgaatggttttgatgatgttggtggtcgagataccatcttcaaaattgagcacgcgtacgtcaccgccatttgcccagacttctttactgcccgcgatatcttcaggtttgtaatctccgcccttcactaacagatcgggcagcacgctggcgatcagacgctgaggcgtgtcttcttcaaacagcaccacccaatccaccgcttccagcgcacccagcacaatcatgcggttttcctgcgggttcaccggacgactgtcgcctttcaggcgcttagtggacgcatcgctgtttaccgcgacaatcaggcgatcgcccagcttgcgcgcgttggcaaggtacgaaacatgcccggcgtgcaggatgtcgaagacaccgttggtcattaccactttttcgccgcgctgacgtgccatcgcaacggcgtctttgagttcagcttcggtcataatgccaaagccgcgttcaggacgcgcgcgaatcgcgttttccagttcgacgatactgacggtcgaggtgccgagcttgcccactaccacgcctgcggcggcgttagccaggaaacaggcttcttccagcgagtcacctgccgctaatgctgcggccagcacgccaatcacggtatcccccgcgccggtaacgtcaaaaacttcctgcgccagcgtaggcaggtgcagcggagccttaccgggctggagcagcgtcataccgttctcagaacgggtgaccagcagggcggaaaggtcgcagtcggcgataagctgcataccacgctcaacaatctcgttttctgttttgcacttgccgaccacggcttcaaactcagacaggttgggcgtcagcagcgtcgcaccgcggtagcgcgcaaaatccgtgccttttggatcgatcagcacgggcacattcgcttctcgtgccagcgtgatcatttgctgaacgctgtccagcgcgcctttgccgtaatccgacagcaccaccgcaccgctgcgggacagcgactgacgcattttttcgtgcatcggggcggcatcaacctgctcaaacccttcttcaaagtccaggcggataagctgctgattgcgcgagagtacacgcagtttggtaatagtgggatggctttttaacgtgacaaaatcgcagtcaacacgaacatctttcagcgttttactcagtacctgagccgcatcgtcttcaccggtgagtccgatcagacgggaaccggcacccagcgcagcaatgttcattgccacgttagcggcgccgcctggacgttcttcaacggtttctactttcaccaccggaaccggggcttcaggagaaatacggctggtggggccgtaccagtaacgatccaacatgacatcgccgacgaccagcaccgaggcctggccgaacgcgggcagagtaactttcattccagacactccagactgcattcaaaatagtgcgcggatgataacacagttgcgacaggtgctatcagcctcacgccgtgagagattgtggtgactgtagccagcgctgccagctgccgttcaccgcctgtttttcctgcgcgaatgcgtcgggctcaacgtgccccggctgctcctgaagcgccagatgatgcagcgcatcgcgcagcgtgacataagcatgggtaagcgcagccgcttcctcatctgacattttctgatgggtggccatcagttcaaaaatccgcacattgtccgaccagcgcgttaaggcgggctgcgcggccgcgtaacgcagcaccagatactgcgcgataaactcaatatccgtaatgccgccttcgtcggttttgatttcccagcggcctttgtgcttattactcagatgcgcgcgcattttgtcacgcatctctctgacgtcggtttgcaacgccgttgcgtcgcgaggcaggcagagaatggcacggcgaatggcgctaaagcgctcgctcaaggcgggttcaccgaacaccacgcgggcccgaaccagcgcctgatgctcccatgtccaggcttcattgcgctggtagtcgtcgaaggcttcaaaggtgctgaccaacatgccagccgcccccgacggacgcagtcgcgcatctacttcgtacaaaataccggacgaggtgcgggtactgaacagatgcatgatgcgctgcgccagccgcagataaaactgacggccgtcgatgctgcgttctccctgcgtgaccgcttccagcgggcagtcatgcaggaaaaccagatcgagatccgagctgtagcccagttcccatccacccagcttgccgtagcccaataccgtgaagccccgttcgtgctcatgcacaaggtgtgacggtcggccatagcgctgtaccatcatattccatgcctgttgcaccaccgattcaatgatggcttcggccagccaggttaagtgatcgctcactttcatcaccggcagcgtgcctgcgatgtctgccgccgcgatgcgtaacagctgtgcctgtttaaactggcgtaatgcttcaagctgctgttcttcatcatcagcgggaatgcgcatcagatactgacgtagctcatcacgataggcatcggtggcggtgggttgatacagcgtggcgggatcaagaagctcatccagtagcaggggataacgcgccagctggcttgccaccatcggcgaggccgcacagaggcgaatcaggtgacgtaacgcaccggggtactcggtcagcagttcaagataggtgctgcgggtcagaacgctcagcagcaacggtgccagtcggctgaaggtcactgcggcatcgctgcgcgaacacacttcactcagcagccgtggcatgagctgatccagcgcctggcgaccacgcgggccgatggtacggcggctgatatcctggcgaaacgcctccagcgcctgattgagtgcctggcactgcgcggtatccagctgcggcaccagcggcgccagctcactgtcctccagactgtcctgccagagcatattgaaatcggccagttcggggcgatcgccaacatccggtgtatcttccccgatcagctcatcgaaaatggcccgcacggcggccatgtgcgcgtccagctgtgtgctcagcatggaccagtcatcacactgcatcgcccacgccagacgggcgcgcggtaatgcctcttccggcagcgtttgcgtttgctcgtctgtcaggctttgcagcaggttttccagcctgcgcagaaacaggtaggcagcgcgcagtgcagcaacctgttcaggtggcagcaatgccagggattcaatagccgacagcgtgggtaacaaggctctgagctgaagcgagcgctcacgtccaccgcgaatcagctgaaacacctgcacgataaattcagtttcacgtatcccaccagcccccagcttgatattgtttttcagcccacggcggcgcacttcgcgcgagatcatcgctttcatattacgcaacgactggatcacgctgaaatcgatgtaacggcgatacacaaagggccgcagcatctgctgtagctcctgactccagcgatcctgctcatcgcccatcagccgggctttcaccatcgcgtaccgctcccagtcgcggccctgctcctggtaataatcttccagagcggcaaagctcatgaccagcggcccgctgtcgccaaacggacgcagacgcatatccacccggtaaacaaaaccgtccgccgtgggctggtcgagcaccttgatcaggcgctggcccatgcgggtaaaaaactgcgcattgtcgagttcacggcgaccgccgcgcgtcgtgccgttttccggccaggcaaaaatcaggtcgatatccgacgagaaattcagctcgccgccgcccagcttacccatgccgaggatcagcagcggctgtggctcacctgcggcattgcagggcgtgccaaactcgcgacagcagtcctgataaacccaggcgcgcgcggcgtcgatcagcacctcggctaacacgcttaactgttgcagcgtctgctctgtcgtggcgtgatgtaagcactgcatccaggcaatgcgaaccagcatgcgacgacgaaacaggcgcagcacgcgcatcaggctggcttcactgtccaccgctgccatgtcactgcccaaccactgcgtatactgctgccactcgtcggcctgaggcgactgcgcggcgatcgcttgccaccagtccggattctgctgcaggttatccagcacaaagtcgctgaacgccagaccggcaagctgtgcctcactcagggcggaatccgcaagcccgagctgttcgacagcctgcgcggcctgcgtgcgcaataggttgggtaaggatggcaacatgttctctccctgatagcgtgcggtatgactcagcgtggcgaaccgctggttagccaaaatggtggctgtttcatggcctgggcctttaaccaatccaggctggcgtgctgctgctccctgattgcgcgctgcaactgctgccacggtgccagccagtcgtgcactgcgtccggcgagtaggcgcccgccagtaaatggaccgccagcaactgccgatccagacgtgtggccttgtcctgatactcgttagtctggtgaatcgtgctgaaggtttctttcaggtcggcattgatgcggcccagcataatatcgccaaagcgtttaaaggagccgttcagcttggtttgtcctttttcatcaatccactgccgccagtgcgactcggctaaccagtgagtaagtgctaactgggtttcaacagagaggacagaaaaacagaagctgtcggcgtcaacatcctcgttcaacagcgtctcttccagcgtagtgagtttctgacgcagctcgctgctggccttgcgcggcactaacgcaccaaacagcgcgaatgcctgacgcagcacatccagcgcctcacgcaccgcttccctggcccgcttgttgccacgcagccacacttcttcatgatattgccagtggtcaagacctgccgccatggccgcgaccatgccctcttccaccgtggctttcggccccgcttttaacagcggaaagggttttaactcacgcggcggattgcctttcgctaactgataaccacgtgcagccttgctcaggctgcccatccgcagatcgcccacggcaattaactgccgggcaaacgtcagcatctcgctgcgctggccgccttttagctcaagctcaacctctgacaagggttcactaaactcccccgccgtgacttcgccccgatcgcaggcaatttcgacgtcactgctgcccgccgtgaccacccagatctcacgttcaaaatgggtgctgaacagcggctgcaggcgctgttgtaatgccgcaacgtcggtgccttccggccagatgtcggctggcagacggctgatgtccagcgtcggttcggtcagatcaacgttgtattcgcctcgctgatgtagcccgcccagcgttgtgccagcggttttcagcgtcatttcgtagcgctggtccacgccacgaatgcgtaatcccatattccatcgacgtaactggttatcgtcggtttcaaaatagatattggtcagctgacgggcagcctgatgctgatgcgggaatgccgccagccgttctgccagtttcccggcagcatttggtttagcaatgaacttaagctcgatctcgatggtcatatttttttattcactaacgccgctggtacttgaggatatattccctacctgtttcaggttatcttctgctgcatccactgagctgaaggttaggggttttcaggcgaagagtaatgcacagaagccgggctgtctctgctttctttgtgctttcgctacccttttcgcactgtcatgagaccaggatagttctcattcagatttatgcgaagcctctacagactgtgccggtaaattatcttcattttaagcaaaacgaaatctaatgaaaaaaatcacactcactggaatcactttgctggccctcagcacccttgcacctgctcacgctgatgaaaaacgttacgtttctgacgaattatccacctgggttcgcagcggccctggcgatcagtttcgcctgctcggcaagctgaacgccggtgaacaagtccagttgctgcagaccaatgacgccaccaaatatggtcaggtgcgcgatgccgaaggccgtaccgtctggatcccactgtcgcagctgagtgaaaaccccagcctgcgcacccgggttccacagctggagcaacaggtgaaagacctgacggctaagttagcgaatatcgataatagctggaaccagcgcacggcagaaatgcagaataaagtcgccagcagcgacagcgtgattaacggcttaaaagagcaaaatcagaaacttaaaaacgaactgattgtggcccagaagaaagtcagcgccgccaacgttcagttggatgacaagcagcgcacgatcatcatgcagtggtttatgtatggcggcggcgtgctcggtgtgggcctgctgctcggtctgctgctgccgcatatggtgccgcgccggaagaaaaacgatcgctggatgaactagtctgcaccacagctcgctatcaggggatcgccagatgccccttttggcctgtctgcaatatgccgaatttgtgcaacaatagagttcgtgcccgtctggattcaggtgccggaagcccccggacgcgcagttcacttatttatctctggagttgtgcgtgaagacctttcttgttggcggcgcggtacgtgatgcgctgttgaaattgccggttaaagacaaagactgggtggtggttggcgcgacgccagaaatcatgctggaacaaggctatcagcaggtaggccgcgatttccccgtgttcctccatcccgacagccgggaagagtacgcgctggcgcgtaccgagcggaaaaacggcaaaggctataccggttttaccacctggtcggcaccggacgtcaccctggagcaggatttacagcggcgcgatttgacgattaacgccatcgcccaggatgagaagggtgagctttatgatccctatcacgggcaacaggatatcgctgcccgtcagctgcgccacgtgtccgatgcctttagtgacgatcccctgcgcgtgctgcgcgttgcacgctttgccgcgcgctttgcccatctcaacttccgcattgccgatgaaacccaggccctgatgcaacaaatggcggagagcggcgaactggccgatctcacggccgaacgcgtctggaaagaaacggaaaaagcgctctcttcgcataatcctcaggtctacttccaggtgctgcgtgactgcggtgccttacgggtgctgtttccggaaatcgataacctgtacggcgtccccgctcccgccagatggcaccctgaaatcgataccggggtgcatacgttgatggccttaaccctgtcagcggccttatcagacgctatcgacgtgcgttttgcgacgctgttccacgatgtcggtaaggcattaacccctgtcgaaaaatggcccagccatcatgggcatggcgcggcgggcgtaccgttggtcgccgcactgtgccagcgtttacgcgtgcccaatgcgattcgtgatttagcgctgctggtgacggagtttcacgacatgatgcataccattgagcagcgccctgctgaatctctggttgcgttatttgaccgtcttgatgcctggcgcaaacccgaacgggtgaaccaactggcgctgtgtagtgaagcggatgcccgcggacgcggtggtcttgccagcatgccttatccgcaaggcgattacctgcgacgtgcgtttgcactggctcaggcggtgtcctctaaggcggtggttgaggcaggatttaaaggcattgaggtgcgggaagagttaacgcgacggcgtattgccgcggtcgaacaacgcatagcttaacgcggccagtcacccggccgcgtcataatggcttacatgaaaatcatgtagaccgcacccgccacgataaagcggtagatggcaaacgacacgaaagagatacgtttgatcagttccaggaagactttgatggccagcagcgcgacaacaaaggcggtgataaagccaacggcaaacatcgggaagtcggccatcgacaggaagccaaggcttttatacagatccagcccggtagcacccatcatcatcgggacggccaggataaacgagaactcggatgcggcatagcggctcacgcccatcagcatcccacctgaaatggtggcacctgaacgcgagaagcccggccacagcgccagacactggaagcagccaatcgcaaatgcctgaagataggtaatatcatccacgccgacggcttttggctgtttgggtttcaggaattccgccgccagcagcagtaagccgccgaccaccagcgcatacatcacgttaatcggattaaacaaggttttaatctgatcgtgcaacgccagcccgaccaccaccgcggggatcatccccaacaggatatgaatcagggttaagcggcccgttcccacgccttcgtgtttgacttcaccaaagtggataccgattaatccaaacaaacgccgccaaaacatcacgaccacagcaagaatggaacctaactgaatgacgacctcaaaggtttccgctttatcgccctcaaagcccagtaggtgccccactataatcatgtgcccggtggaagagaccggtaaaaactcggttaacccttcgaccacgcccaggattgcagctacccacagctgatgaagatctgccatcaatgtattccctctgtccgttttaaaaccattaaaaaggcgctagcagcagcgctatcgccttaatcttatctgcttcactctgagtaaaaccttaagctcaatcgccgtttagtcagtcgcaacgaaacggcaccacctgagacagacaataatttggtttggtttcattgtgatggcaatcacatcgtaattatttaggaatagtcccgcgctgaatacgcacgccaacctgcgctgcctgcgccacagcgcccggttttgctaccttgatgcgcacaccaggcgaattgaaacggttcatcaacagatccgcgatttcttccgctacgcgctcgaccagggcaaaacgctgtcctgtcagatgcgtcaggatcgcgtcggagacgtcggcatagctcaggcagtctttcacatcgtcgctggcggccgcctggcggttatcccacgccatctctacatcgatcaccagcttctgctgtattccctgctcccagtcataaacgccaatggtggtgaagacggtgagttgttcaataaagacgatatccatgatgatgctctctgtttttggtcgcgccggataccacttccggcagattgtgcgtattatccatgcttgacgtgatcaaaacgaccccaaaggaaacgggacggtgttatgagtgctttcgcgcttggtatgattattttcgcgtatctgtgcggttcaatttccagtgccattctggtctgcaaacttgccggtttacccgatccccgcacccacggttcaggcaacccgggcgcaaccaacgtgctgcgtattggcggcaagctggcggctgcgtctgtactggtgttcgatattgtgaaaggtatggtgcccgtgtggctggcgtacctgtttcatgtctcacccctttatctgggcttaacggcgattgccgcctgtctgggccatatttacccggtgttctttcgctttcgcggcgggaaaggtgtggcgaccgcctttggtgctatcgccccgattggctgggacctgaccggactgatgacgggaacatggctgctgaccgtgctgctgagcggctattcatcgcttggggcgattgtcagcgcgctgattgcgccgttttatgtctggtggtttaaaccccagttcacctttccggtttctatgctctcctgcctgattttgctgcgtcatcatgacaatattcagcgcctgtggcgcggtcaggaaagcaaaatctggaagcggaaaaagaaaccctaagcgtaaaaaaagccggctaaccggctttttgattttcaaatggcgggcagttccgacagtggccaacgcggcctgacgctgacgccaagctcaccccgcgtaccgcctttaaggcgtaccatgccagcataagcaatcatcgcgccgttatcggtacaaaactcaggtcgggcataaaagacttctccgccgcgcttttgcatcatcacggccatctgctcgcgcagggtacggtttgcactgacgccgcccgcaataaccagacgcttaaagccggtttgatccagcgcgcgtttgcacttaatcgccagcgtatctaccaccgcatcttcaaacgcccgtgcgatatcggcccgggtttgctcgtcgtcgtcattgccacgaatggtattcgccgcaaaggttttcaggcccgagaaactaaaatccagcccaggacgatcggtcatcggacgcggaaacgtgaatcgcccagcggtgccctgctgcgccattttcgccagcattgggccgccaggataatccagccccagcagtttggcggttttatcaaaggcttcccctgccgcgtcgtcaatcgactcgcccagcagttcgtattcgccaatgccggtgacgctgattaactgggtatgaccacctgaaaccagcaatgccacaaacggaaacggtggcggattcgcttccagcatcggtgccagcagatgcccttccatatggtgcacgggcacggcaggaactttccatgcaaaggccagcgcgcgcccaatcgtggcgcccaccagtaatgcacccaccaaacccgggcctgcggtatacgccaccgcatcaatctgctgcggttgcaaacccgcctctttcagcgccgcctggatcaggggcaccgttttgcgtacgtgatcgcgcgatgccagttccggcactacaccgccgtaatcggcatgcagttttacctgactgtatagctggttggccaccaggccagcctcgtcatcatagattgcgatgccggtttcatcgcacgatgtttcaatacccagaattcgcatggcttcacctcattcttgcggcgcgcagtttagcatagcccttgagtgaaaagaggaccccatccacgcaaaaagtcattttccgctgcctaaagagtgcgctatacttccgcccctggaaaaaaccggcagccgcacaggcaatcgctcctgttggttctaaattatccatggtgctttacaagccgacgcgagttggagtaaaatgctgcaccattttgaaatgtgctgacgccgcagtcagcagcaaaaccgaattttattgaggtgagagttacatgccggtaattaaagtacgtgaaaacgagccatttgacgtagcactgcgtcgctttaagcgttcctgcgagaaagcaggcgttttagctgaagttcgtcgtcgtgaattttatgaaaaaccaacgaccgaacgtaagcgcgctaaagcatctgcagttaagcgtcatgccaaaaaattggctcgcgaaaacgcacgccgcactcgtctgtactaatttcccggaggttcgcctccacagcgtgataaacgcagaccgagtcaagtaaaaggccgtgctttccgaaaggaagcgcggcttgttgtcgtttatgagctgaaaaaacggggcttatggcaggacgaattccacgcgtatttatcaatgacttacttgcccgcacggacatcgtggagttaatcgatgctcgcgttaagctgaaaaagcagggaaaaaattatcacgcgtgctgtcctttccataacgagaaaacgccctctttcaccgtaaatggcgaaaagcagttttatcactgctttggatgcggcgctcacggtaacgccatcgattttctgatgaactatgatcggcttgagtttgttgagagcatcgaagagttagccacatcccatggtttagacgtaccttacgaagccggcaacgggccaagcccgatggaacgccatcagcgccagagcctgtaccaactgatggaaaacctgaacgggttttatcagcagagtttgcagcaatccagcgcccagtcagctcgcgattatcttgaacatcgcggtctgagcgccgacatcatcaaccattttgcgattggctatgcgcccgccggttgggacaacgtcctgaaacgctttggcaaacagcctgaagatcgcgagtcgttgatggaagcaggcatgctggtcagtaatgacaaaggccgggtttatgaccgctttcgcgagcgcgtgatgtttccgattcgcgataagcgaggccgcgtcatcggctttggcggccgcgtgctgggtaatgatacgcctaagtatctgaactcacctgaaacgcctgtttttcataaaggccgtcaactttacggtctgtatgaagcgttaaaaaatcatcctgaacctaaacgcttgttggtggttgaaggttatatggatgtggttgccctggcgcagttcggcgtggattacgcggtggcatcgctgggaacatccacgacggctgaacatattcagctgctgtttcgcagtacggacaacgtgatttgctgttatgacggcgatcgtgccggacgtgaagccgcatggcgtgcacttgaaacagcattgccttacatgaatgacggtcgtcagctacgctttatgtttctacccgacggcgaagacccggatacgctggttcgccaggagggtaaagccgcatttgaggcgaggatggagcaggcgatgccgctctcttcgtttctttttgacagcctgctacctcaggtagatttgagctctcgcgacggcaaagcacgtttaagtacgttggcgctgccgttgatcacacagattcccggtgaaacactgcgcatttatctgcgtcaggagctgggtaacaaattaggtattctggatgactctcagcttgaaaagctgatgccgaagcaggcaccgggcggaagcgcaccggtggccccgccactcaaacgcaccacaatgcgtgtattagtggcgctgctgatccagaatccgcagttggcaacactggtgccgtctctggatgggcttgccgagtcgaaaatggccggtttaccgctatttatcgaattagtgacgcgttgtaacgagaatcctggattgaccacaggtcagctactagagttatatcgcggaacaaattttagccagacgcttgaaacactggccgtttggaaccacatgatagtggatgaggaaagcgaagcggtatttcaggactcccttgcgagcatttatgactcggcactggaagaacgactggagttcctgattgcgcgtgaacgcacgcacgggctgagtagcgacgagcgccgcgaactctggacactgagccaggccttcgcgaagaaatgatgcattatccggcctgctgcttcctgtaaccgaagcggcaggcttaaaaatttgatgggcgaagcacgttttgtttctgtgccgttaccttagcgtactcaagtacgtgaggatgacgagcacgtccagaagcaaacatggcgagtaagccagcttacgccctcgggccgtcggcggcgaagcacgttttgtttctgcaagcgcgcagtcaccggagcgtactgaagtacgtgaggatgacgagcacttccagaagcaaacatggcgagtaagccagcttccgccctcgggccgtcggcggcgaagcaagttttgtttctgcaagcgcgcagtcaccggagcgtactcaagtacgtgaggatgacgagcacttccagagacaaaaatggcgagtaagccaggcccgacataaaatttgcggcttaagtgccgattactaatgggcaaagcccaggccgcgacgaaggcagcggcaagaataaaggccttcactgctattgttggcacgctgccgaccgacaccaatctaattaacagaagtgtggataccgtcttatggagcaaaacccgcagtcacagctcaagcttcttgtcacccgtggtaaggagcaaggctatctgacctatgctgaggtcaatgaccatctgccggaagatatcgtcgactccgatcagatcgaagacatcatccagatgattaacgacatgggcatccaggtggttgaagaagccccggacgccgacgatctgatgctgaatgaaaacagctccgatactgacgaagatgccgcggaagctgccgctcaggtattatccagcgttgaatctgaaattggccgcaccactgacccggttcgcatgtatatgcgtgaaatgggtaccgttgaactgctgacccgcgaaggcgaaatcgacattgccaagcgtattgaagacggtatcaaccaggttcagtgctccgtcgctgaatatccggaagccattacctacctgctggatcagtacgatcgcgttgaagcaggtgagtcgcgcctgtcagatttaatcactggctttgttgatcctaacgcagaagaagacctggcaccgaccgcaacgcacgtcggttctgagctgtctgaagccgatcgtaataacgacgatgaagaagatgaagagagcgatgacgacagctcggatgacgataactctatcgatcccgaactggcacgcgagaagttctctgacctgcgcacccagtacgaaaccacccgtgatgtgatcaaaagcaaaggacgcagccacgctgcctctgttgccgagatccagaacctgtctgacgtctttaagcagttccgcctggtaccgaagcagttcgactacctggtgaacaacatgcgtgaaatgatggaacgcgtccgtactcaggaacgtttgatcatgaagctgtgtattgaagtgtgcaaaatgcctaagaaaaacttcattacgctattcaccggtaacgagaccaacgagagctggttcaaagccgcactggcgatgaacaagccctggtctgaaaaactgctggacgtgcaggatgatgtgatgcgctctctgcagaaactggcgcagattgaagaagaaaccggcctgaccatcgagcaggttaaagacatcaaccgtcgtatgtcgattggtgaagcgaaagcgcgtcgtgccaagaaagagatggtcgaagctaacctgcgtctggtgatttccatcgcgaagaaatacaccaaccgtggtttgcagttcctcgacctgattcaggaaggtaacatcggcctgatgaaagcggttgataagtttgaataccgtcgcggctataagttctcaacttatgccacatggtggattcgtcaggctatcacccgttctatcgctgaccaggcgcgtaccatccgtattccggtgcatatgattgagaccatcaacaaactcaaccgtatctcgcgccagatgctgcaagagatgggccgtgagccaacgccagaagaactggctgagcgcatgctgatgccagaagataagatccgcaaggtgctgaagattgccaaagagcctatctctatggagacgccgattggtgatgatgaagattcacatctgggtgattttatcgaagacaccacgctggagctgccgctggactctgccacctctgagagcctgcgttctgccacccacgacgtgctggctggcctgacagcgcgtgaagccaaagtgctgcgcatgcgtttcggtatcgatatgaacaccgaccacacgttagaagaagtgggcaaacagtttgacgttacccgtgagcgtatccgtcagattgaagcgaaagccctgcgtaaactgcgccatccgagccgctcggaagtgctgcgcagcttcctcgacgattaagtcagttaaaaccccggttcgccggggttttttatttctgccgccctgccccacttttcacgcgttagcttcagcctcgtgtcttcagcgcatcgtacatctgacgatacatcgccacgatctcttccagcgatgcacgatttaacccactcggattcggcaacacccaaacctgggttttccccatgtagatcggctgctcgccccattccaccttgctctgacgaaacgcgcgtttaaaggcatctttgcccaggatagccaacgcagcaggctgataacgcagcaccttatccatcagccgctgaccgccatcacgcagctcatcactggccagttcattcgcctggatggttggacgctcgaccagcatcgtgataccgcagccggtttccagtaagcgctgctcctcttccggcttcagttgctgctcggtaaaccctgccagatgaatcaccttccagaagcggttgccgggatgggcaaagtgatagccggtgtgcgccgtcgactgaccgggattgatgccgcaaaacagcacgttcagatctgatgcgatgatatcgctaatgttgtgttcgctcatgttgcctcctggctttgcgcctgcgcgcctcactgtcgctcacgcaaagggtccttgtttgacatcgtcttgtcactgattaaagcgcatttggcgggcagcgtcgtggtttgggttggcttttttcactgttaagcagggaaagacaattaaggataaccgcgccggttatgtcgccgcctgtcagccagaggtttttgtctgttttatcatagttatcagcaagtaaaacattgctgcttatttcagcaaccagccgatcaacgctggattgccccggacagatactttataatccccgctccattggccccttagctcagtggttagagcaggcgactcataatcgcttggtcgctggttcaaacccagcaggggccaccagatttagtgattaaaatcatgcagttaagccacctcgcaagggtggcttttttgttggctatagtctcgatggcagcaaaatggcagcagactttttttgcatatttcaatgtccatcaacttttctcttgcgaggggcaaaaaaaaacccgctaagcgggctttttttacatccataagacttgctgagaacctcgatcagggtggggcggaacgctagccacttttcctggtgtcatgattatgtcagtcacagtttcatgtgatttaaaggtacaactgcagttaatgttctggcactggttataacgctctttagtattcttagatacctgaaagctacttctcgtgtgtgcggcattaccacacataggacaattcatcatcgcttaagccccatcgcatttttaatcaattatacacaaacatttgttttgagatacatctcattccatttgaaatgaatcaattttcacttccaactctatgctggtcgtgtagccgctgtcggcgctcaggctgtgcgtcagcgtggtaatgatccattcgcaatcatcaatctgctttttaaaccctgtcacttttaccggcatttcggtgtaaagctcagcacgcccgcgcgccagctggatcgagaaggttgctacaccgcgctgcagacgttcccagtgcatttttgccgcccgctcggcgtttgcccggttggcgtaggtgcggctcagaaccaacacgttctcatcagttccgacaaggtaatcaccctgtttttcctccggctctttcttttttttactggctgttgtcgtcctgcgtcggcgtcggcgctttacctttgttaccggctttttcgctggctcccgcgtatgcagccagctggcaatcacgccggtgtaagcgtcgcggtcagccagggcgaagcgatggccgtcaccgtcgcggcgctgaatagtgatgaccggcagcgccttgccgctggcgtttttaccctggccctgccggataaacaacaggttgccgtccttgacgcaggcaacagcaccgcactggcgggcaacgcgcatcagaaagctggcatctgattcgtttgtctggtcgatgtggtcaatcgccattttttgcacgtctgcgcccagcgcaaggctcagcttgtgcctgtcggctatggctttgacgatttcgcccacggtggtcttatgccaggatttttcgcgtttcgtgttcagcgtctgccggaaatcggcgctgcgggcgcggagcgtcagccggtcaggcatcccgctgtgctcaatctcatcaacggtatagctgcctttgctgataagtggctcaccctgccagccgagcgccagttttaacaccacgccccggcgcggcagctgcagaaggccgtcagtgtcatccagctcaatatccagttggtcggcctcaaagccccggttatcggtgagcgtcaggctgataagccttttctctatcttctgtgtgacgtctgcgccttccatcgtgagccggaaagcgggcgcgttcgccgcccccctgacccagctttctgcctgcatcatgagaacaaccctcccgctgctgcagtcactttaccggccacgcctgccgccgcgcttttcatcgcgtcaagctggccgctcagactgccgaacatctcgcccagtgactcatccacgcgtttaagcgtgagcgtgaactcgatgcgcctgcacacgccgttgctgaaaaactccgcctttgtctggctcaggctttcaatcacaaacataccgtaaatggtgccgccgccctcaatcagcggccaggcgcgccccagttccgcaatctgctccagcgcatacagcgccagcctgccgccggtcagctccggcagcaggatgccggaaagcgtcagcgtgtcggtgtcaggcccggcaaactgcagcgacggacgcaggcccacgcggttgttggacggaaaccgccagctgcgctgcagttgcagctcctgataaggcaccgtttccagcatgaaaacgaacagccccagcgtcatcatcattcgtcgtaccctcctcgatcacgatatgaactgcgcgcgcgggcttcggcctgtcgctgctcggctttgagcctgcgcatcacctcatcaaccagatcctgctggctctgccctggctgctgcacaatggtgaatgatgcattgatttgcggcacggcaaccggctgcggttccttcgcgcgctgcgcatttttctggtatgcctgcgcgggcaggctcaacgggtgtagcgacctggcggcggcaggtgcggcggccatccccagcgccagcgccgccgatgcggccagtgcggtggtgcgacgacggctggtaatgcgcgccgggccgttgaccagctccggcccgttctcgcccgcaatgccatactgaccggcggggatatagccgccattgtcaaacagtccggcaaagcccgtcggggatgccgggcttaacgggttgaccggtgtcgcgccgcccttgtccactgatggcttcatgaatccgggcaacagatccgtcatggatgacagcctggccttaagtgcctcccacttagacgtgatgccgtcgagcagggcgcttatcatgttactgcccgcttctttaaaccgctcaggcaatgtgctggccgagttaaccagctcatcccatttttgcgacacggctatcttaatgctttgccatgccccggcgatgccgtcacgtatggcgtcccagcccttgctgataacgccctgcagagtgccatccgcgaacagcgatttaacccacgtccacgcgccggtaatcttgtctttgatggcctcccaggctgcagatgtgttatccgtcaccgcctgccatgtcgctttaaacattggcccgatggtgttccagttacgccagatgtaaatcgcccccatagcaataagcccgatgacggccagtatcgggttagcgaacatcaggcggcccagccacagaacactttttcccagcacgactatggccttacctatcagaccaaaaacgcccggccctctgtaacccaactgcatcagagcgaatttaacgaccgccatcggcccgacaatggcggcaaggctgattgccagcgttcccatgccgataacgataaaagataccgctgcaccgactttcatcagcgtgcctgctgcctccttgtttttattaacccaccgcgccactgtgccggtgacttttttaatcacccccataatgtccataagcggctggcgcagcgtgtcgcccagcccgcttatggtgttgttaacgccgcttttggtcagcatccactgagcggaaagggaatctttattaatgtcagactctttctgcatagaacctctggcggcgtcgccctgcgtcagggccagctgtcggcgcagctccggcaggttgttgacaagttttgcagcagcaggaccaaactcttttccaaacagcattgtcagggcgggcactttcttgctgtctggcagtttcttgaccttttccagcacgcggatgatggttcccatcgcatccttggtcatctgcttttcaatttttgccgggttcagcttgagcagatccataccgtccataaaccggttgctttgcatggtcgctatcgacagctcacgcaccatcgcgttagccgaactcgccgcaatctcagacgtcgcgccgagcgaaaggaacgttgaacccagcgcggccgcctgccggaaattcagcctgtcggcgttgccgcccatgcgctgcagcacgtcgataatgtctgcacctttcgacatcgcgttatcgtctaaatagttgagcgcatcgcccagttgctcaatgttgcgggtcggtatcttgtacagctggccgattttccccagcccctcggccagctggtcggcgggcagctcaaacgccgttgacgctttggccgccgtggtggcaaaggccagtaagtcgcgcttctggtcggcgtaagaatcattctggttcgtcacgcccattcgcgcgccgccttctaccagtgcggcatagtcaaccgcgccgttctgcatcggcaactgctcactggcggccttgatggcggcctgcatgtcgtaaaactgcgcggtgcggttgcccttgtcatcgcgtaggccgttgacctgctttgccacgcctttcatggcgtcttccatatctgcagaggctcttaccgctgccgcaaacggcatactcattgccacgcccgccgccgtggatgccgctccggctccggccaccttatcgcgcgcctccagcgttttgccgtagcgctcacgcaccgcgcgcaatttggcctggcgctcgcccagctttttcagctcacgttgctggcgctcaatggcatcactggcggcgctggcgtcggttttcagtcggcgctgtgccgcacttagctgctttgtatcgataccggcggcggtcagcgcgccgcgctgctgctgtaccgagcgcagcaggccgttgtaactctgctgcaggtcattaacgcggttttttgcctgctcaagtaaacgggactgctgcgccgtggggcggttggtggcggcaaactgcgttgccagtgcggcggcctcctgccgggcagaggcgagatttttttccgtgatggcaagctgctggcgtgttttgcgaaagccatcaatgcgcccggcctgatcgttaagatttttcaggctgtctttgctggctttaagggcggcggacagctcccttgagccgtcgcgcgcgtttcggaatgggcgggtgattttatccaccgccttaagaaccacctgcaggcgcaggtctctttcactcatcgtcaccggctccgttacgcaggatcgctttgtgccgccattcaagtaaatccgtcagcgactccgcaaacatgaccgacggcggccagtgaaacacggtggcaatatctgccaccagatcgtcaaccgtcaggccgtcaggaaacccgacgtcgccgacttcggtaacaaaaaagtgaccacctccaccgacagcgccagcaggtcggcggggtccatttcgttaatttcctgtgccgtcagcgccggggcagacacgcgcggcagcacggccatcaccgcgttgacgtccatttccatcagcgcctgcaggcgcacgccgcgaagcgaaccggactgcggcttgcgcagtaccacctctttaatttcggttttgcctcgcctgattggggtgtccagggtgatggttttttcgttgatgttttcgctcatgttcttaatccactgaatagtttatgaaagcagcaggccagcgcctgccgccgtgattacaggcccagcgcgctgcggtgcgcttccagcaggtctttgccgtcaacgatgtgaaccatattgaccagatccacctcatagagcacttcaccgttaatggtcagcttggcgtagctgttggttgccgacactttggtggtgttagagtccgccgttttccactcgccggaatccagctccttgtaacgcccgcgcgtgaccagctccaccgcctgaacctcgcccgtgtcgtcgcgctgaatggagccggtaaagcgcaactgaataccgtcaatcgtcggtgtacccatctgtttaaacagcttcgcctcggtgccgccgatggtgaattccgtatccagcgcgccatcgtccaggcccatatcaatatccaccgcgcccggcatcccgccgccccggtatttttcaaacttcgtggtgagtttcggcagggtcagcgattcgatcacgccctgccagttgtcgcctgcgttaaacaggttcaggtgttttaacttacggggtaaggccatgtgttcagctccttaggctttaacgctggcggcaaagttgaccagatactggtcagtgatgcgctggcgcagcatcaggttttccagcggcggcaccggcgtgtagtcgtaatcgataatgagttgcccggccttgagcgtgtctttggtgttcacggtgtcatccagccagcagtctgcgccgattagatagccctgattcaccatactgcgcagcttggcgcggatactttcgataatgtcgcgggcaagcgacggattcagcgcgccatcaacggaccacagctgcgcctcggccatcgtgtccgccagcacctgcgccgtgcgggtgtagcactcaaaggcaaacagcggatcatcgctcaggcagcgcgaaccccagaagcggaaaccgtccttgcggataagcgtggtgacgtcgttctggttcagcaggcctgcatcggttgccgggtcctgtaaatcccagaacacgtctttggaaatgccggtgacgccgttcacgccgacgttagacagggacttgtgccagccggtcgcctcgtcaattttggcgcgcagtccgagcacgcgggcggtggcatacgccgtcgcgtcagcgttcagcacggtgtcaaagctgatgaagtcaggccagataagcatcccttcgcgctggctgaaattagcgcggtaggcgatgacctcggaaacggttttgcagccgtaagcggagatatacgcaaacccgcgcagggtctgcgcgatgctcagcagctcggctgccaccgcctttgtgtcatgccccggtatgccgagaatgcgcggtttgacgccgcagacgttctgcgcggcaagcagtgctttcatgccggtgcgcatcccgtctgcggtcacgccgccgatgatgttggatgtggtttccgcctcggtttcgccctgcgcgacgcgcaccacgacgacgagcggttttgcctggtcggcgatggcgtccagtgaggcggcgagcgtaccggttttaccggccttgccgatggcggtagtgacgtctgtcagtaaaaccgggcggttgagcggaaacgctgccgcgtcggcgtcgtcagcggtgcagaccatgccgatgattgccgtgctgacggtggtaatggtgcgggtgccttcgttgacttcgacaacgcgcacgccgtgatgataatcctgtgccatagagcagatcctctgttaaggggttccgctatggtgaaagggatggcgcgcgggcgcaccctgcggccattgtctggcaaatgacacaaaggaaaaaggcccgcagggggcctttgattactacgcaggccggtcaggccagctgacagcgggcgcgctgtaggggtctgtcgcctgcacggcctgcaggtaggtcatccatgacgtgagttttaccttatcgtcgggggaaatgatgccgagcatcagctgcgtttgccatgcctgagtcacgcccgccgcctcggtgatacgggcgcttttctccgcctgggccgcttcaacggcggcgcgctgctttgccgctttgtcagttacctaggctgcgccgccccaccggtcaaaggccgtttctggcttaaccggcgttgtcccggccggataatcaccgggctgcgtgactgtcaccgccgcaccggttgccgtgctgtaagccgtttcgccgcgatggtccggcacctgctgccagctgccgtctttaaagacgcacacctgcccggcaacgtcatcagggggcgcgactgccgtagagtgcgcgggcagaccgacaccttttggcagaaactccaggctgctgccggtgtaaatcccgctcgcctgatcaaagttaaaaacgttaacggtaacgggcgcgacagccaggccgtccgcgttcagtgcttcactgtgctgctgtgtcattatgctgccctcacgatgtagttaaatgcgacgttgcgcgggcgggttgaggagtaagcaaaccagtcatatttgttcactttcgatgatgagttgttaatccacgtttttccctgaatggaagctaactgacctccggtaagggggtcgctgaatgcataattaggtgaactgatggcgctgaaatcaccatcttcgttatcgtcatagccacccaccaccgtgccttcctgttgactcagcaatacgcgtgaagggtcagccccgcgtccgtcatcccagcccctgataaactcgccgcgcaggtcaggcagccgcagcgacggataggctttcgccagctgcgggtaatctgatgcgctgaaggtggcaccgttacacctcagccagcctgatggcgctgttgcaacaggccacggcaccggcacgccgaccggcagcgccgagccgtcgcccaggccgagatttttgagaaacgccgacacgttcgctatgtcgctgccgtttctcgcgatgtccattttaccggccagcttgttaagcaccgtcgtggaaaaattcgcatcgccgcccagcgcgtcggccagctccttgagggtgtccagcgcggcaggtgcgccgcccgccagtgcgctcagcgcagcctgaacaaatgccgtggttgccagctgcgtactgctgtttcccgctgccgccgtgggggctttcgggatgccggtcaggaccggactttccttcggtgcatactgcgtatgcggatcagcagctttcaggtgcgccgtcatcaggctgtcagcgtactggcgcacctctaatactttttcgtccacatactggcgcgtcgccagcaccaccgacggatcgactttcagggtcacggcctcggtactgctcacgatgataagcatacgcaggcgctgcgtgcgcccgctgccctcctgcagttgcggcttataggtttctgccgtgttacagaccgcaatcagcgagccgtcagcgtcaaacaggcccatttccctgatccagaaaccgccctcggtttctgggatcacctgctcggcaataatctggctgctgttggccgtatccacggtgagcgaattgagcgcagcacggcgcacctcgttaaccagctttgtctgcgccgcgttgggcgttggcagcgtgccgcctccgtcgccaacggccatgtgcgtgatattcagttttgtgcccagcgacacggcgttagcaatcttcgccgcgccgaggttggtcactatggcgtaaaatttttgtgtcatggtcccacttccatcatgtcgataacgtgaaccgccgcgcccgcatatgccgggccactgacggagataagatcgggtgtgtagggataaacggtaaggtcgtcgccgtcgtagctggccgcaccggtaaagcacgtgccgctgctctgcaggttgatgctcattcccagcatgtgacggctgcagggtttggcatcgctgataagccgctcaagctcctgataggtctcctcagtaatcccctgttcctgcacgccaatatccaggcgaaacgtgccgggcgcttcaccggttttccaccactccagcacgcggatcagaaagccgaacggctccaccacgcgacgcactgcgctgatggtgcctttatgctgatggatataaaacgcatccatcaccacgcggcgcttgacgctttccgcccaggcctcatcccagcggtccaccgaaaacgaccaggcgaggtaaggcagaaaccacacggggcaggcggcagggttccacaggtcacgcagcgggacgttcagcccgctgatgccgccgcacgcctgtgccagcctgcgctcaagcgccgacgacgcgggcggtaacatgctctggctcatcctttacccccattatcgctggcaaccgtgacggccaccgccgtgcagttgcccgcctgcgtgcggttcagaataacgtcctgcgccggttcggtgatttccacccagtccacgcctgccacgcgcagcaccgccccgtaagactcgcggcgcacgctgcggcccagctttttctggtcagtcaggtaagcgtccattgcggcctgcgccgcctccaggcacgggcctgcggccacgccgtcaaacaggtgcagcgtggctttcacctgatagtcaaatatcgctgccgcctgcaccgttacgcggtcagccaccgggcgcacttcctcggcgtttaacgcggcattcactgcattcagtaaatccgccgttgccgccccgctgttgtcccggctcagtaccgtaatcagcacctccgccggtgccggactcgttgccgacacgtcagatacgcgtccgtctgcgcttttggcgtaaaactcataggccgccgtcggcccggccacgctcagcccctcaaatgcacccggcacgcgcaggcgtaaatcgtcgtctgactccattaccgccgccacaggtggcacggcgtcggggtctgccggggtaattgtgaggcgcttaacgttattatttgccgccagttggtccagatcggtgccgagcgcataggccaccatgaccgcctgcgccgcctcgttgatgcgctggcgtaagaggatttcgcgatagacgttttcctgcaggcacttgaccagcggatcggattccagcgccagcacgctgcgcatggcgtcctgctggtctgacggatataacgcaatcaggttttctttgcgctcggccagcagcccttcaaagtccggcacctcaatgacttccggcgcgggaagctgcgataaatcaatcactgccacggttcacccccgttggtatggtcattgccagcggcgaaccgtcggcacgctgtgcgtttatctcaacgaccatcgagccgtcataagccgttgtgtaattcactgaaatcagccggatgcgcggctcccatcggctcagcgcggcgtaggttgccgccatgacctgcatacgggtgatgccgttctgcggctggtcgatgagcgctgaaagcattgatccgtattcccgccgcgccaggcggctgccctccggggtcagcagaatgtcgctgacgctctggcgaatatgatcgatatcggtcagcgctttgccggtgtcgcggttcatgccgagatacatcacgccgggcctcctgaggtgtcattaccagacttaacgccgccgtgtgtatgggtatgcaccacgacgccgttagaactcatgtcaccgccgccctgagtgactgcgccgttaatggtcgttttaatggcctcaacgccaaaagcgtcagtaatcagctgaataccgtccgcagcttcgatgcgtacgcttttgatgttctttatcagcagctggccggtttccggttcgtactgaaaaaatccgccgtcgctgtactgcgtggtgctgccgttctctgaataatccggcggcgggaaggcatcggaataaatcgcgggcagtgcaaaggcggtttcaagattgccgcccatgctcagcaaaatgacctgttcgcccacggttggctgccaccacgtgcgggtgttaccggcgcgtgtagtgagccagttaatccagttggtttcgaggtcgcccgttttcacccggcacagccagttaaccggatcgacgtcggacacggtgccagtacggatcaggttggtgatgaggcgcatgatttcggtaagttgtgtattcatttgcataaagttaatctagaaattccagccatcccacactggtaatttgtatggggtttcacacaagtaatcttttttaatagagaagctaagacgatggaaaatcaatcaacttttggtgcaatcttgaatgccccttggttagtagctttattgcctacattattgactatgacattaacactaataaggaaacttaactcaccattgaaagaagactctgaatactttaaagattgcggaatcccaccattaatactgcggttatctttgtctcgtgcaaaacttagagaatacaaaccatataaaaaagccacatatacattcattctaattttaggggtaattgttttctcaggcgcaggctggctcacctatcaattaagtaaagattatcataaatctcccgagggatgggcgttattaaaactcacatcaactaatgagcttttccttatctccctaaacaaggcaacctcaccagacaggaaaagttggataatcacccctgaaacctgtgccttacaaacatatggtaatatagcttcagaatttaaaatatctgcatctctagtttataaattatgtacagcgatcacctttaagagtgaggagggagggattagaaaatggattgccatggttcataatgacgcatttaaattgctaattttttatggtccaacactacttatgatgtactggttctcgatagcgttattaatggatatcgtgttaaagtttcaaattgataaatataaccagcagcaagcagagcgcgcaaagctttaccttacttaatctgaaagccaacgcatcagtgtatcttttatcgatacagcagctttatcatcaagcccaatcaaaggacgctctgtatacttcaccgtaatgcctcgcttgctcacgcggtcacgcaggccgtaatgatggacacgggcaagacgctgcacggcaggcacaaaagccacctcggcactgtcgcctgtcgcctttgtcttaaggtactttgccgttttcagcttcacaaacatcttgcgcttaatgcggcccggctttgtccttgctgatacgcggcgcggttcccatgcgccgccatcgggtgagcgctgcgccgtcatgttagcctgctgaatgcgccgcacgtcgcgcgccacctcacgcagcatctttttgcgctcagccggttccagctttgccagcagcgcatcaagccaggcgtcaacctcatgcagattatccacggcgcaccgtccagatgtcgtccgtttcaaaagggttgcccggctccggcacggctctgacttctgttacgccgttgacttcctcggcaataacccgctctgtcagctttaaattaatgctgatgtcacacgcatcgttgccgagaatgtccacttcaaacgtgcaaagctgctcacgatcgttggggttctgcagcgcgtcgggctggttggtgcgcagccagtacatcaccgccgccatcagcaggttttgatcgccggtgaagtctgtaatcaccacattcagcgtgtagcggtattcccacgacagagaggcggcagaagtcccgacggatgcccctttgtccacaaacaggtgaaacctgtccgggttttgctgcaggtaagggatggcgttattcagggcttcgcgtaaggactgcggcttgttcatcgtctttttcctggcaggtcactatggtgtccaccttgtcggcgcaggccgcccaggcggtttctgtttcatccagcagggccagtaaatcgccgttagtgcgcgccgacgacggccccagctggcagcgggttattctgggacagccactgacggtaagattcacctccggtgatggccggtcgctggcgcagccggataacagcatcaggcagaggggcatcactccagcggcgtagggcgtcattttcacttttcagatcctcaatctggcgctgccgctgtcgcagcagtgcgttgttttgttcagccgccgcatacagctgcgtctgtgcaaggttgctgctctgcgccatgatgttgaccgccagcagttggctgtttttctggctcagctttttatctttttcggccagatgcgccgcctgcgtgccgatggtcctgtttgcgctgtgcagctgccacgacagcagcccggcagtcatcagcagcacgacaaaacaggtcacaacaacggcgcgcatcatgctgccgccccttttaagcaccagctcagttcccgcccgcgccggttatccagcccctgattaaatatgcctttcacgtacacccatcgcggcagctgataacaggcatcgcgccaccggctggccctgatgagtttcaccatcgttgaaccgcacacgtggccggtgccgacgttaaacgccagcgacaccagcgcgtcatatacctgctgcggcatggtgaccgccacgcagcgcgccagtgccgcctcaacgcgtaacacgttggtgataaacgtcccggcggcctgccgctcggtaacggttctgcccggcacaacgccccgcgtgttgccgatcccgtcggtccacacgcccgcatcgcacaggtaaggtttcaggcggcagccctcgtaatcagcaatcagtttcagtccctcaaccgaggtatgcagctgctgaaatcccggcagtgtggcggcgatggccagtaccgcgccgacgacgcagcgtttaacggtttgcagattcataatcctcccgcgtgatgcgcccgcttgccagcagctggtaggttttgtgcttgtagtaccagctgatcagtgccataccgatgcctatgatcagcccggcccatgttgaaacgtctttaaccgacaggtcgcccagccaggccataaacacggccatcgaccaggtgataaacgtgctgattctttcccacatgattcagtcccatagctgcacggtctgcgccgtggctgctggcgcaacgtccggcagctcgacctctaaaccgtggggtaaggtggggccgtattccgccagccccggattggcctgtaacactcgctcggacagcccctgcgtgcgcccgtagtgacgccagcacagtgcatcaaccgtgtcatactgctgcgcacgcactttcatcagataagctcgacggttacgtgtggcagatcctgcacgcggctgatggcccagcgcgcatcgcgccataaatcgccgctggcatcgtccagcgtctcgccgcgcttagcgccggatgcggtggcgtcaaagtcgctgtatcgctcgttgagtaccgcacgcgtccagcaccacacggcgttttcatagtggtgcaggcgcacgctctttccggccagctgttcagccggtacgtcggccagcccgttgtaacccgccatttcctgccgttcccgccacgggtacagctcggcgttgacttctgacatagcggtcagcacaacctgtttcagacgctccggcgtcacggtgccgtcaacgcgcatcgcgctgcggaacttagccaaatccagatccggccagaatgaattgttcgggataatgaccggcgcaaccggcgactgctctggcgctgtaaactgcatccttactactcctgaataggtgggcggtggacggggttttgatgcggcgctgcctgtcgccaccccgtgccgccccgcgcgtgggcacgttcggttatcagctgtctttgcggagtttccgctccagctgctcaatgtctttttttaccccgcatctttcgtccagctgcagggcgtgcttaaggtgattcagtgcggatgccgggttgctttcggcctgtacccagccaatggatttatgcaggcgcgcgcgcgactgatccggcatgtcttccccgtccacgttatccagcgtctgcagcagcaggtctgcatcgaacggggttccggccagaatggcggcctttgcggcgtcggccatttcctcggtcagtacagtggcggtgttgcgcttgccgaccggcatcacccagccgtgtctgagggcatggcggccaatggtcagcgcaccggcataatcaccggcatcgatacgccacagcatgacgtacatgatcacatcatcctgctgcgctccgtcggcactcagcacgccctctacccaggcggcatacttcggcagcacctcaaccttaatctgcgctttggtgacggtggactgaatgcccttgaggcggcggcggtcttcattcagctgcagcagcataaggtcatagccttttgcgtggcggccactgccgcccgtgcgggcggccactgccgcccgtgcgggcggcctcctgtgcctgaatgaatcgcgtatgtgtgcgaaaaggattggtcacgggttacgctcctgcgttgccggtgcctgattcagcctgcgcctgcgccgtacccgattcgctcatggccttgaccacgcttgccgcaacggaggcaatacgcgcgatttcggcgtcgctcatctggcccgcttccggctccggttcctgctccagcattacaatgttctcaatcaggcaggtgcagtcgtagtcctcgaccacgtacgcctcgttgaccgactcaaggttttcaatgcgatcccgtttcgggttgtcgatgatggagcggcggcgggtgtcgtcctgaacataaatcgacaggttatcaaggcgcgtaatcagcagcgcgtctgccggaaagaacggcgcgcgcaccgcaggcaggccaccaatgcgcttctggctgataatcaaatcagcggccagcgcttcggtgttgggctggtctttgttgacgatcgggaaatacttgtcggccagcagctggcgaccgcagatcacaaccagctcggtgtcatcctgatactgcacggcgattttttccgttacggcacccatcaccacggcatccagattgcggaacaggcctgttttaccgatggtgattttatcggcgatgatttttcctgcgctgtcgatgtgctggcccagcacctgcaacggtttctcctggcggattttttccagccagccgatattcacatcctgcagcagcgggttctggtcgcggttagaggttttctcgcgcttgaggccgttaaagccgatcatgatgcggtccagcgcctggcgtttcacaatcatgtcgcggatacggacctgaaagtcggaaaacttcgcccacatgtccagcttcgcgtagggcagcgccgtgtcaaagttggtctgcgtacatttgtagccttcgccgtcaatgtaggtcggatcggttggctcgcgctctttctgcgcggtgtcggttgtaccggcaatcgtgccgccgattcccagccccaggcgctcgccgctctgctccgcgaccggcacgatgttgatgcgcgtcagaaattcagatgactcctgaattttggtttccagcgtctgcgcgacggatggctcaacggtaaatttgctgttgagggccgacaggttgattttgttgatttccgccagtaccgacatgtaggcgtttaacttaaagcgggtgctgtttttcatcgtttcatattctctgttcgttaagagggttggccgcacctgcatcagcagtcggtgcgcacgtcctggctgttgccgttgccgttaccgggcgtgcgcgggcggaagtcctggcgcccgtcttcacggctcagttgttcctgcagctggctgaaatccgcctgcagctgctcacgggctgcagcttctgctctcagctgcgcctgcaggctgctggcctgctcgctcagggcggtttctatgcgctggctgaatgcctgctgctcggtggcgaccagctcgacggccctgtgaacgtcgctgaaacgggcgtcatcagacttctgtttgttgctgaaaagcgcagatacgcggctgaaaagagaaggtttttcgtcggccacgtcctcaaactcgatcacggtttcggcggcggcggtaaacaggttgtcaggatgctgcttgcggttagccagcgggtttgcgcccgcactggcgctgaactgcagcatttcagtgccgaggctggccggatcgtcggtcacggcgaggccaatcagatacgcctcgccggtgtcggcaaactccgggcgaatctccatagaggtaaaaagcttctgcatgttgccggtcatcgtgaccagctcatccgtcgggttaattaccgcgtacagccccagcttgcctttcagcaggccgtcgctgatttcttcggtgtccagcgcatcgaccactccgaaacggcgaaacgcgctgtcaggcgtgtaacccttgatgtgttccatgttgatcacggcggtgtagacagccggatcgtaattggccgccatctgctccagccagctgcgctcgatggtgcgcccgtccgtggtggcaccttccaccccgatgcggaaacgccttgctttctttgccattgtccaggctccggttagataaaaactctgtgagtccctatgtttgcggcgacgggggcagtgaaacaacgcggcgacgttgtaccgtaattcacacaatcacggtcggcggaaaaggaaacgggcgggccgtattttggggccatgacaacgacaatcgcccccgcagacctcgatccccgcagacaggctttgctgctgtactttcagggataccgtatcgcccgcattgcagaaatgctgggagagaaacccgcaaccgttcacagctggaagaagcgcgacaggtggggcgactatggcccgcttgaccagatgcagctcaccaccgctgcgcgctactgtcagctggtcatgaaagaggagaaggaaggaaaggactacaaagaaattgacctgctggcccggcagtcagagcgccatgcgcgcatcgggaaatttaacaacggcggcaatgaggccgatttaaaccccaacgtcgaaaaccgcaacaaaggcccgcgcaaaccgcctgaaaaaaacgtgttcagcgacgcgcagattgaaaagctgcaggacgtctttcacagcacgatgttcggctaccagcgccagtggtgggaagcgggcaataaatacgccgtccgcaatctgctgaaatcgcgccagatcggggcgacgttcttttttgcccgtgaggcgctgatcgatgcgctcaccaccgggcgcaaccagatttttctgtcggccagtaaggcgcaggcgcacgtgtttaagcagtacatcgtggagtttgcccgcgaggcggacgtcgacctgaaaggcgacccgatgacgctggctaacggtgcgtgcctgtatttcctcggcaccaacgcccgcacggcgcagagttatcacggcaacctgtatcttgacgaatatttctggataccgaaatttcaggaactgcagaaagttgcctccggcatggcgctgcacaagaaatggcgtgaaacctacttttccacgccgtccagcctcacgcacagcgcctatccgttctggtctggcgcgcagttcaacaagggccgcaccaaagccgaccgggttgatattgatttaagccacgcgtcgcttgccgctggccgcctgtgtgccgacggccagttccgccagatagtcaccgtcgaggatgccgtacgcggcggctgtgacctgttcgacctggagcagctgcgcacgcgctacagcccggaagactatcaaaacctgctgatgtgcgtgtttatggatgacctcgcctcggtgttccagcttgccatgctgcagaaatgcatggtggacagctgggaagtgtgggacgacttcgaagcgctggcgctgcgcccgttcggctggaaagaggtctggattggttacgacccggcgaagggtacgcagaacggcgacagcgcgggctgcgtggtgattgccccgcctgccgtgccgggcggtaagttccgcatccttgagcgtcatcagtggcgcgggatggatttccgcgcgcaggccgacgccatcaaatcccttacgcagcagtacaacgtgacctacatcggcatcgactcgaccggcgtcggcctcggcgtttatgagaacgtaaaagcctttttcccgcaggtgaaagagtttgtttataacccgacggtgaaaaatgccctggtcttaaaagcctacgacaccatcagcagcgggcgaatggagtttgacgccagccacttagacattgcgcagtcgtttatgtctatccgcaaagccaccacggccagcggcaaccgtccgacctatgaaaccagccgcagcgaggaagtgagccacggcgatttagcctgggcgaccatgcacgcgctggcaaacgagccgctgcagggacaggcggcacacacgcagaatattgtggagatgtattaatgagcagacgcaggaaccgcacgcgcacgcagcccgtgcagcagccggaacagatgaccagcaccgccgcctccgaggcgtttacctttggcgacccgatcccggtactcgaccggcgcgaactgctggactacgtggagtgcgtcatcaatgaccgctggtatgagccacccgtaagcgttgacgggctggcgcgcacgttccgtgccgccgtgcatcacagttcgcccatcagtgttaagtgcaacattctggcgagtacctttatcccgcacccgcttttgagccagcaggcttttacccgcttcgcgatggattacctggtgtttgccaacgcgtacctggagaagcgaaccagccgcctcggcaccacgctgaaactggagccttcgcttgccaaatacacgcggcgcgggcttgacctcgacacctactggtatacgcactacggccttaactccgagccgtatgagtttacaaagggcagcgtgttccacctgatggagccggacatcaatcaggaaatctacggcgtaccgggctacctgtcagccataccgtccgcgctgctgaatgagtcggccacgctgtttcgccgcaagtattacattaacggcagtcatgcgggttttatcatgtacatgaccgacccggcacaaagccagcaggacgttgacaacatccgcagcgccatgaaaagcgcaaaagggcctggtaacttccgtaatctgtttatgtacagcccgaacgggaagaaagacggcattcagatcatcccgctgtcagaggtggcggccaaagatgagtttctgaatattaaaaacgtgtcgcgcgatgacatgctggccgtgcatcgcgtgccgcctcagttaatggggataattcctaacaacactggcgggttcggggatatagagaaggctagcatggttttcgtacggaatgaactcagcccattacaagaaagaatgaaagaattgaatgaatggttgggagaaaaggtaatagattttaaagagtacaaacttaattagccaaaaaattgaaagccagaacaccactccactttggctttcaattttattgtaaataattaagttcgagggaattttatttccttaaaatcctgacaagcaccatcaatccctgggaataatgcaccatatgtgattcccatcatcgctaaatcacgcatagcgttccttgcatcttttataggaatatctatcgccttaagatatctatccgtctctcccccgcacttataaagatgcccctccatatcacagcaattagtaaaagtagttaacgcctgttgtggcagcgctctcggattattcaatgttaaatactcccctattgaaatatttagcctacaatcaaatgggttactaaactgccaaatctcccttctccacttatccaattcaaatacaaaaattctcgctttccttgaagcatcactattatcaatttcatcctgcgttagcttgctaaacgcaaaaaaagcagcaacataaggtgagtaagaccaatcgagtaaaggtgtaggataaccatggtgctggagcaaatttatgaatgcaccgttatgtattggatccgataaattgaaatagtgctttgtcatactagatatatgtctgtgcaacaaaggtatatcatcattcatatatacctgtacatcatacctaccattcctgtggaatgatgttcttaaaggccaattatgggcctgacctctgaatgccacattcctgtaatcaacactactcacgaaactcttaaaatctacccatgtcatatcaatacctatagatgagtagcttttattacatttattttccaagacacaatatatgacacttccaacactgggagtaatcaataaattcaatacatcgccatcgaaagataattcaaaaatcgcgctctcaggaaagtctataccgccataactgttacttatataatctttagttgaatgaataggctgagcaaggaaatcagaactcatgacctgtatattagaaacattgagcttgtggttgtctccagatgtaggcatttcaaaatacacacatgacgatggataagacacggagcctgaaaaaaaataagcgtaacatcctaatacatcatttttaggctcgatatttatcaaacactctcctttgaatgaaccaaaagaagaagtacccacccattgtccagaaaacatgacgacctcgtatgaatcagaattttaatattgaaggaagaatttcacgtgggaaatcaattaaaaaatacgtgcttttataaaaaatacagcaacttagctctaaaggaaataagaatgaagaaaaaacacctgcgagtgaccaaattgaacacactcgtgtttagctgctcgattttttgtgagcatatagtagccaaatacaagtggaatctatccttacaaaacttaaaaagatactgtttctttgcccatacaatacttcaccgacaatgctcagcgataggtatttagacttggcgcgcgctcgtagccccgccacgcctgcccgctttatgtagtggttttcatgcaggtgcatgacatatgcaaaagcccgctatcataggcgggccagagggtagacgatccttttgggatcatgcagattcatgcagcatagccatgcagaagattatcaaatcaagattgcagtctgatttgctgtttaatttgaatggcctgtaaagtttgatacctttgtcttatattgttatataactcaggggtatcttttgcctttagcgatacaatcaatacatatgcaagatttggtagttcatctatttcagcaggcattccattatcacgcccgtagtaaataacatcaaaacatggatctttaagagtatctttgttgaacgtatgctcactacgaagcgtagtttcccatttatgagaatcttcacgcaactcctcttcactcgcatatatatgtttactattaaagagtgggaaagtagcaccaattttatcttttggtgtttttctcatagtgacaaccaatccactttttgtgtaattcacaggatgagcaacgtccacgggtgtcgtgaagcaaaaggtagctttaagttcaacagcaccgttaatctggatatcagggaaaggaattggcgcacgcaaatgctgggatggcttaagctccccctgatatataactttaacttcgttgtcatcacaatagataacatcggaaatatcatgaggaaatctcccccaccctacatgactacgttgcagtccattattttctgcatgatgaatcaaaagagctttagctgtgagtggcgtaatattatattctaaactcgctgccaagcctatggcttgtcgtagaactaatggtgacgaaaagcttgtgccagcggttttaataactttatttaaaaaaggactataaaccttaaaaggctcatctttagagccgccaaaagccacgccgtcaggtttaacataccctggacttcgccctggccctatgcagctataatcgcttctgacccaagttttcgataatgaattagcggcaccaactgctaatgcattaactaaatcagaaggaggctgtatacgattcaagccgtcagccaaaccaccatcattacctacggcaacagtacacaggatatttccagcagataaatattgctctaaagtagacgtccacacatgtacatcttcatcatcaataggaaatcttgggcctaaacttaagtttatatagtcgtattttttctcatctaaaacagatttaattcttaataaaacgtcaaataaatcttcatctccaccatcgatcaagttatcaataactctgtagtggtcaatagaagaatacggtatgggcaattgcgactgaccatcctgaacagctccaaacaaaactgtagaagtaacatcttgaccatgagaaagtaactttccactagtctttgaaggctcgccaaaagtgtattctttgacccatttatcaaaatcagtattacctattcccccgtcaaaaatcgccactttaatattatcattaattgctttttcgagaggaagttcaaattcaaaatcttcaacgactgtacgcgtgaaaacaggattatttatccttaagcctggaagatccctaaccactcttaagaacgaaaaatcagcaatatttttagcctcagctaagttagctgatattggcataaaggtgaggtcattaacctttattattttatgcctatcaatttttgcaccgcaggacaatgcatatttaataaagctatcaagcacatctttgttactatcaggcgtatgtaaagctacctccaactttctaggatgcattgaggaattaactatcttaaccttctcattggctgaaaaaaaagcaacactttcaaacgttataatttctttttgctgccctttattcagtttattatctgacagcgctttaagaagattcgaaaaatcagttacttttccagaaacataaatgcatacgctcgaatattcgtctttgtgcttaccgcgactaccaacaacctttcgcggtttaattgatacagccttactaccaatgctggttagcgaaaatctcttaaaaattagatttgaaaaataacttttcgctaaaaatgccggatgaaggattaacttcgcaactgcttcaccttttggtttcgcggcatcgggaatatccataaacttttgaataacaccccttaactcatttattattactggagcattgtcttcataagtatatggtttatttttaggcccactaccgttttcaattttgacatcaccggttaaagtctcaccatagcctaatagcaggtttttgttattcattccgaccccttacaaaccaattatcttcttaatagttggtctaggtattgataactcagcagaaatttgccgttgcgacatccctttctcattcataaatttgatgatttcctcgataggttcaccatcaaaaagctcttcaagtattgctcgattaaccggtaaatcctcaagaactgaattcctttttgcctgattcaaggaacgctcaatgacggcgaaggacttacctaccatccgttcacttatattttcagcaatgccatgcggtacatcgcattgaagtaggaaatctttgataagattttgtgaaggataatcaaattttattactcggtcaaatcttctccaaaccgcaggatctagcaactccccatggttggttgcagcgactaaaattgatgtgttcggccactcgtcaattgcctgcagtagaactgttactaaacgctttaactctccaacatcagaagaatcatcccgttttttagctatggaatcaaactcatcaagtagcaaaatgcatggaaaagaacgcgcgtaatcaagaactgcacgaatattgttgcctgttttacccaagtaactgctcatcacacttgataaatctaaagtcagaagcggaaggttcatcctctctgcaagccatttcgctgctaaagttttaccaacgcctggaggaccatccattagtagtgatttcgatggcagaagaccgttttcacacaactgctctcttttttcccactctgccacaaatctgtttaaagatgtagatatatgctcaggccatagagggctaacagttaatctcacaggatagttttcgactagcaatttctgacgagtatcagcgtctaccggtgctggttgtttattatctttaaaacctcttaaaacagtaaatgaatctgtatttcttaaaagtgcatcacttaattctgatgcaagctctggagaatctttttttaatttctttatcatgatgcgtagccgcatctccagattttctcgtttcccttgcaatgcatcgttcatcacttcaacaaacatatcattagtgatgtttatcataaaaaccactccaaagtaaaatcaaaccaaaacttagcagatgatataccataccgaccagacatccagtaattttatcaatttaagataaataccttaccaaaaaagcaaaaaaccttaccaggctattgtcttccatagatagtaatacaggacttatcaaacgatatgaattttatctatttggtttcatgtgctttttcttttgattgcttaacttttagtatcaatagagcgtagatattcctgaatccggacctttttcattagttcatctgtaagctcagacacccactggatcgccagactcttttcatcttcactgcaatcactcgatgcaaccaatttaagaaacaaatcaatacgttgcaatttaaaagactcaaaaaaataatcctgcataacatttacttccctcaaacaactgtacataaacacagtatattaggaaaatccgaaagtgaaatgtttttttactttcagccttactttttgtgtgcttcgctttccactttacgcaagttggccgccttaaccctttcagcaaggctgttgaaacggctcagtatttcgtctttacgtgaagtgtcatccttagttctgaatggtcgtactaagtcgccgtagcaggtgcttcggaacatttttcctgcaatttctgtctgtgtgccacctatcaggcgcacggcaagaccgcgactgatggtttcgccgcttaagtctctgacctggccgatcacgttgtcacacgccgtctctatcgtatctggccgtcgcagcacaaggtgttttttatccggcttttctgctctcagtcgggcaagcattcgtcgccgttctttatggcccatccccttaaggtcgatttcttccaaactttccggcgggtttgaatcctcagatctcaaacgccccgtacagttattgacagaactccgagagggcgcgggcgcgccctgaagatcaaaaccaaattcaacggcacgcttcggaacaatcttccactgtgccagacgggttaaaatcggagtatctgcgccaacctcagttgcgtagacacccttaatacgcaaggtttcctcaccgtattcattcagctcatcgcccgactgataccaggtgcgcacggccagctcatcacgacgcacgaacggaccgccctgtgcgttaacgtatgccgcccagtcgcccacgtcggccgcgtcatgcgcagcggcaaactccgcgctgaggccgtgagcggtgtcggtgtcatccatgcgacgcagctcgcggtaaaccgtgaccggcgcaccgccgataaactgaaactgtcggatatgccagcgtgccgcccaggcagaaacggcgggcgcggtttccttaagctctttaccgctttcgtcgtccagctcgccatccagtgcgtagccgtcgatattcttagagatatatttagccacgtaacccgtagcactgcctttttccggatcgatggcctcggcatgaaagcgcgctttacgggctttatccgtggtcagctcgttgctgtcctgctgaaaggcatagtcacggattgtctggcgcacctgatccgcatcttcgggccgcataaacatcagcatgtgccagtgtggcgttgcgtcgtggtggggttcggcaacgcgaatgccaaagattcgaatgtcatcacggtgcagctttgcccggatgcgctgccagacgctgcagaggtaacgctgcgtgtctgcggggctggcaccattccatttacgattgcgatggccggttttgattgtggcgtgatagcgtgacggtgcggtcagcgtgtaaaactccccgacatagcccagctcattacagatattttcaaagccgcgaatgcgggtcatcagctcacagcgacggatggccggatttgccacgctgccgtcgtatttcttaatcaggctgatgcggttgccttcctcgtcttccagttccatgccctttaaaaactcacgggtacggcgtttctgctcccgccattctgaaaccgtcattctgctggcgtgaggcgtgtgttttttgcttacgttagccagggcaatctgcaggtgttcacgccatgacgcagccacacggcgcagtcgtcccgtccaccatttctctgtctgcatacgcagcacggcgggcgtgacttcctccggaacaaagaaacgggacgtcactttatcccacagtggcggcgtctgattaaattcccgggtgatggccgccgctgtcatgtaaacgcggtgcgtgtatttataatctgactcatcagttgactgcgcgtgtgcctgtaccagctcggccagaatgaaactggcaatgtcaccggccagcaaatccacatcggcacgcgacatatcagccaggcggttaaaacgcttcatcagctcccacaactggccgccggcacgtgccgcgccagcctctttcggggcgttatgtgtgagcaagttcaacgtgccggcactcatcgttttcacccggtactgttcattaacgcattcaacacgcggcaatgtgcgctcgacgaaggttttcgttaagtacgcattggcgcgggcaatgccctgtgatttttccagctcgttcatgcgacgtttgacgtcaatttgaatcagagtcggctgctgctcaagcagctcctgcgcacgcaccaaagccgcaatcatttgactgcggctgtgcatttcctcataggtggggtaagggctggcgatagcttcccgtggagcattccacgggtaagcgtactgctcaatcatgtagctgcctcttttgcagccatatcaacccccaaaccagatagcggcaggacgacgaacggcaatgatttctgccgcgcttttgctgtcacctgcagccacacctaccgcgcgggcagccctgatgctggtcagctcgtaggcatcaaaaagcgtgcgcgtgaagtcagtatcgctgtttgaagcgatgaccgggcagcgctctgacacgctggttaacatgctggctaagtcctgctgcgcagccttatcaaatccgcctgcgtggtagtcgctaaacgtaccgtcataaggcgggtcgcagtaaacaacgtcaccgcccttaatcatgctcagcgtctcgcggaaatcagcacatacaaacgttgcacggtgggctttggctgcgaacgtttctatttcttccagggggaaatagggttcagaatagtttccgtaagggatattaaattcactcttacggttgtaacggcaaaggccacggtagccgtggcggttcaggtaaaggaagtgcgcggcacgctcaagcagaggtagagccgggtcatgattaaacgcttctcggatgcggtaataatcctctgccctcttgttttgggtaaacagactcaccgccaccacgataaacgggcgcgtgtgttctttaatctggcggtaaagattaattaggtcgggattaacgtcagccactaaataagccgggtaatccgtagccatcataacggcgcaggaaccggcgaacggctcaacaagtcgctgcccctgcggcagataattaagcagttcaggcatgaggcgggttttgttgcccgcccacttaaggatcgtactcatacagcaccgcctttatagtgggcgcttttcagctcgacgatttcctgacaggcgacgcagtgagtaacaccctgtaccgcgcgacgacgggcctccggtatcggctcatcgcaggcctgacagaagaactcaccagccccgacaggctgatgacgtgcgttagcgagattgcgctgcagttcttcctcaacgcgcgcctggactaaatccattgaatcggccattagtgcagctcccgcgcctgatgctcaaaacgctctgcctctttatccagcagctcaatgatttctggcgcggtcatttcgtgtttgcgggcatgaatgaccagcgccgcaatgcggattgatacggccagcgcatcatcgctgcgctgttctgttttggccttgctcagcagtgcattaagcgtgtctgcgtcggcttcaaaattacgggtttgggtatttctcattgttcaattctccagattcagggcaaaggaatgcccggcgggtttacgccattaatttttgagtcttatttactctggtaaaaaacagtctgcggtagaaaactgtcggggcagaatctttccccagcgcgccattttattcatcgccatgatgattaattctcggcggtattcatcgaagtattcaaacggcttgccgatttcctcctgcgaaaaggttttaggattttcgcggttagccagggttaatacgcaaaatttaaactcgtcattctgacggttgaaataacgcagtgacggattagcgttattgtcacgctgctgccgccagcttttccgaaactcatcaaacgacattttgttaacagcatcagcacgattgcccgttgaatgagttttggcaaaagatgccgggccttgctgtgcggttgtgttgcctgttactcgctgcatgttaccccctgaataaacgcgccatgaaaccggcgggtttgcgtttgctggtcaccccctgcagcagttgcttttggctgttgcacggatgccagggcttgccgttctcacccatgatccagccgttgccgtatgctacggacggacttttacgcttaagaagtgatgccagtgaaatcattagcagtccctcagctcaggccaatggatgcgccgaggccgctgatagcgtctacggttgatgccatagtgggattggaatgaatgcgggcctgtaccgctatagcggccagactcaggcagcgaatgccggtattaacgctttgcatcaggctacggcgacaggaagtgctcaacgcatcctgattcactgcactggctgccagctgccccacttctgccgttgccttcaaaacgtaggctgacagcttttcttcggcatgttcgttcatcggtacgcaaggcaaacaatgtagttgtgccagtgcgccatccattaaagttgcatcttcggtcaggtcagtgagcaaaagcatttccgcaacggtcaactggtgcggctgttcaggattcagcttgttgcgcagggactgcacgttcatgcctgcagcctgcgccagctctttcatgttgtgagacagagcgaaccggcggcaggcttcgtcaaagtagttatgtgtggacacactaaaatcaaacatgattaatccctttcaatatcccaatatggatacatcagccctgcattgtgatttcgcagccagaagcggcttcaatagtgagagcaaccatgttgatttcgataagcccgtttaagccctccttcttcctgatgggtaaacggttctcgcggtacatctgacgaacggtgccctccttgtaaccagtgcggcggcagaactcttcgacagtaatgtacggttctgaaatcacgagattgattgaagggcgcattgaaagtttacgagtcatgatgcagtattcccaagtttaggtattagatatcactattaaacgctattcatctcatcacagaccgaagaataggatcacaaatcggatatgtcaacgaaagaaaacacaaatcgccataacgcaaaggtagttcgtgaagcggtagagagtaatcggggcggtaaagatgtgatttttcgcttagttgaggcgtacggattcagcagccgtcaggcgctatgcaaccatttgggcgtctcgcaaagcacgctagccaaccgttcagcccgcgataccttccctgctgactgggtgatcatctgccatgtggaaacgggagcatcacttacctggctaactacaggtaaaggtgcacgctttatggaagtggaggaatctcgtgttgtgattgccacacacaaaaaaatctcaaatggggttttagaagttatggatgatttcattctggataaagcatcactacccgaaggcttgaatgccccgtttgtgatcaacgcagatagaagcacttatttggttgatacctatgaaggcgagatcgtcgatgggctttggcttatcgagattgataagttagtcagcattcgagaactggcacgttttcccggtggaagaatacgtgtcgagaatgggaaatcgtcatttgaatgccaatcaagtgacatcgtagttttaggcaaagtgatcactcgaaccgaatacctttaaggcatggaatggcgataaacaaattacccaacgggaaatggcaggcgcagattttcccaaacggccgtgacggcaaaaggattcgccgccagtttgcgacgaagggcgaagcacaatcctatgagaagttcgtaaaagagcaagttcaagataaaccctggctgggagataaagcagataagcggcgggtaattgagctggttgaattgtggttcaacacccatggcattacgttggcggatggtgagaaacggcgaaccacaatggcgttcgcctgcgaggcgatgggaaacccactcgcaaccgagtttaacgcgaaaatttttgcgtcttatcgcgagcagcgtttaagcgggaaaatcacccgctccaatcgagtgaagacggttacgccgcgcacggtaaatttagagctggcatatttcagggcgatgtttaacgaactgcgccggttggatgaatggaccgcgccaaatccgctagagaacgtgcgcgagtttaaaatcagtgaatcggagatggcgtatctcaccattgaggaaatcagaaatctactcgccgaatgtgagaacagccgatccaaagatctgactaccatcgtgaaaatctgcctggcaactggcgcacgttggagcgaagcagaaggcttaaagggaaaccaaatccgcgccggtcagatcatttatgtgaaaactaagagcaagaaaaaccgcgcggtgccgataactgaaaaattacaggctgaactgccatcgagcaggaaagcacagttgctctttaaaccttgttactccgcctttagaaaagccatgcagcgcgccggcatcgagacacctgccgggcagcttacgcacgtattacgtcatacctttgcttctcacttcatgataaacggaggaaacatccttgtgcttcagcgaattttagggcatacggatattaaggtgacgatgcgatacgcgcatttcgcgccagaccatttagctgaagcgacgcggcttaatcctattaattatatctaactcttccatatgacaaagtgatataattagtatcatggctgccaataaactcctcaaaccaacaaccaaattttcaagagaaaatgtgaatttaaattaggataacgcatggatgattttttagttactccaaaaggtgaattgcacgtacatttcaatggagctttgcctccagaaatagttgatagaatcattgtagaaaataattctgctgatcgattgactgaaattaattaccatcacagcaagttattagttaataaaaaatcttctggattgatagagtatcttaagccctgggaatttcttcggattatccctataaacaaagttcaattaaatactatgattgaggctttttttatagccatggcagaaacaaacataaaatttgttgagatcaggcacacggtaattcatttagctagaaattgtgggattacttatctcgaggcattagattggcttctggaaggaattaaaatttatagctgcaaatatcagataaaggctgggttaattattacaatcgggagaggcgaacaggccatggaccatattaaactcgccatcaataatattcctttatcaagttcacaaaataatatcgttggcattgatctggctggagatgaagatactgaactggataataatatctacaatctgttcaaaaaatgcaaacatgatttaggattaggaattacaattcatgcaggcgagactggaaatgtcgataatattaaaaaagccataactcatttcgaagcagatagaataggccatggaacttgcgctaaaaacgataaacttgtattagaaatgctaagtaagaatcaagtttgtgttgaagtatgccctttaagcaacgtgatgacaggtgctacacatatagccaaaggacattctcttcaagagtttttgaatttcgaagttccctttgttgtttgctcagataatccggggatacaagaaacaagtcttattgatgattacgactattgcaataaagaaattataatccctaacttttccaaaaagatgtatgaatatcaaaaacaatttacttttattaaaggaatactatgaaactacatttcctgagtaacaaccctaataaaatcaaggaaataaatgatatcttaggtgatcgagttgaggtggtgagtgccaacataaaaattgaagaaatacaaagtaaaaatacgcaggatttagttagagataaattattaaaagcttttaagcagataggaagaccagtatttgtagaacatactggtttatatttaaaatcattaaaagagttacctggtgggttaactcaaatattttgggatgatcttgaagcagaaggatttatatcactactcaactctcatcaagataaggctgcaattgctaaaacagtaattggctattgcgatggaaagaaaatacacttttttcaaggcgaagttgaaggaacgatatcagattcaccattaggaaaccgggattttcagtgggactgtatatttataccaaatggttaccaagaaagctttgctgagatgggcgataaaaaaaatcaaatatccatgaggaaattagcattggataagctttcgttacatttactggaggaaaagtgatgatagatcaagagttattggatgcttataaaaatgacaacctcattctttttattggagctggcgtttcaaaaaaccttaatcttccagattggaaggaactgattagtgaaatcgcaaatgagcttgagttcgacgacgatgtattccttacatacggtgattacttaagtctagctgaatattacttattgaataataacaataagatcgggaaattaagaagttggatggatacaaagtggcatagtggtgatataaaaatcgaagactctgaaatccataaacatattgcaaccggcaacttcccaataatctatacaactaattacgacagatggattgagcattcacttaaacattataacaagaaacataaagttatcgttgatgtatctgatattgcagatattaaaagcgatgtaacacaagtagtcaagcttcatggggatttttcggacgactcatcgattgtgcttggtgaatcaagctattttgatcgtttagattttgatagccctttagacataaaatttagaagcgacatgttaggtaaatcagttcttttcattggttatagtctttcagattggaatataaaactattattttataagttagataagctatggaaaaaaaatagcaacacttcaacatccagaccaaagtctttcgttttctcaacaagaccaaaccctgttcaagagaaaatattagatgcaagaggagtgaaaatgattgtcagtgatgttcatgaaccatctaaggcattgcaatcttttttaagtgaactcgttaagaattcataaatttattatcccccgtaagtggcagcaaagtggcagcagagcgcaacgctatgtgccacttttcatcactattcggcccaaacaaaacataaaaatcagtaagttgctgattttacttatttcaaattgggactcataatcgcttgatcgctggttcaaacccagcaggggctaccagatttagtgataaaaatcatgaagttaagccacctcaaaagggtggcttttttgtttcctgtttttaagtggcgataaaatggcgatagattttctcgacattctaattgtgccattgctgttcactcagagcagtccgcacacagcggctcaacaaagcggaaaatctttagaaatgtataaagtaactgtgttatctgaacgtatcaggttgaccagtttatgatttcatccagtccaaacaaaatcgcagggaagtaactttcatccagtccaaaaaagtctgtaagcatgacactatcagcatgatcctcaggccttagcaccatgtttacgcctacagcattacccgaatctgactgtatgaatgtcaactcgacctgcttaaacagacagctaagaacgacatccgaattcttctgttgaaatatcagcgactgatgcagcttttttaaatcatcccgaaatatctcaagctggcccgcagcaaactccgcacggaattcagttttaagcgaaggaacagaaaactcaacccagaccatgatccggtcatatgccgcttcttcaggctcaggtatcctttcataaggggttaacttgagatgtagggttccgctctgtatatcgatcatccgttcacctttaaggcatgtactgaaagtgcataatagtccagtctttttctcttaccagaacttcaagccggtagggtttatagaaataacttccttttttttgtttatcttctaccagccggtacatacgggtttcatatctgaaaagccctggttttctaagtgggtctggcatacgtgttccatatcgaatggctttttcctgtatctgtaaaggcacatatcgaccaggttcatacatgtgctttgctgcgctttccgtcatcttcaaagagcgagccgaaaggcctatttttagccttccgcgcaagaggctgatcgtggcatggctaagatttacagttacggctgcacgaactccactctgtagtaaagctctcccggcaagaaaaatacgaaatgctcctgccgccagcaacaccaaatcggttgggtcaatgaggggagactctaacggtgtctcttcaagccgaaaaaaatttccttccgtatcataaatctgccacaatcctggagcctgagatactgagtagccgatacacataccggtttcatcatcaacaataggcttcgcaccatgaggcagaaatcgtgggcgaatttcaaagaattcgccgtgtggtaatcgtgactgaaaagtgtagtagcgaccgggttcttcactcgctggtaatcctgtaaccatgaatacctcctccttgtaattcaacgcagtgaataatagctccatgctaaaatagctcgggtttatagactgaagaaaatggaggaagatgtaaatgcatcattttctggaaacactttcagaatttctttccaattggcctgtaatatcgggagagcgagcagagagaaagccagtaaaagacaggaagaagatctcaagtcttcactacagacctatttgcaagatcactgatgataaaacaagagataatgatattcccaagaaagatgaggccaactaagaaaaacacattcacacttaagcagtcagactcattgcttgtaaaaaaaaccgctaaccgggcttcattacgatcataaccataggggctgctgctggcctctgcctggatgtggcggaacggctttaactttacctggtgacataataatttctgacacagtctcatgcgacttaaaggtacaactgcaattaatgttctggcactggttataacgttctttgatcttacccacgtaatgtggacacaatcctaagcgagattctggttttcaaattgttccgggctgaggccgccacaggcactgtgacgtcggcgacgatggtgtaatgattgaatatgaccttcgtcctgaagcgcatgctgacagcgttcaggttaaaggcgatttcggcatcaacgagagctacttccccgatattttaaaacggctggatgagatgattgaatggcaaaattaagccttcccgcatctaaaatttttcctgatagtccccgctgtaacaggtttttttctgttcaggcttttccggccagctgacatccggtgccgctcaggtctcgacgcggttcagcttcacgcggtaggttctctgttgctccagcagcgctttctcgctctccgtggcgatttttctgccgcctggcaataacacagcgtccgtcatgtctcgtcgggaatgcagatatagtcgttgcccgcaaaggctcacttattgaaaagacgcataacggcatcaacgctcgacagcttatccccgcccgccgtcatatctgccgctactgaaacgccatgcttaccggcatcatacaggctgagatttttaagggcgtcggcaaccagtcccgcgtctttgatttccgccagcacgttggccgtttgcaggtaatgcttatggggattatcggcagtaacatgtgcgcctgcgccttgtcggtataagcctttacctcagttaacgcgttatccacagcctggcgtgccagcaccacggatgggtcgattttcagcgtgacggcactgtggcagaagcaacgtatacataattacgatatgctctacttccttttcgaagaacctttgaagcacctgatagaaatgggaagaatgttgcggaaagagcccaacagaacggaggcgtgattacgtgttatcgagaatctttaaactgtcattcaaatttgtttccgagatagtgggaacactggttttgacagcaactgtatttggtatgttctatacaggctttatgaatgaaggcgccatgcggatcgtaggacctctcgctgtactaatctgcggaatgggggcttatgtattggtgatgtatcccaccacgaaaatcagtgaaaatgataaaaagggccaacctggttaaagataataccgggattatgtctcaggctaaatccgcacatcggagaaaaacatggctcaggatagctacgctcctgttactcctcctgttaggctaagaatggcacgctttactattctcacgttgacccaatatgtttgcgcaaaccaaccaccgtaaaacaggtccatagatcctgtaagctctcccggattgctttcgctcaacgttttcagctttaccacagttatgctctgagtacattcgtaaagcgtgaagtacacatagcggatctgttatttttttaatctgactaaatatcggtagattttttttgccagatagatagcggcaatacccagcaacatcgatgctataccgagaaaaatcattaacgaaaggaggtggctaaaaatcccgcccagacttgtgaaatcgctgagtctgacgagctgttcaggggttagtgtacgaaccactatttccggaagaatcagaaaacatataatgactgctaaaatataaatcgtcttgtttgttccctttttcattattttcctgtctgagtttgagggtaaggtattttctctttttgatttttcttcatccgtccagtgacctgctcgtgccgagtcaatcagtaattgaatggtcaacgccttttctgctttgccattatcttcgggaaaatagcgagtgaaattgattttatctgggttaattgaaaatttctctgtgaattcctccagtaaatcataggcatctaacgggtccattcgaaaatcttcattaagatcggtgttatgtttgagcggataccgcttaaaggtaaatatgctgcgaccattgtaggtctcaacaagatcgaatactgctttttctgtctcgtccattatcataatccgttcttctttcaggcaatcttattgtatttgaatgttatctcatagctaatcttgtaagcatacaacttagattgctcatccatttataaggatgttgtaacctgattatttactttgagcaagtcaataggggtaagacccgattcactgaacatcctaatacagataatcattgaaatttcatggtgcttttcaaatcgccatgaaaaatattatacgttttaggttatatccacttactatatcttatataaagataagcaacgataccgccccaggcaaccacaaaccccattggataaaatggaacaaatcgcacaataaaataagcgccaacaacactggctataagcggtaaaagatagaaaaaagattgcagtaaccatacaacgaaaagcttcatttactcacaactccatcaaagcctcagctactttatcaaacttgtaatggccacattaaaaacttcacaatagcgaaatttagcttttttcatttaccacacatataattaactcaacatttcacgcacaaatttatcccttcggctcaattccccttgcctttaacgcctccctcgccaggtttttcaaccagcttgccagactaattccttcttcagttgcaacagcatcgagctgttttttcaagtcgggatcaatgcgcatatggaattgtggggacttgcctcgaccttttggttttttttcacgcattattattgacatgtgctgacctattccctcagtttagccttataaaagaccacactaacacgaggccttttataagagcaacgccccggcagtgcagcaacacataccggagcgtctgaccacaacgttcagtgttaaggaaacaacgctatggctaacaccgatagtaacacaaccgcccatcatcaaatcgtggacattcaaccagttatcgaatctgcgatctcaaacctcttgaaaacgccgctcggcaccacgcacgatctcttcctagtgctggatgcatgcgggcgctatgtcgatgccctggttgagtgtaacgatattgcagaccgcatggcgctgtgcggtcgtctgctcgctgcactggaagtcttgaaagttttgttagacaagccactaccagaacacctgatcaagcgcctcacgctggagaaaggtgatgacagagcctgtcgcagcagggattcgatagactcggaagagatgcggcaatattgcagcgcgttaacattagtattgctgaatcagcaggccccggcagacttgcaaaaacatatcaccggcttgttattccagatggttaacatcatgactgatgacttaaccgcgccgcgctttgtgcgaacagcgtcggggctggtgatgattgagagcaaatttacacatatcgttcactgattttggacccttcccttcttccgcagggaagaagggaattcgcatgcaaaatttaaaatctcactgtggactcactctcagtgccaaaatgctttataaccctgagttttcttctgccgaaaataccaccacgattcatcttcattcactgaaaatatattttgtcgtgctgccattcctgaaatcttttcattcccgtacagttattgccactgtccccaagggccagcgcctccccgccgtacagttattaacagcactcccagagggcgctgtcgcccccttaaacgtcaacggcgcgctggccttcagccacgtctgtcagccatcccatccaacccgcatccataaaaaaacccgctttcgcgggttgagcttacagcagctgcggtgacgggttatcgctccctttcgccataaccggcaccgtattgatctgcgccggttcgacgataatcccggatacgctctccagggttttaaaggtacagctgcagttaatgttctggcactggtgataacgttctttcgtctctttcgaaacgtagcgactgcttttcgtatgggcggcggtctgacattttgggcaatgcatcatagtcgttctcctctctggcatagtgcaacattagccaaagactaaacaaaaagcaacttaaattagactaaatctaaccagcctgtttttccactaagacgtaatccacgttttcaatcatcagctccaggttcaactgggtggtaaatccacttttatcgagggtatgcacgatattagtaatcagccatttttgattatcgatgaccgatttaaaaccctgggctttgaccggcgtttcaggaatcagctcagcagcacccagcgcgagtaggatcttcaacgtagcccggttgcgttgcagttcctgccacttcgctttagccgccacctctgcttccccctggctactgaagtgcgtattcagtacgaacagcttcttattgctgccaaaaacataggtttttcccgggtcttgttgcccgatagtggggatatttttggccgccggatggacagggttcaccgccggtgttgctggcggtatcgtgttgacggttacccctttctgctgcgcttttttctgatcgtaccattttgcttcaacgccactgtaatcgtcgcgcttaaacaatttgtactcatacttatcgccatcctgtcggttcagattcaggagtggaatcggctttccgctcgctgtcacgccatgcccgggggcaaagaacagcagcgtcttatcttttatcgccgccacagcgccaaccagcatagccagccgggtaatgaacgtgccgtccgtttcctgcgtctgatcgatatgcttaatcttttttttggctatctccggccgcacgtcggaggtaagtccgttacgtttcgcgattttctccacaacctcgccaaccgtcatgtccggatatgaatcagtgattttaacatcgagcgaaccgctaaaatcggcgcttcgggcgaccaccgttatcgtgtccggcgcgccctggtaggtgacctgatcaatgatgtaggagcctttatttgcaagcggctgtcccttccagcctatctctaagaccactttcgcgccaaagggcggcataaccaactggccgtcactgtcgtccagcaccaggtccagctgatcgacctccaggccacggttatccgtcaacttcagagaaatcagccgtgggcgaatatcctccgttttatccttcgtctcaattttgatattaaagtccggcgtaggcgcaacgcgcaggggcacgggaatcggggcgatatcgctcatctcagcgccctccgttcagcgcagaggtggcgctgttgatgacagagccgacccgttgcgctgcgtcgctggcccggttttgcagttcttccgcctgcctttttaagtccccgaacatactggttagtgaatcgtctacccgcagcaggttgagggtaaagcctatcttgcgcgcgctgccgtcgctgtagaattcggtatgcgtggccgagaaatccgtcacaacaaacatgccgtaaataatgccattgccgccaatcagcggccacgccagcccttcatcggccatagtcttcagcgccaacagggtgacattgccgccggtgatttcaggccggagttcgccagacagcttgattttatcgtcgccgccgcccaaaaactgagtcgactcacggcgccccacgcggctgtttttcgcccagcgataggtaatgtcatgctgcaaattgtcgaagggcagggtttgccgtacaaacggcatcatgcctaatatcatcatcatggttaattaatccagactaaacatggagttatagctgcgatcagccgtggaccacggcgataccgtggaagcctgcgcgacggcctgtccaatcgcctgtgggtcgcccgtcacattgatattgttggtgaccgtgtgctgccggttatccacgtttgaactgttaaccgagggcaaaggctgattgagcgtgctgttcaggctggcgcgcgatgcggccggacgggcatccgcgttgtcctcatcctcgtcgtcctgttcgcgcattttgggcggaggcagcttgtctttcaccttgtcagatttctcatcgatgatgccaagcttgccgagcacccagtcaatgccgccccgcagctgattcagggcttcaccgggtaatttgagtgccgtcgccagcatattgccgaagcgctgtcccatctcccctgccgaggccagttcctgctgagaaaacttcaccggttccagcagctttgagaaccaggagcccagctcagagactttgttgctgaaccagtcaaataccggcttcagcggcgcgaacgcgtcacttatcggccccatcgctgcactaaagccctgagcaacgccgctgataaaggcgctgatcggctcccagtactgataaaccagcatcgcgcccgccgcgatagccgcgccaagcagcacaaccggcagcgtaattgcgcccagcgtcgctgtaatcgcgccaccgatgatggcaaacgcaccgcccagcagttcagcgcccgccatgatggtgctcaacccgctaatgaccggccagacaatattccccacgctggcgagtgagtccaccaacgtcagtccactggccgccagcgtcagcaggctgtccgaaagctggggattgatattcatcacgccggtcagaacggactgtacggataagccgtcctgactgatggtttgcagattggtgtcaacagaggcatctaccggctgctgagccgccggcgcctgagacagctgatccaggcgcccactggcggcacctttcatgagcacagcggcaggagccgcgccctgttcgccaaagatggcctgcagataggttgcctgctgggctgcatcgattttgtttttctcaaatgccgtctgcacctggctgagcaccgtgaaaatcggctgactgttgccctcgccatctgcggtaacaacattcaacgctttcagcgcgctgtctgcattgtcatcaggtgcctgcacgtgcgacaacatggcaccgacgcctgcgcccgcagcgctgcccgtcatgccgttttcggccagcacgccgatcatcgccgatgcctgaccgacgctcacgccggcttgttttgccaccgggccgatgctggccatcgccttgttcagctcagcgatatccggttgcgcaccgctgttgttcggattaacagacagggatgccgcctgatccttaccgttattcgcatccgcaggtgacagataatcgataaccttgcggcccttctcgacgaagtctttggccttgttgctggcaccttgtacgttatccgccagcgccatgccggcgcggtaacgatcccgggtacgattgagcttatcctggcgctgattcagcaaccccatcgactcgccctgcgcatcaagggtggattgggtccgctctgtttgttggttcagcttctggcgctcgctgctcagacgacgcgtggaaatcccggcgtcattcagcgactggcgctgatcctgcaccgactggcgcagctgaatgttcttttgttgtaacgcgttggcagacaggcgcagtttctccagcgcctgcgcttgttcaacggtggggtttttggtgtttttcagttcaatggcgagtgctgccgcttctgcccgggtgtttttaagattttgttgggtcagcgtcagttcttttcgggtatcacggaacccttcaatctgcgcggatttggcgttaagttctgccagacggtcttgcgtttcctggatatccgcagacagcctttctgtttctttacgcacggcattgaacgggcgcgtggcccgatcaaccgcctccagcagcacttgcagcttgagcgtgttactcatcagaggttactccactgcggatcatcactttatgccgccagtcgagtaactcttccagcgacatgagatacatttctgagggtggccagtgaaaaacgctggcaatgtcggccatcaggtcattgaccgttagatcgcggggccagcttacccggccgatttcgctgacaaaaaaccaatcaccttgccgcccagggcaatcaggtccaccggatcgagcgcgttgcactccgctttggtcagcgatggcagggtgatacggggcagcaccattaacagggcatccacatcagacgaggccaggtctgccagtcgcacgccacgcagcgatcctgccgttggtttcaccagctcaacctggctgatcaccacatcaccacgtgaaatcgggctttccagcaccaccaggttttctttcagttgtggtttatcaagctgttccattttttctccatcaggataaagagggccagcgcaggacgcgccggccttttttattacaccaggccgagatttttacgacgctgttccaggcgatcgacgccgttgaccttctccaccatgttgacggtgtcgacttcgatcagctctttgccattccaggtcagtttgaaataggtgtttttgctggtgactttggtttcggcgttttcgccctgtttggcttcaccgaaatcaaaggcctggtgcttaccgcgcacttcgatttccacggcaatttcttcgccggtgtcatcgcgctggtaagaaccggtgaaacgcagcggtacgttggcggttgcgccccactggcttaacaccagctcatccatcccgcccagcgtccactccatatcgagtgcggcatcgtccaggccgttatcgatgaacgccgcaccgttcataccgccagcgcggtaggtatccagcttgcgcgacagcttcggcagcgtcacggcggtgacgatgccctggtagctgtttgaatcattgaagaggttcaaccccttaagtttacgtggcagtgccatttatccggctccttagctgtttacggatgcggcgaagttcgccagataggtgtcggtgatgcgctgacgcagggtcagatcttccagcggcggcaccggtgtgtagtcgtaatcgataaacagtttgcccgccttcagggtctctttatcgttcgcgctgtcgtcgtaccagcagtttgcgcccagcagataaccagcactgaccagctcgcggaacttggcattgatgccagcgatgatttcgcgcaccagcaccggcgtcagtggtttgtcgttggcccacatgtgcgcttcggccatggtatcggccagcacctgtgccgtacgggtgtagttttcaaaggcaaaaagtggatcgtcgctacaggtccggttgccccagaaacggaaaccgtctttgcgaatcagcgtggtcacacacttttcgttcagcagatcggcatcggtgccggtctgttgcaggtcccagaaaacgtctgcggagataccagttacgccattgacgcccacgttggacagggttttatgccagccggtgtcgttgtcaattttggcgcgcaggcccagtgcacgtgcggtggcataagccatttcagatttgttcgtggcggtgttccaggccataaagtctggccagatcaccatcagctcgcgctggctgaagttttcgcggtacttcatggcatccgagatggttttgctgttccaggcagacacgtaggcaaagccacgcagctgctgggcaatgctggccagcgctgtcgccacttccagcgagtccagacctgggacgccgagaatgcggggtttaacacccagttgcgtttgcgcactcagcagcgccttcatgccggtgtatttaccgttcgcatccgtcgagccaatcaggttagaggtggtttcagcctggctcgcgccttctgcaacgcgaaccacgacagtaaccggcttcgcctggtcagcaatcgcctgcagcgctgccgctaaggtgccttttgtaccggctttaccgacggctgcctgcacgttggtcagcaggacaggtgtgttaagaggaaacgccgttgcatcagcatcttctgcggtgcagatcatgccaacaatggcggttgaaactgttgaaatggtgcgtgtaccgtcattgacttcgacgacgcggacaccgtgatgaaaatcagacatctgtagcactccgtgttgagggtgtgctcagattgtcaggtcagtggaaaggatgcattcgattgcggtttgctgatcgttcagtaagaagaaccgcgtaaatggtgctgttttggcgctggaatataacgataaatcgttttgggtgagacatctaataccagcgcaacctgatgaagcgtggcgccattcgccatcatgcgttccgctctggcaacgacttccggtgtcataatgcgccgccggccaccaatgcgccctttttcacgcgctgcggtcagcccggcacgcgttcgctcgacaatcaattcgcgctccatctccgccagtgcgcccatcacatgaaagaaaaagcggcccatcggtgtgctggtatcgatactgtccgtcaggctacggaagtttaccccgcgttcgcgcaactcttcggtgagcataacgagatgacgcatgctgcgacccagtcgatcgagcttccacaccaccaaagtatcgccctcttttaacgtccgcagcgcccgctttaaaccaggccgttcactggtctttccgctgattttatcctcaaaaatctgttcacaatttgcgctctgcagcgcattccgttgcaaatcggtgttttggtcatttgttgacaccctgacatagccaatcagcatcgttttttctccggtaaaaggtgaggagtttgccattgtgcaggtgaggcgggccaggggtttgtttcatcaaaacctcgg

SEQ ID NO: 15 - DNA, 118792 bp, Pantoea sp. OXWO6B1
ggactcatacgggcgaacacaacccctgaggaaagcaggaacccgccgcaatggcgttgagcgcggttgcgaaacggcgttgccccttacatcccgccgtgtgttgtggcgggatgcacggagcgacgtgtacggcgcgactgagcggcgcagccggaacggctgctgcaagcgagaggtgttgcgtccggatggaaacccgctgccccggaacggggccgggcagagacggcctgccggctctgtgcgaagcatgacagccgaccggacgcccggtgagacagccctcaggcacgccgcaacgacgatctgaagggaaaaaaccaacctggcaaaaacatgcccttataaccggcccgcagccgcaaagggaaagagagtggcgcgccagcgccgctctcctttcctttgccgcaggccacaggggtttgcgctcgcccggacgactgcgggggtcggttcccccgcgatccggtcagacggctggcggcagtgcgcccggatagtgacgcgccacaatgtcattcaccttttccaccaggtcaggccgcgtaaaggtgacgtgcgcagaaccttttttgaaggcgcggacggtgaaataggcacaggtcagcacctcacccagattcgacgatcgggcattgataaaatcggccagatgcgcaccttctgaaacccgccagtccggcacggttttgccgtcaagcagccagaacggacgggcaaggtcatttagccgctcctgcccgtaagtgcgcacggaaaaccagcggtttgcgtggttgtctatcacgccactgaggatcacgcgtttgccgagcatgcaggggttattggttttgtagtcccacgacagtttgcggaacacgtcgatgatcccctgctcaaaggtcgcagctttatttgcgttgaggtggcggaatgtggcgatcacgctgtcaaagctgatttcagggcaatcctcgccgtacaactccgcatcccagacttttttctgctctgcgctcatcagcgtcagcatgccggtgtcacgcataagccgatcccatatcgggcgatcggcaaggcggccaatctggcggcggaggttttcactcgccttgtcaccacgtgccgaactgaggccggattcgatgatgtccttcatgccgtaaaaccattcgcgcccggacgcctgcgcaaacgcggcctgcgcctgctgtatcaggtgcataccctgcataaaccactccacgccgctgttgcgctgcgcgattatgcgctcaaccggcacggacgggatgagttcgcctgcatcctcaaaacagtgcatatcggcggtgagtgcggtcgttgtgtctgtcatgtttttctccttcctgtacgccgctgcggggcggcgtgtcatattgttaaggggggtgttcatgcctggtgctgattcggtgtttctgcttctgcctgtgcctgttctgtcacgtcctcagggtcaccgaggaaccagccctttacaggcctgaattcctcgataaaccgtctctgcgcgcgcttcgccgtcacagcctcgacgcgtgtaaacaacggtaacgagcctttttcgtcgctgccgagaaacgcaactttgtagatacgctttgcctgcatctgcctgaacctctctccagtctgttaaagaaccatcatccgctgagttgccggggccgcggttttgacgttttgcggggaactgctgcttgctcaccaggttgtaaccttcacccgcttgagagccgtacgccgcaaagggcgaatcaggcacgggccggtgcagctgtccgggcgcgagcggaaaaatttttggccagacaaaaaattttccggcgagaggcttcagccgtccctggacagccaggcggtttgtggctgtctcagccccggcgtacggactcatgcgcgtgaaaacaaccggcagcaggaacccgccgcaacggcgtgaggcgcgggcgcgaaacggcgttgccccttacgtcccgccgtgtgtgatggcgggatgcacggagcgacgtatacggcgcgactgagcggcgcagccggaacggctgctgcaggcgaaaggtgttgcgtcaggatggaaacccgctgccccggaacggggccgggcagagacggcctgccggctctgtgcggagcatgacagccgaccggacgcccggcgtaaaagcatttttttcgggtcacacgggcagaaaccgctgagtcgctcacgcatcacgacagaaaggcctgaaaaaatggcggcaaacgtcgtgctgaagaatactcttgtcagaggcgttacggtggccgcgccgtcaggcgcgccctgccgtttcgccgccgcaggcgaaggggtttcgcccggccaaaaccggcagcgggcctccctgccctgcttaccgccgttactgatttaaggcgtggtaagcccgtctgagcgcttcttcaatggcgctgggatcgtcatcgccccccgtattcagtaagcgctccacggcctcggtcagaacagccagatcggacgcggtgacagtcaccggccggttacgccgtgtggcagcgtagcggatgccgctggcaatcacgcgaagagtttcggcacccacgcccgcctcgtgttgtgcatccctgtcccatgttgagaggtcgcacacgatttcggctgcggtttcctccgtgatgtgctcctcgctgagtaccttcatcacgtcctctttacgccagatgatcagcgttattttttcctcgccctgaaattcggttttcaggcggtggcaaagctgactgacggttccgtacattttttgactccttacggggggcggcttcaccgcccccgcgctgtcactgggttgttatttgtctgcctgcgctctcagcgcggcgctgacacgtaaaagcgcctgtgtttcgtgtggatacagccgcgcggccgccccctccccgctctgtgcgtcctcaagacgcataaaatcccacgccaccctgagcgcaatttcgagtgcggcggcgggcaccgtcgcttcgcgggcctgcctctcttcctcacggatgttatccagtaccgcctggagcgtttccaggctcacgccgtattcgtgctgatcgctaatcccgtcgatttgctgcaaaatttcgtcggcggtttcgtcgttgatctgtgcgctatccagcacgtcccgtacgtcctctttcgtccagataatcagcgtcatgagttcgtcggatttgtagcgctggcgcagttgctcacagatttcgttaacggttccgtacataatttttctcctgtgaggggcggccccgccgccccgttggtttcagtcaagggcgcagaaaatcgcggcggcttcgggatgaatttgggcaaatgcggtcagctggcggtagcgacggcagaagtgcgcgcacagctcctcgtcgtcgtggcggtcatacagccagctacggtgattcagtaccagcgccgtaatgatgatccccgccgcgtccgaactgatttcaaggtcggtccagacgtgggggctggaaaactgccagcgttcttctccggcgggcttcatgtagccgccgccgtggggcacgcctggcacccttacaaagtcccacaccgctccgtcatagttggccaggtatcgatcggcgtagaggtagacgttgttttctgcacgcatgaagtcgtggccaaacagcgcaggaagaaaatgcagcctttcagcatccgccaggacagacgctggcgggtaaacgtggaattgtgtgttcatcagacatctccgcagtcagaggggattaccgttacggcctgtgccgtgcctgaatgacagcccgacgaaaagcggagtgatcaggagcgacgacgaggccgcagcgcaaacgagcggagccgtgattacgcacggcgctgacgcgaatattgagcggaagcgcgacggaagtaagcgcggcggagggagtgcgaacgggggaggagtcgagcggagcgatctcttgatcacgcagcggtcgggctagagtgaaggcacggcaccggccgcagaccgcacggacctggttttctgccctcccccgccgacaggcggcataaagcggcgcgcagcaacctcctgactctcagttgtccacagcacggtgaataaaccggccggaaccctgtggataaaagcgccgcggcggcagtacccgcgaactgaaaaggagtggtcataaaatgaccactccggcatcttaattcaggtggctgcgcatcagggcggcgcgccggtaaagctcaaggagctgtaaatcgatatcttcaatcagcacccccgccattttctgcgccggcgaggcgccgcggtacaggttgcgctttaccatgtcccgcagccgcaggtgaaactcgtaaagcgattcctccaggtcgttcacgtcgtcggtaagctgggtcagttccgtatttggtgtctggtctgtcatggtgctgtccttctggtcaggttaaggggaaaaatcaggcagcccgggcggcgcgaagttcgccgatgcgcttaaggccggcggcgtggtactgctccagcagttcgatcccaatccagcgccggccgcactggtccgcggcgacgcaggtcgaaccgctccccgcgaaagggtccagaatcaggtcaccgggctgcgtgaaggactcgataagcggccgcaggacgctcaccggcttttcggtcgggtggtgtcggttgcccgtgtactgccaggggatcacgtcgggcagcgggtttgccggcagcggcgggcgccctttggccagcacgtaggcattttcgtgctgatacccgacaaatgccgatttcgaggcgtaggttttggtgaaaacgaggtgcccgacgacgcggaaacccgccgccttccaggcctgcatgaagacgtcgatgcggttccagccgtagaagctcaccgccaggctgttgtttttcagcacccggaacatctgccggctcgccggcagcacccactcgtcgttaacgtcattggcaatcgaacggccggaccggtccttaaagccgacgaggtatggcgggtcggtgaggatgaaatcaatactcgcatccggaaagccggccatgatctgtacgctgtctccacgcatgaaacgggacataattctgctcctcactgtcagagggcacccctgtggtgccgtgaccgccacacagccgggcgaccggctgagcagacaagggcgggcgcgaagccgcacgcgccgccggagcggactgaatgtgccgcgcacggcggggaacgggtgagcagaccggcgaagcttcacttgtctgagaagcagcccggctaccgtgagggcacggcacgttgcatcggccggttttcggccagcggacgggaagcggcaaaaaaggcggagcgaagcgacttcattatcccttactgaagagatgccgccggtcggggcggcatcggggtgaaaggtcagggccagtaatcttcccaccggcagtcgcaccggtcacagatgacgggcgcatccggcgtgccgctcaccgcccactcatcgaggaaccgcaggccggtcagggtgtcggcctcccgttcatcaagcaggacgatgcttttgagccagacgctgccccggtcaaactgccagtagcagccctgagagcagacgggccgctccggtggccaccagttttcacccatccgctcgcacgccgcctcagccagagcgaagtcactcccctggagcagcatgtgatactcgtgtgaggtgctgcccacctcctcctgccagctgacaagccaggaattcatacgtcaccgccctgtttcatttcgctgatggcccgttccagatgccaccagttgaaaccctcattcgcgtcatgcctgtcttcagcaatctccatcgccgctgcaatttcttcccgcgtcagcgccgggtgtaagcgtcacatccacaccgtcttccatttctgcccgtgtttcctaccatggacactttcacgaacatggacactaccgtggacagaaacacgccttacatcagcagaccctggatcactacagcactcagcctgcgttttaacgacgccctgacctaccgtgaaatcgctgagcagctgaatatcagcacttccgctacgcataaaatgttcaagcgttttcgccgtacgggtattaactggccgctgcccgaagactacacgccggaacggcttgatgaggagctttacgctttcaatctggaaacgaatctgcccgtaaaaaagcggcgcccggactggccgctggagttcaaaatccgcatggcggagctgagcctgcagccggacgcctgtgtggcacagctggcccgggagcacggggtcaacgataacctggtgtttaactggcgcaacctgcaccgtcagggcctgctggaccccgccacgcgcgccgggatgataccagtcatggttgagccttttcccgttccggtcaggcagagcagtggggttccggattcgccccccgttatcagctgtaagctgacgctgcccggcggcaccctgagcctgaccggccccgtgacaccggacttgctgcgggcgctggtcagtgagctccgtgagagtgaggtatgattagctttccgtcaggcgcgcgcatctggctggttgccggcgtgacagacatgcgctgcagcttcaacgggctggcggcgaaggtgcagaacacgctgcgggcagacccgtttggtggccatctgtttatcttcaggggcaggcgcggcgatatggtgaaaatcctctgggccgatgcggacggcctgtgcctgttcaccaagcgcctggagcgggggcgctttgtctggccggtgaaccgggacggcagggtgcacctcacgcaggcccagctggcgatgctgctggaaggtatcaactggaagcatccgcagcggataaatcctcctggcctgcgcatctgaaccggcgtaatgtgaatgcatggaacgctcactctctgcagaaaacgcccggctcagggcgctgctggacacgcagcagcgaagccttgagcagatggccgaatacaaccgcctcctgtcacagcgggtggcggcctacgccagcgaaatcagccgcctgaaggcgctggttgcgaaactgcagcgcatgcagttcggcaaaagctccgaaaagctgcgtgagaaaacggcacgtcaggtgcgcgagactgaggatcgcatcagcgccctgcaggaggaaatggcggaggtcctgggtgagcagcatgacccggcactcccgcagccgctgcgccagacttccgcctgcaaacctttaccggcctcgcttccccgtgaaacccgcacgctgactccggaagaaaccacctgtccggcgtgcggcggagagctcagcgcgctgggctgcgacgtgtcggaacagctggagctcatcagcagtgccttcagggttatcgaaacgcagcggccgaagctggcctgccgcaggtgcgaccacatcgttcaggcccccatgccgtcaaaacctcttgagcgcagctacgccggccccggcctgctggcgcgcattgtcacggcgaagttcgccgaacacacgcctcactaccgacagtcggagatatacagccgccagggcgtggagctgagccgtgccacgctggggcgctggtccggcgcggtcagcgaactgctggagccgctgtatgacctgctgcgccagtacgtactgatgccgggtaaggtgcacaccgacgatatcccggtcccggtacaggagcctggcagcggcaaaacgcgcactgcccgtctgtgggtgtacgtgcgggatgaccgcaacgccgggtcgcatctgccgccggcgacatggtttgcatactcaccggaccggaaaagtatccatccacaacagcatcttgccgggtacagcggcatcctgcaggcggatgcatacagtggctataatgcactttacgaagacggccgtatcacggaagcggcctgtatggcgcatgcccggcgaaaaatccacgacgtccatgcccgcacgccgaccggcatcaccaccgaagcgctccggcgcatcggtgagctgtatgccatcgaagcagagatacgcggcagtccggcagacgagcggctggcagccagaaaagccagaagcattccgctgatgcagtcgctgtacgactgggtgcaacaacagatgacaatactgtcgcgccactccgacacggcaaaggcattcacgtacctgctgaagcagtgggacgcgctgaacctttactgccgtaacggatgggcggaaatggacaataatatcgcggaaaacgcattgcggggcgttgccctgggccggaagaactggctgtttgccggttcagacaggggcggagaacgtgctgctgttctgtactcactgatcggaacctgccggctgaacggcgtggattcggaggcgtggctgcgctacgtgctcagccacattcaggactggccagtgaaccggctgcgcgatctgctgccgtggaaggccgatcttacctccgctgttttgacctgacccggttatggcacagagctgaatttaatctgacaggctgctctgtgccagagcggacattgctaacaccagaatgtactgatatgcggggtactggtcacccggtctgctctcctgccccctccgccggaccggaggggtttccattcttattcagaatctgctgaatgaggcgcagtgctgtaatcagaaatgtgtccagccgtcgtcttcggtctccacgcgggctttaactgccgcacccgcagctggagcgggcgcatgaacagcggcaggttttacctggctgcccaggctgaacacagacacggcctgcagaagtaactccgcctgttccctgaggctcgcggctgcggaagccgactcttctacaagcgaggcgttctgctgggtggtcgtgtccatttcagtgacggcaatccccacctgctcaattccccgggcctgttccgcactggccgcgttgatttcctccaccgtatccgacagcttcccgaccgccgcgaggatacctgacatggtttcagaagcgtgaaccacccgttcattgccctgtcccacagtatcggcattggctgcaatcagctggcgtatttcacccgctgccgaggcgctgcgctgcgccagcgacctgacctcacttgccaccaccgcgaagccccggccgtgttcgccggcacgggccgcttccacggcggcattcagcgcaaggatattggtctggaaagcgatgccgtcgataacggccgtgatttcagcgatgcgcccggaactttcgctgatggatttcatggtgccactgatggctgcggtagcctcaccgcctttgtttgccacatcacgcacgctgacagccagccggccggcctgccgggcgttatctgcgttgttttttaccgtcatgccgagctgcgtcatggttgcggccgtctgctcaagcgcgctggcctgttcctcggtacgctgcgagaggtcagtattgccctgggcaatctgggtactggctgatgccacgctttctgcattgcttcttaccaggctgactgtgttaatcagtgagtcctgcatgtcactgatggccgacagcagtgtgccggtctcatctttccggtctgcccggacggtaccgctcaggtctccgcgggccacccgccgggcagcctcaacggccacattgagtggacgcgtgatactccgggtgataacccaggcggataccgcggccaggagcagagcaaccacgccggcagtgactaacatcatcagcgcagcggtgcgttcctcgcgcgcctgggcggcggctgaactcatgcgcgcttcctgaaaggtctgcatttccttgagggaagccataaagtctccctgcgtctgatagcgtggaccaaaaagcagccgggtggcctcatcacttttgccctgctgcgcaagtgccaccacttcatcgatgaagggcaggaagagttctccatgggctttgaggcgggtaaagatttcggttccctgaggggtgttgacctgcttaccgataagactgatgagactgtccacctcgtgcctttcaccccggtaatcgctgatggctttttcccttttagtgacgtcgctgagaagaatcgcattccgcgcaaggcggctcatgtctgaggtgtaatagcgcagcgaaagtgaagaggaggccttactgtaaagactgccggatatctcgtcgttggtgctaccgagagagtttattttaacgatgccgatgagcaccataaacatgacaaggagtgccataaagccgaaggcggcaccgagccggattcctattctgatattgttcatacgggttccatggtgtaaggcgccagcatgaaagcatggtgctgacgaaaaaaatcactcccgtttaacgggaggatactggtatgaaatgccgcagcatctagctgcagcactgttattatcggcagtggtcagcaaaggttcacccagccagtttctttgcctgagactccggtcaccatgatgcagatgaggcgaagggtcagagtattagtccagggcctggtattaatgacagggactggctgaatctgcttcagagggagtagctaatcagcacgcatgtttagttatacgggtttccggcagcataaatgctgcatacgaggcatttatttgtctgtttcatcgccgtactttttttcagcctgaacgtccgatttgtgccatgaacggacgtaattattctggcctcatctatgcagctaatagagttagattgtgttaaaaagttgtttcaagacagccgtatctgaaccctgatggagcaaaaatgagaacgcaaaaaaaatgcatgggttatgtggccatcgtggtcgatgactatgaccgcgcaattgattactacaccgacaagctgggctttacgctggttgaagacacgccacagcctggcaagcgctgggttgtggtgacaccgaacccggagagcgactgtaatctactcctggctcgtgcttcaaacgagcggcaggaaggatttatcggcaaccagtgcggcggtcgggttttcctgttcctgcagactgacgacttctggcgcgactataacgccatgaaggcaaaaggcgtcaacttctgtcaggagccgcgagaagaggagtacgggatggtcgttgtgtttgaggacatatacggcaaccgttgggatctttatcagaacaggtaacacaaaagctctgatggtcaggttaattagacataagcggccccaaaaccaggtccgcttttcgcgcaaagcagcccctctctaattgattgtgctaaatcaacaaaacctatcagctaaagtctgagctgatgcaccttcatgcgagtgtcaacacggtcaatatgcgacgcttaccgccgggtcaatgctgaggaagtcatctgccagccagaaggtgccgcagcacagctcgtcatccccgctggtatcgaggcgcgccttaaattcacgtaccgtcatttctctcatgtcgttttccggcggggcttcccccgccgcctcctgtcagccaccgtagtgcccgacgttgttgataatccagtccggcccggtcacgctgacgtgaccgtcctcattctcttctccccactccggcgggctgctcaggctgggcatgatttgctcctcagtcagtggttgcacggcctcacctgctccgtgccgccacaacagccgggcgaaaagcggagcagtcacggggggacgcgcaagccgcacgcgccgccggagcggactgaatgtcccgcgcacggcggggaacgggtgagcacgacgcccttgacggcgacgcggcccggctaacgtgaaggcacggtgcaggccctggaaaaaggaagagaacaattcatgagtaagggaggcgctccggtgccaggcgaagcggggcgccggaaaaaagcggagcgcagcgacatccttcgtcgctgaagcacagaaagtttctggttgagcctgtcgttgaatgctaaatttcccggatcgaaccgggttaagacagggaaatgacgatgttaaaggcgcttgtgacaggaaaatttagtctggcgaaaacattctggggatggggattcggcggaaccgcgctgattgtggccatcagcaaggcgggtgtatatgcaggccattactgggtgatcccggtgagtcatgtactgcaggccctgctttcactggcggtgctgtccggcctgacgttcatccttaaggagaagcactcctttctgagtgtcttactcggcggcatcgcttttgccatttttctggcgcacttcatcctgagcgcaatatttgccgtgcgcttttcgtctgtgatttttttctgatcaccggcaggctttaaaataagatggaatgcttcagctaaaaaacctgacacagtgtatctgtgccagatgacattcaggaccggcgtcttaccccggtcctctcaggagagggctgcagatgaagccgataacgccctcttacagactgacaaattttttgagtaccactgcgcggtacgttgtttatcatgaatgtgctgtgagtttccagaagcctcataagagtagtcacttgtcctttttgcccggttatccgggcttttttaactcccctgactgagtttcctgagttccgacatcgcctgacggaccatccagaagccgggcgagtaaaacacgcggcccagcttctccgccacggcaggcgtgacggtcagtctgtcccgcagaataagcctgacctcatgctcctgcagcctggaacgccggcaaaacttgtccacgctcatatcgtattcggccaaaacgccccactgattcatgctcatccataaaagctcccttcatccgtgattttcacccgagcataaaacatgcacctgccctgttcaacgttcacacagccagataataccgcccttaaaacgtgagccggcaacgctcgccgcagaacacggctgaggcgtaccgcagcggagcgaggaacgaacagccgtgtcgaggaagcgtcatttcactgatgcccgtaaggactacttacgtcctccccagcccgaaactacattacagaaagtagttcctgtcagccctgcatgactgtcattttttttaatggagcatatatatttactatccccgataaacttcactgcattcttcaggaaaaatacacggctatttggtataaacagcacctgcacagacacaataatctcaaaaattaatacggcgaaaaattttactgcgcaggaaacagtctgtacaagcacctttttccactggcttatagcactcatcgtcagacaaaggatacagaaacatctgcatttactaacaggagttagatatcatgcaatttataacaaatggcccggatataccggatgcattactcagggcgcatgaagatggaaaagtaatatttttttgcggagcaggaatatcaatacctgcggggttacccaattttcagaaacttgttgatgaagtttacactcacacagacacatcccattctgatgctgaaaaagccgcctacgacaataaactctatgatgcgactctgaaccttctggaaaaaagattacctgacgggcgcaacaaattgaggcaggcaatattttcgatactttcaagaaggtcatggtcaaaaaaagaaactgaaacacatcgtgccctactagagttatcaaaaaatcccgatggtaaatatcggcttgtaacgaccaactttgatcgtcttttcgagtccgcgtcaaaatatttaaaatcaaattttgaatcgtttgcagcgccaatgttaccgataccgaagaaaagtcgctggaacggactggtataccttcatggcttacttacacctgatatgactgatgccgacctgaaccgtttagtagtaactagcggtgattttggacaggcttatctgaccgaaagatgggcttctcgattcgtgagtgagttatttcggaattatcaggtctgctttataggatatggaatcaacgatcctgttatgcgatacatgatggacgcactcgccgcagacaaacttgcaggggaatccactcaaaaaacctgggcatttggtggtttttttaagggagaagaggaacaggagaaggcgatctggcagtctaagggcgtttctcccatcatgttcgagataattgataaatacgattattctctgctctacaagaccatcaatgattgggccgccacttatcgcgacggcataacgggtaaagaaagaattatcactgaatatgccacatcttatccagccaacagcacgcgtcaggatgattttattggcagaatgctttgggcattatctgataagtccggtctccccgcaaagctgtttgcaaatcacatcccggcacctgatcttgattggctttttaatgctttaatgcaggagagatacacttccgaagatctaggtacatcgacaggcagtccttctccacatgaaaaacttaaattcagcatgatatcgaggccttcaccaaattatcacgtcatgaaaatgtcagtcctatcagagagcccgatgggaaatgactgggatgacataacgtgtcatcttgctgactggctgttacgatacctgaatgatacaagacttcttcttgctgtagctaacagttatggatgtttacataaccaattaaaaaacagaatcctgctaaaattgagttcttacgcaaaatgtacgaatttaggcaataccgaggaactacataaaataaaaaaagactcacctgaagctattcctgggcatttaatgaaaactctctgggagttagtactttgtggccgagtcaggcctaagaatgctgtagatatatatttataccaatggatggctcgattgactcatggtgacatatctttccctatgcggctagaattaaaggaattgctggcacctaaactatttctaagagaaacctcttatatttcttcactgacaaatgacaacgttaaatctgaaccaacgaaagttggtgagctcgttcatttcgaactggtactcaattcagagcatgctcgtactgtattaaattatagccataatatattgatcaggtcagcgctgccaatgctgtttgaggattttgaagacctgctcagagatgcaatgaatctactgaaggcaattggtgaagcagatgacaactcagatcgttcttttctctctctgccctcaatatcagaacacaatcagaatcgtcgtttcagggcatgggttttactcattgatttagtacgtgatgcctggctggaaatccttgaaaaagactttaatcgcgcaaaacgattgggatgtcgatggtttgaggagtcttttccagtatttaaaaggctggctttttttgcagcacgacatgatggaattgcaacatctgaccagtgggtacagtggttaactggtgtcaattcaaaatggctgtggagtacagagactgcacgggaagtctaccgtctgttagtcctgcaggggagaaacctatccccctcggcaagtgttgtactggaaagcgctattctggatggcccgccccgaagcttgtacagagaagatataactgacgaaacactgaagcaattgtatgacagggaaatctggcttgctctggccaagctagaactctcaggccatgctcttgggtacagagcaatgctacggttcaagaaactcagtaaaaaaaatcctcactggaaactcgcagaagatgaaagagatgagttcgccatctggatgggtgacggtttaagttcagatttcaagtctgatcgcagtacagaagtcgcccctgaaacctttgagggtatggtagcctggttaaggaaagatcctacaaaaactcacccgtttgcagacgatgaatggaaggacagatgcaccaatagtttttcccaatctctcagagctttagagaaactggcgaaggaaagtttcatccccacagaacgctgggtggaggcatttcaggcatggagtgcggataaactcaaagtgcaatcttgggagaatgcggccccggtagtttacaggctgcctgatgataaaatcgaggagatggttcctcacgtcagcaggtggatagccgtttgcgctaatacaacgtcaaaacacagaaaaatttttacgacactgtgcagtcgcattttagccatgcctatacctgcagactccgatataacggttggcgataagccaattgatgatccgcttgtcgaagccatcaaccatcccgtcggtcatattgctgatgcattgattggggatatcttcagaaatgaaattgacgataacgataaaattccgcgcagactgagacctgttttctctgaaatctttaacacagaattggaccgttttcgccatgcacgtgtgatattggcaaccaatttaaatggccttttccgaatagacccggaatggacgcaaaagaaccttttaccttgttttagctggagtaatccttcggaagccagagccctttggtcaggttttctgtggacggcccgtctgcacaaacccttatttataaaaattaagcatgatttcctctcaacagctggcttctacagtagtcttggagaacaaaaaaaacactatgtgagtttactcacttacgctgcgctagaaatgggggaagaattcactgaaaccgacctaagggacgctttcagaaatcttcctacggaaggtctggaagatgtttgtatgacgttgattaacgcgttagaaggtgccggtgaacaagggacatcatactggagaaaccgtatcaggcctttttggaaaaagttctggccaaaatttgaggacagaaaaacgccttcagtttcagagaaactggtcagactggttattatgtcaggatacgagtttcagtcagcatatacactgctcatggactggtttcttcccttagaataccttcagtactcaattgatttacttaaaaaaaatgaaatatacaggatgtacccattagagtcgttatttctactggataaaataattgattgccagagtcatgttccatatggattgaatgaaatcctcactgagattgaagatacaaatccggatctgggtaacagctcaccttataaacgtatacgtaactttatcaacctcagaagtgcttaatgttcctctcttagaggagaaagaatctaactaattatttatgggccgatagggggcaggctcttaagtgagtaccctttattgggagcaattgagctgacgatgaccttaacgcttgctattgttgcctgaacttttagattgataaaaaggacctttttaaatgaatgtcagatacctgtatgggaagaaagagttcctgttacctgtgattgaagataaagccggactccgtctgagtgacataacccactattctcgaatggaaaatgagaaaatgcgcgataacgaaatggaaaaaattttcgtagtcgacagaaaccattttagcctgaccgtaaacaatatcgttataaaccccaatgaaatgacggccgatccagttttcaatctttctccaaagcactgttactgtatttgctttaccagcagaaaaaacgacgaaattttgttcgatacatttaaatccgatatatgcatcggatttgatgtcgatatgctcaaggaaagacttgaaattagtaaagaaaaatttcccggagttgagcttatcggaaaagaagttacctattatcatcctggaaccccacctgatgctttcacaccaaaagaactggtgttctataagccagcgaccttcagtcatgaagcagagtaccgtttagcaatgttttttcctgaaggaaaaaaggggttcacaaccatcgatggcactgtaatacccttctggactgaaggtgagtcaactcatatgactgtaggtcatcaaaaaaaaggctttatcagcggctgtgttactgaagtgttttataggaaggattaattcaacttttggcatagattgaaaattacgccttttaatcgcaaggaggaaacgctcgacgcagaacatggctgaggcgtaccgtagcggagcgaggaacgaacagccgtgtcggggaagcgtcatttcactgatgcccgcaacgactgcttacgcgctcccctgactgaaactgcctgacaagaaaattattagcctgctcagtaagataagcgtcccctgaattgccaggtgtccggttccccttgccatgcgactccggctcaataatactgtttttatatacagtgttatttaagggggaatttatcatgtcagaatcattcactgccgcaccggcttcaggccattcagtccggagaacggcaccatgaaagcaacatcctcccggggcggactgacggtattcaggcctgccgacatccgtcccgtgatgcgcatcccgctgtttgttgagcgctgcgccgccggatttccctcccctgccgccgattatgtcgaggcagagctggacctgaacgagctctgcatcacccaccgggcagccacgtttttcgtgcgcgccagcggcagcagcatggaagacctgggtctgtatgacggggacgtgatggtcgtcgatcgcgcgaaggaagccacgcacggtgacatcgtcatcgcagaggttggcggggaattcaccgtcaagcgcctgcagctgcagccacagattgcgctgcgcccgatgaacccggcctatccggtgatataccccgaggagctgcaactgctgggcgtggtcacctggtttttccacaataccgaggcgcgccggaggtaaccatgccaatgtttggtctggctgacgtcaacagcttctatgcgtcctgtgaggcccttttccggcctgatttgcggggcaaacccgtcgtggtcctttcgaacaacgatggttgtgtgatcgcaagaagtaaagcagccaaagccctgggcatcaaaatgggggtgccgtggtttcagttaaagtcgcagcaattcactgaaaagattcatattttcagttctaactatgccttatatcattcgctgtcgcagagaaccatgtcagctctggaggaaatgacgcccagagtcgagcagtattccatcgatgaaatgtttctcgatctgaccggcatcgatggctgtgaggactttgagcactttggccaccggctgcgtgcccacgttctggccagaaccggactgactatcgggatcggcagtggccccagtaaaactttagcaaaatcagctcagtgggcctcgaaagagtggccccagtttaagggcgtactggcgctgacacccggaaacccgaagcggaccgaggcgcttctgatgcgccagccggttgaagaaatatggggtgtcggtcggcgcatcggtaaaaaactgaacctgctcggcatcacgaacgcgctcgagctggcgcgaacgcatcccgccttcatccggaaaaacttttcagtggtgctggaaaggacggtgcgggagctgaacggcgaggcgtgcatccccctggaggaaatgccgccggcaaagcagcagattgtctgcagccgcagtttcggttcacgtattaccgcgaaagtggccatgcagcaggcgctctgccagtacgccacgcgcgcagcggagaagctccgtggcgaacgccagtactgcaggcacatcagcgtgttcgtccggacttcgccgcacgcggtcggcgagacattctacggcaacacggccggggaaaaactcaccctgcccacgcaggacacgcgcgatatcatcggcgtggccatgcgcgcgctggatcgcatctggattgatggccaccggtacatgaaggccggcgtcatgctcgatgacttcacccctcacggcgtcagccagctgaacctgtttgacgacaaccggccgcgggccaacagcgcgcagctgatgcaggtgctggacggcattaatcagtcaggcctgggacgggtatggtttgcgggtcagggaattgatacggagtggaaaatgaaacgggacatgctgtcaccggcatggaccacgcgctggagcgatatcccggttgcccgggtaacctgaattagcgccctgagcaggtgacagtgcaaacgtcattcagacttcatgtcatcctgactgaaccggtgggactcgtattttgaatgtaactcatcaatcaacacaatcctgtcgcctgtgggagagacgacatgtagattttcgtcagttgcgccgcgtaagtcttccatgctctgtaccacagatgccaccgtcataactgacgagaatcgtaagaacgggtcattattccctgccactacgggtacagcgggatagaaaatggatgccgtcggctcgccgagaatttcgcggatgcgtgacagtttatcgtccgtcagcgtggccgcaaatgcctgttgtctttccacactcagcccgttaacgctgatcgtaacttcgaccctgttggccggtttggccgggcgcaatttagacaggtcccgcaggtcttcctgcaacgttttgtccataagctcaacaatcatgagcttgcctgcttcaaacccgagccggtattccacccagtaaatcagctttttattgcactctctgactgacgtgtagatatcgactgtgcccgtatgcggcacaggcactgcggcggcctcccctgccccggcatcactgacgttcctgtagagctgcccgttgaagatacagtattcggccatgccgtattccatatccaggtctttggtctggaaatactggccattgtggctgcggtcaaacccttcgtgggtaatgttaaccggctggatatcgctgaagctgctcatggtgcctgccttaattattaattttcagactgtcgttaagctgcgcgctgagggtcattggaaattcaaggttaagtttcagcgctgctgcttgttctttttccaggtatcattggccagaaaagctgatcgggtgataaaaactccccaaaacagctggagaaccactttggctatgacactttcgataacccctaacagaagtggagctatacacgccattccgagtaaaaagccccattcagccgcactttttctgtctttaccggtgagctttgtaattcctatataccctgagacaagatataaaaaccttttcatggtcacctctttattttgatgaaaacccacctcatcaaagttaagcatctgaaataaaatcatttttatttatgtatatacataaacatatacataaatcattaacaaaactgggtaacaattgaacgtcatatgtatatacctttgtatacacatttaatctgtgtatacactcaatctgtatatacatttatatatacatttaggtgttttcaataaccaactttgctaatttttcaatccatttgtcatcatccatgtgacaagcagcccttagaacacgggatcttgaaatgtttttaagaggaaggtgctcctgtactctttccaccagtaaggacagtgcgtcatcatctaaaccagttaaccgaaggttcatttggcggccagtagttatatttcttttttcaacaactcgggtaaccccttttgctaccctgtcacttcttgccatcttcatcccctttgatgatgcttagcagctcctgagcgaatgctttgtagtcgcggtaaggcctttcgttttttgcgaaagtcataaccggtctgtgttgttcagtagcttgcttatacaattcactgtaacgaatctcagttttagcgagattatatttgccttcagctatatagccgtctatggctctgagcatttttgagtgcgagacattcacttttgtctttacaagtgtatatacaaaattctcatttcttttgatttcccggacaacctggaaaaggtcgtcaatgcctttcactgcccttctgtccatatctaccggcacgacgataaagtcagtaataagcaatgcattctctatgctcaggtctattgctggccttaaatcaataagaatgaagtcgaaatcagtgttaagtcgtttgaggccttcttccagaatattcagcctgtgacgaaaacgttctgcgcttctagcttctacagcaagtgttatatctgcagggattacataaaggtttggtatttcggtgtctatgtcacgagctgtataaactattttgttgatatcgaatttaggatcttcaaacaggtcagttacggtgtagtcttcttcacccctcccaacatcatcactaagattaccttgatggtccaggtctacaagtaaggttttaaaacccattgctgcaaatgcacaaccgacagcaatacatcctgtcgttttagcaactccccctttgctgttagcaaaggaaattatgtatggctttttcattgagcaccctatgtatatacaaaagtatatgcatattatctgaaccaatacgcttgtcaatgtatatacaaaagtatatgcacattttgcttgaagtatatacagatgtatatacaaatatatcttatgtatatacaaaagcatatacttataaggtatccatagagatacatacaccaataataacagtaagttatatataggaaaaaagtaagagactgatttaatcgcattgttaggggagggcaggggactgatagtccctgagtttttagttagaccatactaataggctcacaaaatcagtgaccccgacacgaaaatctgaactgaggtaatgttaatgaatcatcacgatttgccgaagtgcaggtcaaagaggcttacagggttgtataagcaaacaggcaactcatagactatttactgtacgagcgctataatcgcctactaaccgatgttatcaggggaattcaaaatggctaacaaacccactcgatgtgaagttactggcattgttaccgtaaagattcgcggcggaaagtctggttctcgtaacgtaagtcgccgttctatcgctaaatccgcgatggataacgctaaaacatcgttcgaaattgaaggtcaccactacagcaactctgattggtctaagatcatgcgaattgccgatcagctggaagacgtaatttaatcaatttttgaattaattaatgccctatcgagtaatgctgttagtcttttggggtatccttgcacagccttccatactgcaaagtgatagtatcttttctttcttttactattcatagatgctgataaatcgaagtcatatccccttgttttagcaactatttccagatagagcctcatcgtgcgaccatttccgtcctcaaacggatgtatccacgcaagctctttgtgcgcatagacaagcgcattaagcatgagcactctgtcatttcccactttaggtaaatatctggtgctaaaagcattgcaaaaaaccttcattgaagcagcaactttagaggggtgcatagtgggatgttcacgcggacctataaccaactcatgtgtccggtagtcacctgcccatgaatatataccgctgaaaagtgcgaaatgacattctcgaaatgttttctcacccatatgaagtgattgattttttagatatttctcaaccagcctaaagcttcttataggcgcataaatatcttcaatcttatccagttcatcctgataaactgcataaacttgattcggaattgcatttactcggccctttagattgtttgatacaagaaaaaaattgtgaggtaaatattctacccacgtttcaaaaaactttgactgaaggtgattaggttgaagcctaagccatgtctttccgaaatccttttttatgcctaccacggtggcgcaaaccagcggttgtataaccttaccaaaaaagtaaactactgagtcccccatttggatctcatccctagtgaggtcaaagtgtgactgactatagcgttcaaggtgtgcaagggaaggtaccggaaaatgcacttttgaaccaactatgtgttcctccttatttttgttggagtaaatatggatttccccattttttaccggcgttgtctttaggtgaacaatttttttttctttaaaaaaaggatcgttcaaatgaaaaatgttgtcgggtacttttatatgttttttcactaatcaacatcctatgttcttgctaacgatgaaaagtccatgcgctgcgggcttctgcatcccatagacatggatagtcttaatatttcaagccagcccgcactattatcacttataacttgccttatatgaccacaattatcatcactctaagctattcaagcaatcaacggaaagttggtcacgtagatagttcaagattgcactcataatagatggctttagaaagctgaggtgaattgttcacattaaaatagctagcaattaaattgcacgcaattattttgcgaaaaataaataaagttagaagttaaactcatcaacgcagtagtaacgttagttatgataattgataacatggttatcgatataattatcaaccactaaactaatccaataaaaattaattgattagcaaattgtcactagattcatcaaaaaagggcattttaagtggccaataaatagatagccaatttaagctgctaaatgttattattgacctgtcaaaagcaacaggccaattaaggtatacctgccgtcattccttcctgagcattgccaccgcctcattgcccggcatagaaaactgcacccggtgacgcgccgccacgtccagcgcaaacaccttcgtatagatctccgtcgacttcaggctcttgtggcccatgaggctctgcagcgccttcagcgggatccccgcgtaaagcatgtgcatggcgtaactgtgccggaaggtgtggggcgttaccggcaccgagaaggtcacgccgtcggccgcagcggccgccacggcttcgttgatccaggtccgcacggtgcggtcggtcacggtccagaggcgcaccttttccgtccggccggagtcaggattgcgccgctccaccgggatccgcagcgtggccaccatcatctccagctgggcgatgtactgcggatccgacagcggaaccagccggtgcggcaccacgcccgacggggtacgtcccggcccgcgtacggccttttcaccgcgctgcttcagcgtggccagctgcacgaagggatggggcggcgtcagggtgaagtcggcgcgggtcagggccagcgcctcgttgatgcgcgccccggtgttccacatcgtggtcagcagcatcttgcggtgcaggtccggcacgtaatgtaaaagtgcgctgacttccggcgccagcaggtattttggcaaatcgtcgatcagcgcagccatgtgacgtaacgccagcgcagccggatagtctatagctaccggaagtgaggcagcctgtaacggctggccatagggaagcatacccgtcatgtctttctccggatgaggcagcaggaattcatgtcagcacgcatttttctctttcctgtaagcggcagtttcagcctgcatggtagcgtggaaggcctcaagaaacagggtgatgtcactgagagcacgctccaactggtagcggcctacgacggtttcagtgtcatactctgatatgccgttccggtgaaccaggtcgtgcctggtattaacaatgtctttgagtcggcttacaggccactcgggctcctgacgcagaacggcgccaaaatacctttcaatatgcttcacattatgaaacgtcattcccctgacaatggcctgcacggcttcacgataagcgtcagcgggagccaccggctggcagcacacttttagaaactttgtctggttatctctcagtccgatcttatgctggtttgattggaacagccggaggtgtggctcatgattgagcagcgcccgggcgcagtacatcaggcaggcttccataatgcttaccgcgtgaacccacgacatgcgtaacacgatgtccggctggaaggattggttaagcccctgcagcgttctcagttctgtgaaggcatgctcacagcgggcatcaacagagttgagtgaggcggtaaactcgtcccgcagatagtcttcatacgcctggtctgacagaaagtcctgccagtcagaataaatctggccgatggtttcccactctggcgtatcgggctgtacctcaggatatttctcggcggcccacgcctcaaaccgttcctgctgcagctccaacataagttctttggcacttcccatccgagcaatcctccggagttaaattggtttcgctgtattatcgaataacaccctcactctttaacgcgaccggtgtccagctcacgggccagttccacaaattcttcatgtccggtctccagatagcgcccgtagatacgcgcgtcgtgtccggacaggccggacgggttgcccgtgaagtagtcctgcagcacccggatgcagtgggagtaggtgtccagcccggaagcgaggacgggcagcgcgtcctcatggatcagctccgcccggaaggtgtcatagtggcggcgtatcaggccgagtccgcctgcggaggccatccggcagttttccggcagcggacactccgcggcgttccggatgagttcaaacgcgtagacaaaatcgttgctgtgcgtgatcagcacggacatgaacgttaccccccgtaataaaaagccttgcagtaatgaggaaggaaaacagtcacctttcacccagtagtgcagctgacagttacttcactcatgattaccttagttaactgtcagaattctgacattaacaacagtcagaataactattctaacagtcactcagatgactataactatacttacagttactgattcatcagtaagcctgcttttattcccgcaacgcaattgccggaagccagcattcaccggatccgactttttccgattatggcagtaaccggaagggtagcacggcggcggggcgggcagaagcggggtttaccgggcggatttatgctgacgcatcccctatgttgtgtcatgtgcagctgagtgagccacaacatgtggtgtactgcgcagaaaaccgccaccggaggaggaaagatccggttctgtcttttttcggatcttcgataaaaagagacaaataagaatatgtgatgcatatacatatgtcctacatctgcatatacttaacagatgcatatgctttacatctgcatagacagtggatatgctttatctatgcagcgttgtactgccacaaaaaatagccggtatcggcacagtgtcggacatccgaccggaaggagtaaccatgagaaccgtatccatttttaaaaacggcaacaatcgcgccattcgtcttcctcgtgacatggattttgaaggagtgagcgaactcgaaatcatccgggaaggggacaacatcatcctgcgtcccgcccggccgacctggagctcatacctggaactcgaaaaggccgatccagactttatggcagagcgcgaagacgttgtcagcgacgaaggacgatttaacctgtgaacacaacctatatgctggatacctgtatctgctcgttcatcatgcgcgagcagccggaagccgtactgaagcgcctggagcaggcagtgctgcgcggccaccgcatcgtggtgtcggccatcacctactcagagatgcgcttcggcgccaccggcccgaaggccttgccgcgacacgcactgctggttgacgcgttctgcgcccggctcgatgccgtcctgccctgggatcgcgccgcggtggatgccaccacggagattaaagtggcgctgcgccaggccgggacaccgatcggcccgaacgatacggcgattgccgggcacgccatcgcggccggcgccgtgctggtgacgaataatacacgggagtttgatagagtgccggatctggtgctggaagactgggttaactgacggcagaaagagctctgcagtgagtaatgtccgctttgtgccaaaagcggacattgtcgctaaaagtcattttgataaattgaccttagagataggtagttggcgccaggccagctcatcaagattagaatgagagttactcaaaaggcattaactaacgcttcaatcaaaatagataagcaacgtagcgaaagccaggcggtaaaccgttgtcccttccgccagacactggctctttgcgtaagacattcgttgtgccataaacgaaaattgaccattaaggcaccaccgacatagattttcccggccccagcttgagcctaaactgttagtgcaatcccgcagtaagcatcagctaacagactttcggtttgtataaaacgggtttatatcattacagcacgtgcaccgcgttcactattgtcagtactgggcgaaagagagtaaaagggctgagcctgcatacgttctggagcattaaggtcaagaacggggcatcttggtcgctgttacgatcggggtgtgctatgccggtataaacgacggcgagagcaagtgcgctaacgtaaacggaaagtactgccagtcagcagatatgacgaatcaacatgaatacttattgattgattaagacacatagggcgcgttcggttttaagccagtccaaatattttactcatgtcggggcaaattaaatttcttgggtttatttgccatcatctgaatcacttggatgagaagaaaagacatagctatctgctttagtagtagcatagcgaaaccccattcatgtaatctagacgatctttacctaagttgtgttgcatacagcaattaacgaactaaaaacgaggaaaatcatagatgagcaaatgctgggagcagatgggcattagcaaaacagattacgatgagcttagctttaaacttgaacaaaccatgacacgaattacccaaactttctccagagatactcatgcatctgaagacagttttttcatttctttcatggctgccttgagttttacattaattacctttggtgaacaatattatttggaattcaaaagttctaagacaaatcaaaatggtaaaaatgcccctgagaaaaaatatggctgcgattttgggctacgtgtgaatttcaatgctcagtcagtgaatccattttctaaagctatcattgggcaggcaaaaaacaagcccagaagagatgtcgaaggtgataaaggcgagaagaaaaggctgggtcgacaatgcgaagcaatgtcagaagttacgagtaattatatagtaacatttcgccctgcatcagatgaaagtatcccccttgtttacctaggcgatcaaaaaaataaatcttatgaagtagaaggaataaggtttgataaatatttattagaatatgtattgccttgttcacatggtgaaaaagatacaatagtcatgggttatatgatctcatcgacccatagcggctggagcgactacgttagagtatttgaaattgatacaaatcttccgaaacctaacccagcgccagattcagcacccgaacccgatccacagccgagaaaaaaacctaaaagatcaatgagatgaaattaaatatgcagttaagggccgctcagcgatgtttctggactcctgccgtgcgccctgctgcctctctattcaccggcggcacaaaccgccgccaacgaatacggacgatgatttaaacaacacctggctctataacccgattaatttttttgagtaacctaatcatgagtcaccattgattcattagtcattttctagtgttgtagataattacgaacgtccgttccgtacctcaagcggacatttccgatcattggtctgccaccgctgagctgcaccatggcattcagtatatgtctgctaacatgcgcgcattactatcgcttctggggaatactgatatgcctcaaataaccatccatattctgaatgctcaggaaaaactcaatgctcactgtgaatggctgcagactagtctgaccgatacctacctgcacgttacaaggttgatgccgaccccttcagtggatgtcgtagttaaagccgggaagtttattatccctgaaaaagggcatagcggtttttgttctgaagatggtgttatctatataacagtagatcctgaaaactctgcattctgcaaaaatgatgcgcactctattgaacgtatgttagcccatgaactgcaccatgctgcaaggtgggcagggccaggatacggctcaacattgggagaagcactagtctctgaaggacttgccgggcatttttctcttgagctttttggtggtgaacctgagctttgggaaagcctcaagcccgatactgttaagccatactgtccactaattctcgaaaactggcatcgcacagattacgatcataacacctggtttttcggaacaggagatttgccaaggtggcttggatatacggcaggattcaaccttatatccagatatctcgtagcatacccacatttaaaagtatccatgctggcgaacataaacgctgaggaattaaaggcttttatatgaagtgaagacttctcatttctctcaagtcattattcgactcataagcaaaagctgcatggtccgcttttcgctcatagcggacctccagctcagtcagcatttcagctttgtgccagaagcggacattgacactttcagacatggccgggatcgggcgcctcgggataaaacgggggcttgtcgtacaatgcatcaaacctgagaaagtgaaaaagtagtcgcaaaagttattactggagtatacgttccggagacgtgccttaatgaaattaaaaaacttggtgtgcgattaggtcgtcaggtgtctgtcagtctttgcagccaccttattgaagagcctggtcactcgccccagaacgtgacgagggagactagatggttcagagcgcaacctttccggtggatgtgggctggcaggctttactgaaagacctgggcctgacacctgcgcaggttttacgccgcgccgcgctcccggaagacttactctcgggaggaaaacagcccctttcaacacaggactatttccgcttatgacacgcgctggaaactgagtctggtgacgcgatgtttcccctgcgagtcatggaaaccctgacgaccgaatctttcagcccaccactttttgccgccctttgcagtccaaaccttattcaggctgcaaagcgcctcgccacgtacaaaaagcttgtctgccctatggagctgatgctggatgtgggaccagagggtgaactgacagtatctccacgctggctgacgcttcaggccgaggctccgctgtcgctacaaatcgcggaaatcgtcttttttgtggtttgcccgtctcgcaacccgcgagcctgtccgcgcttgtcgtgtggtactgccagacagtcttcccgaaccccatgcccgacgctatgagaaattcttcggtaccagcatcatgaaaggaagcgtgccttccattacgtttaccgccggggatgcattaaggctatttcttaccgccagtgaaggtatgtggcgcgtatttgagcctgatctccgtcagagactgagtgaacttgaagcaaccgccgcatcggcagaacgggtccgggccgtcctgctggagctgctaccgagtaatacggccacgataaagaatgcggcaacccgcctcggactgagtcagcgctcgctccagcgccgtcttgcagaagaaggtgtcaattttcgcggattggttaactccacgcgcgagcgtctggcacgccattacctcaacaccacttcaatgtcaggtggagaaatcgcatttctgctcggtttttcagaccccagttctttttaccgcgcatttcacgactggactggacaaacggtcgggcgcgctcatcagagtcttccacggaaataagctttgacccgtaagcaatggaaaacggaaggcgggcgtcgaaatggcgctgattgcattaactctggcaccgattgcaggcgtactggcctgccctatcggttaagctgggtcaggatagcgtgaaagcagcgccagccctgtcacaatgcactacaggagcaactcagatgtatgaaatcagccagcaacggggccgcagggtcattatcaccggagccaacagcggcacgggtaaggaagcagcaaagaggctggcggcagcgggagccgatatcatcatggccgtacgaaatgaggcgaaaagggaagaggcgtgccgggaaatttgtcaggccgtttccggggcttcgcttgacgttcgtatcgttgatctctccagccttgaaagcgtgcgtatgttcagccatcagctgcttagagagggacgcccggtggatctgctcgtgaacaatgcggggatcatggcaccaccacgccgtgagctcaccgcagacggctttgaactgcagtttgcgacaaattttctcggccacttcgcgctgacgaatcttctgctaccgcttttactggaagcaaaaaatccccgcgtcacaaccatgaccagcagcgctgcaatgatgggaaacattcggtttgatgacctgcattgtgaacgatcttacaaaccgattgcggcgtatgcacagtccaaactggcctgtttgttgtttgcgaatcaacttggccatatcgcaaaaacacgtcactggccgttactcagtacgagtgcgcatccgggccatacgcgcactaatctgcagacaagtggcccgaatctgggaacggcatcgacccgaaaaaaactgatgtattatctcgtgccttcagtgcgtgtagagtgggcaacagaatcgctcctgagagcagctgttgacccttcggcgacgcagggagaattttacggcccgcgctttctgctttttggagctccccatgtcgcaaaacaacccaaaaccgtaatgaaatccgacccgacgcgcctgtggcagacagccgaagcgttaaccggcattctgactcccgccgcctgagaacaatttcataatctgttgtttacatcgcgctcatggcagacgtctacttgcgtatagtcgcgttgtgccaaaagcaagcgtcaccttacgacctgaagcagatatgatgctgtccaaatttaatccgttaaattctatgtgtcgcaaagcggctttcagataatccgggactgacatcagattcagctttcagtaatttaccgtcatattcagacagcgtagtgagccctacagacgctgtagtgcaacagaggcggctgaagttctcacctgccagtaccgggcaggtgctctgcattcccggcgacaacagaactgcgtctctggttccatccggccggtagcggaccacacgactccctccccattcagcattccacaaatagcccctggcatccacgcaggaaccatcaggcgcgccttcgactttggtgaatacgcgctggttttgcagcgaggggtaatcgcagcacattatccgaccctgcatcgagtcacagtaatagagagtgccgccatcggggctgaaacagatgctgtttggaatggcgacatcgggcagtgcaagcgtctcaactgtcagcgttgccgcattaagccggtgaaacttaccgataacgttcacgggaaaaccgtcatccattgttccaaagacaaaattaccgctacggtcacatctgccatccccaatgcgggtacccgtgcctcccggtgaggcggccagcgtggtaagaaaaccggtgttgagatcatacaaagccagcctggatgcaagccccatcagcagaatatgacttcggtcagtcagagcaaaggaaccaaggcgttcaggcagcgaccagcgcatgacagcgtcgttaccttcttctaatgcgagcagttcacaggcttcaatgtcagtccagtaaatcctgcgggtcctttcacaccacaggggacactcccccagcgtattccttatatcacctgcgattgaaaacatgtgaatcctctcgataaataaaggtcgtactttgcgccagaccagacttatccccgcctgcgtggtagcaaacgggggaaagccgttactgcagaaaacgtgcggaaagtcgatcgccgaaaagcatgacggcgagaccggccagcatgacaagcattccagccaacttaattaaagaaaccgggcgcttgatcgcgcccagcagaccaaaatggtcgatcatctgagatgagagcaactgcccgacaattgccagtccgagcagagctgaaaaaccgattttcggtgcaagtaccacgtagctgaacagcgcgcaggcaccgatcagtccgcccgccagactccagacaggctgagaaggaatggctgaaagggaggtgaataaccctccacgcagcagcgagtaaatcccgaggctgaacgccccggccgtaaaggaaaacaacgcggcggtgacagagtcgcctccgagtccttttgcaagctgactgttcagggtcgtctgcagggtaatccccagacctgctgcaaaagctaccacgtaataaatcgcgctcatgctgttcgtctctgtcagttagcctgaaccagcggcaggaatttttccgcaaagatgtctggctcataccctgccgccgcaaaaaggtgctcgcgtgattcatcaatggctgcgcggaggcgctcactgtccacacccagcactttgccgttctgcttgacgatgcgcccgccgatcatcacggtgtcgatgttactgcgctcggttgcatgtaccacggtaccaaacgcatttccgttgggatagaggttgatatcagccgcgttaatcagcaccagatcagcctgcttgcctggcgtcaggctgcccactttgtcctgcattcctgcacagtaagcaccatcgacggtggccgatttaagcagctgcgcagccggaagcgtcgtcagcgaatgcgctgaatcacaacagtgctgcttgtgcatacccatcacacgctgcagatagaacgccacgcgcatttccataaacatgtcggtgctgtaagacgtttcattgtcaacactcaggccaggatggataccatgacgttgcgcggcttcaatagcgaacatcccgctttcgatgccgtaatgcgaatctgagcgcgggcatacgttcacccggacaccggcttctcgcaggatttcccagccttcatcaggcagtgccgtgcagtggttgaatatattatccgggccaagcagaccctgccgatgcagcgattcaagctcggaggccatctcagcaccaaagaattcggtcacgatcggcaaccccagcctgcgcgcttcggcccataattctggctccagctgagccatgacgcccagcgtcacaagactctcaggattgtccgtgaaatatttttcctgcaggcgctgccagttgccaggccagtgcgccttatcccatcaccggccaccggtgcgccggaagcatggatcgcgcgaataccggcatcaagcagggcctcaacggcggcatcggaatgtgctgcggtccggctgttgtgcgagttatcaatcattgtggtgatgcccgcgtcaatcgcgcccagcgccgtcagcaggttacccacatagatatcttccggacggtaatatttagcgaacgaaaagtgcgtggcgttgctgtagtcgtccagacaggtggcgttggggttgatacgtcgcagctgaccttcccaggcgtgacggtgagagtcgaccatccccggcatggcgatcatatttgtggcatcaatgacgtgagtacccggcgcatcaaggttctgtcccacggcggtaatcgttgatccagtgacaagaatatcgccacgctcaaggtttcctacattgtcgtccatactcagtatggtggccccgcgaatcagcgttaccggcgggttttcgtgctgattattaacaatatctctgttgtaatctgtcattgtcatcgtctctttatgtgtgaacaggaaaacgatacgccctccgattaaggtgaaaaagatgactaacgcgttttcataattcataattaacgaataatgatacttatcaccctcatatgatatccaggagagcagccagatggatcgcattcaggctatgcagatttttttaagggtggctgaggccggaagctttgtgcgggcagcggaaacactctccctgcctgcctcgacggttaccagcaccatcaaaaatctggagaaatatctgcaggtgcgtctgctaaaccggaccacgagacgggtcagtctgactcccgaaggtctgcagtatctggcgcagtgccgggaaattctggccttaattgaacatactgaagccagtctggctgattcgaacaggcgcccccggggccgtttacgcgttgatatgcctggcggtatagctcatttcatcgttatgcccaatctgaaaacgttctacagccggtatcctgatatttacctgatgattggtgtcagcgatcgtcaggtcgatctggttcaggagggggtggattgtgtaatcagaaccggagagttgcttagctcaacgctggttgcccgcccgctcgggcagtttcgctggatcacctgtgcctctcccggctatctcagggcgtatggtattccgcagtcacctgaagagttatctcatcaccgggccattcactatttttccggccaaagccggcgcacggacgaactatgttttgtgcagggaacggaaacgctgtctgtctccgttagcgggcaggccgccgtcaacgagacgggactctatataaaaatgtgccttgaagggttcggactggcgcagcttgctgagaacgtggtcgcagaacacctgcagaaaggaacgctggttgaagtcccggccgaatggcagccgtcgtctgttcctgtcacattgctttacccccatcagcgttttctgtcacccgccgttcgcgcatttgcagactggatagatgaaatcgttaactgatacctctaggccggtgtagacgaaagtctgtgtctggcggatgcgcgcatcccggagcagcgacttatcggggaaagggttgtacccggacattcaactctccgggtaagtggtgccgccgtctgaaggtgccagccgcatccgggcacgcactcagctgaagtgccggagtaaaatatcttccagaatgcgaaaaacggtcctgatgcgctgcggtacaagggtctgatagggccggtaaagataaagctgccaggtttccagtttcagttccggcaggacattcaccagcctgccgtcttcgaggtattccctgcaggccagattacttgactggatcacggctttcccggctaaagcagcctgaatctcagactgggagtcggtggtaaaaaactcaagatggcgcggtacaaacgtatcgacgccatcgagcatatattcgaatactttgccggtttcaggattcagcaacccactgaaaggatagcgctggcgcagatcttcgaagttttccggcgcccccagcttctcaatgagttcaggcgatgtcatcagcgcgtgatgaacgagcgtgatgggcctgataataaagttcggatttggctcgcgttcgatgcggatccccatatcaatgcggttctgtatcgaattcagcttcatcatgtccagccgccagtctataaacagctcaggatagggtcgaagcgcagtcaaaagctcaaacagcacctgttcgtgtccgggaaaacggaacagtgtgatcctcacaatccccttcatctcattgtcatctctggccgtctgaaacagcgcttgtgagtcttcaagaaggcgcacagcctttggcaggaaaagttcgccaaagctggtcagcacaatcgatcgggtattccgcttgaacagtggttcgccgagctgattttccagctcagcaatggttcgcgttaccacggagggagaaatggccagcctgaccgcagcttcgcgaaaattcatcgtttccgcagcggcaacaaaaaatcgcagagcatcaagtttattcatgattattgtgttttcagcaattctggctttcgaaattagcaatttttcggcaataaatccagccgtatacttaaccactcaaaatcatcagcgtcttaaataagggtgaaataatcatgaaattgagaaggttaggtagccaggggcttcatgtctcagagatggggctggggtgcatgggcatggatcatggctatggtcattcagttgaaatcaaggaaaggataaagctgatagacaaggctgttgagctgggatgcaaccttttcgacacggcccctatttacggatttgaaaacgaagaactgctgggtactgctcttagtaaacacagggagagtgtcatcattgcgaccaagtttggcgtgaccggaatggaaaatatcgatggtcagctggtaccggttctggacagtagcccggcgtctgtccgaaagcagctggaaggttctcttgaccgtcttaaaaccgattatattgacttgttttaccagcatcgcgttgatcctgcggttgagccggaagtggtcgcaggattgatgaaagagttaatcgccgaagggaaaataaagtactggggattatccaatgcgcccgcgtcttatatccggcgggcccatgcagtgtgcccggtcaccgccgttgaagatcagtattcgatgatgtggcgtaagcctgagcaggatctgtttacagtctgcgacgaactcgatatcggctttatggcttacagcccgctgggtaatggtttcctgagtggtcaggtgaaagctgatataacctacggggaaggcgattaccggggcatgatggggcgctttaaacccgaggtaatggaaaataatcaggcgcttcttaatctcatcgccgacattgccggaagaaacaacgcaacgtcggcacaggttgtcctcgcgtgggaactggctcagaagccttatatcgtgccgattccgggtacaacgaaattacaccggctggaagagaattttcatgctgcaaatattcagctcagtgacgctgaattacatgacatcaatgacgctttatcccggcttgaaattgacgacacattcttttaaagacaagagataaaaaaatgaaaacaactgtatttgttatccatcccaacattcatctgtcccgtgttaactcggcgctggcaaaaagtgcagcatcactgcccgatgtcgaagtgcgttatctgtataacctgtatccggatggcaaaattgacgtggctgctgaacaggctgttctggaaaataccgaccgtattgtgctgcagttcccgatgcagtggtacagcacgccgccgcttctcaaacagtggcttgatgacgtactgacctacggctggtcacatggtggcgaaacacaggcactgcgtgacaagcaacttatgctggccgtttcgctcggtggtgctgagtctgcctatcagcctgatggcgcagccggtcatacggtaagcgaatacctgcagtcctttgaaaccatctccggatatctggggatgcactatatcaagcctttcattacaggcggaagtgcgacgatcaccgacgaagaaattgaagcacagactgaacgctacaaaacggtattagtctgattagcatcatgcattctatcaattattaaaacgttcagatgtgctggttgtcgctgacaattatcattggcggcaactagcagaattatggctgctgatggctgttttgacggccctcagcatacgcgagagccccctacactatgcatttctgaagcattgctgcttatttaagttatgcggtagccacttcagaacgttgaacctgctttgcgaaattctcataaaagtatgttctccgtataaagacattactatatgaatctttaacgtccgcttttcgctcaaatgagacaaccataatcacatctcctaacccaatggagattgaacatgacagtatccccctggaacaaaagccgccttattggccagaaacgacctcttcagatctctcatatctgggggattcgtatccgtcttgaactggaaggaaaagtccgcgatttggctctgtttaacatggctctggacagtaaacttcggggctgcgatctggttaagttgaaagtttctgatgtggcctatggacacactgtttcgggcagagcgactgtgatgcagcaaaaaacgggcagccctgttcagtttgaactgacgaagggaaccagagaggctgtatccgcatggatcaaaatggctcatttgcgtagtagcgactatcttttcagtcccgcattggttcttcaagacacatttcaaccagacaatataaccgtatttttcatggatggattgagaagctgggtctcgatgaaacgctttacagtacgcattccatgcgcagaaccaagccatatctgatctataaaaaaacgaaaaatcttcgtgttatccagttacttttgggtcataaaaaactcgaaagcacagtacgttacctgggcatcgaagtagatgatgccctggagatatcagaatctattgaagtctaatttgtcagggctgcaacagcagccctgtgccagaagcggatgttaaccctgtaggcaatttataaaacattgtgaaaactcatgttaatttgttgtgttagtggaagttgacaatttacgacgggagagagcctgaagtgaaagcatttaaggtgcgtcgcatcaatgagagcgatctggaagatttcagaagagtaagactggaagcgttgctccttcatccggacgcttttggcgcctcttacgaagactggaggcagaagccatcaacattctttgctgaaaaattgcgaaccaatcatatttttggcggattcgaccttcacaacaccttacagggcctgattggtttgagcttcactacctcaccaaagctgagtcatgtagctactatctgggtgatgtatgtccgtgccgggatgaggggatcgggactatcatcagggctaatggaggctgcgcttgaagctgcaagctcagtaagaactataaagctttccgtagtcacaacgaatcatgccgcatatgcactttatcagtcgtacggtttcactaactgggccactgatactgctgcgctttactctagcggtctttttcatgacgaatatcttatgaggcgagactcggaaaacgactcataacaaagccattatgataaataattgctttcgcttcgacatcatcgagcgttgtttaaggcaatgtccgcttttcgctcacagcggacctccagctcagtcagcctgtccgctctgtgccaaaagcggacgttccgggagcaggtcagcgcctctatgcagctaacgctgcatctaatgattagctgcatatctccattttcaattttgaagtctgattgatgaaactgcgcagtaagagatttgactgaacggccggacggcgcgggtgcagaacagcgccccagagggaaggtgtaacgcgccgtccggcacaagaagaagtatgaaggccatctgctacagaaacaacatggaagcactacggacgttatgaacatagcccatacacacaatgggtggttaataccaaatatatcattagatgtatgatcagtccgcagggactttaattgcaatagtgtactttataactttttcatgaccttgaatgagttaagccatccccagagatggcttatcagacagagatgtagtttttgtaaaagtatgtccacgtttaattacacacatctaaagcatttgaaccacttaaactgcgtttgtgcggaacacgctgacagcatctctcaggcttgcggcccggtttgcaagttcatcagcggatgatgcagattcttcaaccagcacggcattctgctgcgtaacctgatccatctgtgtcaccgcaatatttatttgtgatacgcccgcactctgttcttcagaagaagatgagatctctctgaccaattgcgatgtctgctcaattgcttccacgctttgtttaactttttcaccggcatcccgggccatcaaaattccctgtccggcatgctcaactgactgctcaataagccctttgatttccttcgccgctccagccgatcgctgcgccagtgccctgacctcagaagcaacaacagcaaagcccttaccgtgctcacctgcccgggcagcttcgacggctgcgtttaaagcaagaatattcgtctgaaacgctatcccgtcaataacggaaatgatttctttaatctgtccagcactgttgcttattttttccattgaatccaggactgactccatggcctcaccgcctctcaaggccgcagttgtagcggagttggccatttcagcagcatgacgcgtgttatccgcattattgccgatgattgacgataactgctccatacttgccgcagtttcagccagagaggctgcctgctcttccgttcgcgccgacaaatcaccatttccacgggctatttcttcagatgacgtagcaatagtgacagcgttacttttaatgttttccaccgtaagcgtaagtctctgactcatttgcagtaatgccttaagcagtgcggcagtttcattgcgtcctgtcaccgtcaatgttgacgtaaggtcaccgcccgccacctcaagggccagtcttgatgcggcactgataggtctggtaacggagcgaataataaccagagcaaaaattactgccagcaggacgataaaaacaagaacggtcagtagtgcatattgtgcataccggtgttccttaatctgcccattcagcatttcattcagttcattacccccggcaatggcgtagtcgctgaatttgttaatagcgtgtgtaaagagcgctgcatagtccttcgggttttgattcgtcatgctgcggttaatgaaaatcgcctcagcggttttgagagcactgtttgcctcctcaacggctgcatctgcatttgcgctaaatttttgcttaagtgtgttatcagataaaaacagtttttcagaatcctgaacaaataaattcaggttatacgaaccattactgattaaagactccatacggacagagtctgcttcacttatgctttcatttcgggcaagaagggaagtaccaaatgcacgtattttcccaaggctttcggtcagttcaggcaatgatgaaaaattactcgtaattaaacggtacgtgttgatatctgaatcgagtgaaaggccgtaaaaatccagcacatcacggttcgcattcaaaaggttgcggatgaggagggcatgtgcatcaagactggctgtcagagtcagttgtgaagaatcgattctttgctgtagctggctccactgtgcgcgcacgtcattgattttttatgatcatggcagcgctgccttctgtcttggccatatctttggtaataacatcagtgatgttttcaatttcatctctgacctgaacgcgggacggtgttgctggatttttggttgcaatggcaagggcggtttctgcacgatggcgctgtatcaaattgagtagggctaaaatcttattttctacggggatacctgttacctctctttgcttatcctgaatgtatttattaccttcagacacaaaaagcatggtaggaactgagaacagaacaagggaaaacaggcccagaatggcaaatttggcggtaaggcttatattgttaagaatcttattcatttttaattcctggtgaattaattcgttatagtgacaattacaaaagatacattcgtaacgcaccttaatgcatttatcggttattcactcactaactttataccgcacggttgttttactgcattacgtaataaacttttagtaacgttaaacaaagcacttaagctaaataatcattttttctcgggattaagttcttttcgcagcagcattagccattgctggattttcatcagagtatttttactgagatttgaatgagccggctgaaccagatgcgaatcgcacactgtattattagcatgtcgccgaaagacgttgtctaaggggggtaaggtgaagcaaaggttactaagccaaaattatctgacctggcaggcgctttgatcgctgcctgctacctgttgattcacacagaatgttgttagcaatgctcacggtcgctcatagcggacctcaagctcaataaatctgtccgctttgtgccagaagcggacatggctaaaatcgggatgaccttagcggcagacaggatacaggccatcacgtgaggtaataaactcgcatgagttcggtaaagtcatcggtgtgttttgacagatttgaatattataagctgctgtcagttttaccctcgttcaggctattgatgatatgaagatatggcacagactgcctctcaaattctgggctggtaagctttttcaaccacgatatggcctcaaaaattttacacaggcggttgtcgctacagctgcctgtcgccatccttttcagctgttccataagggaattgatgtcaatttccttgtcagtcagcgcaagatacagggcggcttcgccaattatgatgagtcctctttcttcgtctcgaagtgacatatctccctccgtaaggtgatttaggcactggcataactgactgtcctgtctcagaagatttcttcactcctgaataactcagctgtttattcctgtgaaatataacccgctaaatacctgtatactgttcactgttttcctgtcgctttagacagttagtgcagttatcggaacgtgaaattcaacgtaacaatcaattgtgtgtataaaataagcgagcacttcccttatcaacactttatccggactttcttttggttatcaggttttccggtggttgtgcttctttaccagactatcgtcacagtcatctcttttctttagcgtcaaatcaatgcttttaactatcactgcgacaggtatgcttccttattcaaggaaatccatccgcgaatgcagcagatgaatgcatctttacgggtgcggcagggtaaacagaaatgaattaagaagatgttagcgttcagttcgggctaaaacgccgcgcaagaggtgaggcgaaccagttgtgtggctccaggcttctctggcggcgggcgccagcacccagttgcacgtttaaattatgcctgaaagcattatgcatgcaagcgagacggtaaataagatgtttaatctggctggcatgcctttaatttcgtgaaaaaaacttcagaaaatacattgcattccggcacggtaatgcggatttaatttttattttttttaaataccgtcttttactgattatacgtttaagttgatgtgttcagattcgtttggcttatggtgaaaacattatttaattttatttatctgactccgcctcgttaaaaataaaagttagagcccaaatgataacctgaaagataattaacccctcttgtcagcaaaggggtgattaagtgattctgatcaatgaaaccgattattttataaagccacggaaaacaggtgtaaataatgcaactttctggccgataccggattgaaccctgagaggatataaatctcagggtactgtttaactccggggtaatttaaatgaatattataagaaaagttacagatttaaagataggcggcaaactgggactgggattcacgctggtcatactggcctccgtcatcatatcggcgctggcctttcgctgttttttaagcattcaggaaaattcggccaagcgcgatgtcaccgttcagatgctcgacacgctggcgaaagccagacttaaccgcacgctttttcagtacacccgcgacaaaaagtttattgagattaacggcgaggcgatgaatcagctttttgtcttacgaaccagtcttaataaatactcctggtcggcggaaggaggggaaaggctttctgttctgagcggtatcctgacgcagtatcaggaaaagcgtcaggcttttctcgagagcagtgacagtgccgcgcgcgcgctgagcgaaatacacacgctgggcctggcatcactgggagaaaaactggccgccggccaggcttctgctcctgccgacgttgttgcgcccctgctttccctcagcttcaggacagagcaggcggcattttatgtccaggagttcatcagaaagccggacgcttccacgctggataaattcagtgaagtcagggacgccatttctccgctggtaaaccagctcagaggcgtttccggcagcgcgctcgccgcagtagtggcggacgtggagcaaaaaatggcatcgggctccgcgcagttaaataattatctcctttctgtgcggactgaaaagcaggcctcagatgaaatgaccgcagcggcaggtaagctgaaccagtccatcacggacctcgcgttctttcagtcagagatggctgagaagtatatccagaccgcgctctggcagatcggttttgcaacactcgcctgtatcgttctcagcctcctgattgcctggcgaatgacgcgaagtatcaccgttccgctgagagagacgctgtcgtctgcacagcgcattgctgaaggtgatctgacctcagacatcactacctcgcgcaccgatgagcttggcgagctgatgacagccgtgggcgcgatgaaccagagcctgcgtgacattatctcccgtgtcagggacggagtgaataacgttgcccgcgcctcctccgagattgctgcgggtaacaccgacctgtcttcacgcacggaacagcagtcggcagcggtggttgaaactgcggccagcatggaggagctgacctccaccgttaagcagaatgcggagaatgcccatcacgccagccagctggccaccgaggcgtcacacaatgccagccgcggcggggaaatcatcagtgacgtgatcaacacgatgggagggatcagccagagctcaggtaaaatcggcgaaatcatctccgtcattaacggtatcgctttccagacgaatatcctggcgctcaacgccgccgtcgaggctgcaagagcgggagaacagggaaggggattcgcagtagttgccggtgaagtccgaaatctggcacagcgcagttcacttgcggcaaaagaaatcgaggcgcttataagtgagtcactgagccgggtgagtaacggtaccgaactggttaaccgtgccggtgtcacgatggaggatatcgtcaagtctgtgacccaggtcagggacatcatgggcgaaattgcggctgcgtcggacgaacagaaccgcggaataacccagattgcgcaggccatgacagagatggacaccacaactcagcagaatgccgcgctggttgaagagtcatccgcagccgccagcagcctcgaggatcaggctcatgagcttgaaaaaaccgtagccgtgttccgtgttcctgcttccggcctgttgatgccggaggttaaagtgcccacgccggcgttaaaacacccgtcatccctcagggcgtcggaagcaaactgggaaacattctgacagccatactgcagccagagccgtctgtaacgacatctggctgcatatttcagtcatttatcggtgaggtggtcagtgtgtgatctcagcgtgccgcattgttacatcggtaaggcggtggaagctcttttttatgatgcggagtcagtcacccgattaaaggtaataggcaaactgagcctgatgctcagggaagagtctgatcctgtccggaaaaacgagatagtaatcgccatcactcttctcagttaaatcatgagaatcaaaaccaatctggaggtttaaaagacacaaatcatgcaaatttatcttagataacgtccgctttgtgccagaagcggacgttattattctggcctcatctatacagccagtagagttagattgtgttaaaaagctgtttcaagaaagccgtatctgaaccctgatggagcaaaaatgagaacgcaaaaacgatgcataggttatgtggccatcgtggtcgacgactatgaccgcgcaattgagtactacaccgacaagctgggctttacgctggttgaagacacgccgcaaccgggcaagcgctgggttgtggtgacgccgaacccggaaagcgactgtaatcttctcctggctcgtgcttcaaacgagcggcaggaagattttatcggtaatcagtgcggcggacgggtattcctgttcctgcagactgacgacttctggcgcgattacaacgccatgaaggcgaagggggttcacttccgccaggagccgcgagagtaggattacggaatggtcgtggtgtttgaggacatttacggcaaccgctgggatctttaccagaacaagcaagattaaatctccgagggtcaatttattgatgcgtaatcggccctaataacaagtccgctttccgctcataacattatgtagtcaaaagctataaacatgcctcaaacctgttattttaacctcttccattgctcgatagtcagagtgaacatcaggttagccggtggatcttcaggattatccaccctttgggtaaacagcaaacctgctttttcgagaacgcggcgagaggcgatatgattttcgcgtgtcactccaacaatttcaggcagttttagctcgtcaaatccatatattaaagcgcgacagcaaagctcagttgcataacctttcccccatgattctggttcaaaccggtagcccagattgttagtttgtcggccattaaactgactgacaaatacgcctccaaatccaatgatcctttctggatccgtcttttcagagatagcccagtcgtcaaatccgtacagctcacggtctgcagttcgctgaaggataacactacgactttgctcgatgtgccgatgtggacctcgtgggttaaacgcgtgcgttctttcgtcaccgtatatgcgaaacagtgcttccacatcggacataattactggtctgtagagtagtctttctgactcccagtacattagctcttcctttccatttaaatgcttttttaaacacagtaatctgtcggacacagcctgagaagcacttctttaaaaactttcaggtccatatcggcactacatctgctggcgtattctgtaagatttgcaaattatactagtcaatgtccgcttttcgctcatagcggaccttcagcgccgtccgtccgccttgtgccaaaagcggacgttcaagatatcatgacgcagttaaaatcgaagatcaggctaacttgctttcaagtatgttaatgattaagtcgcgtggaaaaattatctcattggtatgtatgagctcttctattgtccaccaatgatgatcgcgaatgacttccttttcattgctactccatcctgagcggtcgagatctactgtatttgcattaatcataaagaaacgctcatcagcaagtactgtctccccacttggtagcatcattgtgaaggttcgggacgctatttgcggtcctattaatgttcttatcaaacccgtttcttcaaataattcgcgtatagcggcctgctcaaaagattcatttttttcaagccctcctcccggagttgcccagtatgcttttccccttagagcatcatctttatgacagaacctaaagagcaggacatgattttcaggcgaaagaatgagtagtcgagatgctggtcgaatgcgcacatatcccccttaaaaaatcttacttgctgattttaaatgtttatataaacataaattcaagcctgaatcgctctataggtctgcattttattacagctttaatctcactcaacgtcttctcctcgctcaaagcggacgttcctttccctcctgccttttgccttgaactcattcctgccgtatctccttagccctccctcacgcttagccagtccagatccgacttttgaggttttcggatctacattgaggaggaagtgcactgatgcacataggacagcaattgaacattatttttgctaaaaaaacattattgataaaagtgcacaaaataatatttattgttgctttttaggcagttttacttcaatcaaatcatgaaggtaatcacttcctgtcatgcctgattgggaacgcaagagtggttcagataaatctgatcaggatggcacaaccagaatgaaaagtgggctacgatggaaaggctcaaagaactcagggataaggagaaaaaaatggctcaactcaggatccgaggcgtaagaagctacgcgcctgaccgggatatctgctttgatctcagcagtaaggtgacactcatctatggccagaacggctcggggaaatccacggtgtcaggttatttttatgaccggcaggcggatcaataccgtcactgtgcctttgagagcccgcacatcaactactttcaggtctttaatcaggaatacattgatagtaaattcgcccgcgcggactatcagcccggaatcttcactctcagtgaggccaatcaggaaagccaggataaaataaacagtaataataaagaaagaacaaaactgagtgcccgcctggagaaaattaatgaggagattgcacaaaaagaaggaatgaaagaaacgatcgtcgaccactgtgccagggatattttcaaccggacagtcaatgacaggaaaaccctcagcgatttccttgatggcgccaaaattaaaagatcgttttacgaacgtatggttgcaacaccactttcagacgtgcgtaccacaactgatgaactgactgataaatggcggatgttaagtcaaagcgaaggaacgattgtcggcgaaattcatattccacgaacaactgtcttaacggaagaaacaataatactgatgcaagaacctgttatgactgcaaacagcacgcaattctctgcactcatccagaaaattggtaatgcagactgggtgcgccaggggcagcattatatacatgacgatgtttgcccattctgccagcagtcctttgatgtcagggccttttcgcgcgaactcactcagatgttcgatgagtcttatcagacatctcttgggaggctgagccaggcagctgaaggactggctcaggactgtgatgccatggccgaatttgaacaccgcgttgcaacccattcttttgttgatgagggaagtcagattttatctctggtgaaagcggtaaataaaggctttcagattttgttacagcaactccttaataaaattaaagaaccgtctctgaaggtacaacctgagaaccttcaggaacccctgttcttactccagaatgaagtggacgcgttcaatacccgtgtacgggaaaataaccgactggctgaaaacttcactcaagaaaaacagtccctttacgctgatgtcatggcgcatctcagagggatttgcgaagagttctttaccgaacgtgacaggcagcttggcgagctacagaatgaaattaacagtaggttgcgcgattgcgagatcatcgaatcaagcaagaagcagttggatgacgagacgaatgcgctgaccggacaactctccgacatacaacccaccattgacagtatcaacgcgaatctcaggctactggggatcaacggctttgaaatcatctgccatgatgctgagatgaaactataccgtctgcgccggggaagcgagcctgagaaggcggaagtattcaaatctctcagtgagggtgagaaaacaatgatttctttcctttatttcatagaatcatgctccggcagtctcacccccgaatccattcatccggaaaataaacttattgttattgacgatccgatctccagcctgtcacataactatatctatgaagtcgcagcactcattaaacggaaaataataaagttaggcgcagcgagacatgtagttatactgactcacaatatatttttcttccaggaaatactgttaaacagcggtcgcctgcaggataacagaaaggcaccggtgaactggtctctgcttcgaattattaagtctgactacagttcctgcgagcagctctccatgcatgagatgctcaatgaatatcaggcgttatggcagaccctgaaagatgtcagggatggaaaaacccagcctattgtgctttttaatacgatgaggaatattcttgagtactatttcagttttgcctgcaaaactgaaaaacttaaagaagctctggagtctctggcaggcgaacacagtgatgccggagaatatgattcattttatcgggctctcaaccggcactctcattcggatggccgaaatctcttttctacaggggtcatcgataaggaacgctatctgagtatgttcagaaaagtgttcactcagacagatgacgatgatcactatcttaccatgatgggcgaatcgacaggcctgccggaaacagtggagtaaactagcagtatcgtcacctgcgggtaccgttcacttaacgcgtcgggagcgagcgcatgtgcttacgcacatgctctacgcgcccgaaacgaaaacgtgtataccgtacaacgggtacaattttcggtttcatggcgggtttccttttacagtccggctactgccggaagtccctgtaaccatttacaggcggtaaaaagcgcagaggggaacacccgaggtgacgacagctgattataaacaccattccggtttgaggtaaattctttccacatttgtaagagggaaaagcagatgtcccgttcccggaactaactgcgatacgcatccaaccttttataaccaaatctaaggaaagccagagctcatgctgttaagggtcgtcccgcactccggttccccttgcaaccgagcatgttatttccggctttgcctttcttcggatctgcgggaggtaacagaagcggcgtgtgcagcatgcagtgaataacggtgcatattcgcttacagcattaaattatgtttacagttaattaatacacacaaacacaaaattactgcatataagtttaaaagtgtgttacatgatggaacaaagtatacagtcctgattaaagccggcagaaagggtttttgacatgcacagggcggggagtcagtacagcagtaattatataaagaaagggtgactgagggccgggacagggaacagcagtgccgtggcaaaaccgatacgtgataaaacagagcttatgcgcagagaggagcggaagagaggctcagtacctgaccacccgtacccgtttcaaaaggccgggacggtaatccccccgccaggaagacagaggcaggggtgtcgttgacagcagggcagaacgcatgcgcagatctttcccggttctttacttgagtatcgcagtaaaaagatcactgaaagcggaacctgctatataagtgcgttcggtggtaacctcatcctcacggattgctgccagtcttttcagggcactctcgggatcggaagccctgacttcttcaaaaagcttttcccagccatcctcagtcagctgagctgctttccggacagcatccctttcgagaacaactaactttttgcttttacggtaaaaacagtactctggcatgatatttctccaggatatggatgtgcttttaacaagtatgtctgacagactcatttatcaagcaacgtcacagaagcgaaagggacagtcttcagttataagtatatccatttataacgaaggtcaaactttaaaactttgcacgtcaaaaatatgccaagccgcatcctgacacatacctgacctgcgccattttaaaaggattttatccgctttggtaataagaggccgaaacattcaaatataaataaatagcaaactaaccaataaaggaaacatatactaacacaatgaaacaaaatctcgtataattacgacttgattaatacgtgaattttactaaatcttaacgttggggagaaaaatacaagttgtggcgaaaaaaaccggaactcgatattgaaatacagtgactcacgtcacgaaattttacttctgaagtaaagtgaaagggataaagcatcacaattccgggaagtcgaaatttcgcagaaaataaagactgccagccatattaaacggctttgagaaagcataaggatggaatgaggtgtttcgtcaggaggctatcgataacagtaaaggacactggcatggcgatgcattacttctgcccggtttgcaccccattatagtgtgggcaataacaatcattttcattatcgcttttctgatatttgtcatgtttgggtcatatacccgacgtgtaaacgtttcaggggaaatcacgacttttccgagagcagctaacttttattcaggtgtacagggcgtggtcgtaaaacagtttgtgtctgagggcacaagcgtgaaagccggggatgctgtttaccagatagatgtcagtaagagtacacgttcgggagtggtaagcgaagagcaggtagcagacataaatcatcagatttccagcgtcacacaaatcattaaaaaactcgaaagcaacaagaaaaagacgctggatatgatggaaaagcaaaaattaaaatatatcactgccttcgaaaattcgagcagcattattcagcgagccagggaagggatccggataatgaaagagaacatgcagaattatcagcgttatcagaataaagggcttattaacaaagaccagcttaccaatcagatagcgctctattaccagcagcaaaatgctctgcttggccttaccggtcagaatgagcaaaactcattgcagattacgtcacttgaaactcagatacagactcaggccgctgattttgataaccagatctaccagatggaattgcagcgttacgagcttcagaaggagctggttaacgcgcaggcaaacgggatggtgatcatacgggcactgaaagagggcaggatagattcgctgagcgtaacggtgggtcaaatggtcaacgccggtgacagtctgtttcagatcctccctgcagacatcaggttctataacctggtgatatgggttcctaatgaggcaataccgtatttaaagaaaggagataaagtaaacatcagatatgacgcatttccgatggaaaaattcggccagtttgcgggtgaaatatctgtcatatccagtgctcctgcgtcaacacaggaaatgatgacataccagggggcgccagcacattccccctcagctaacatgacgtactacaaggtgatcgtgcggccggagagcaacgctgttaaatacggcgggaggagactcctgttgcagaatggtatgaaggcagaaagcacgctgtttctggaaaaaagaaaaatctatcaatggatgctgtcaccgctctacgacatgagaaacagcgctgcggggccggtaaatggatagggcccgttttggcaaactactggatcagctggatttcagcttccgtcgtaaaacacccgtgatccatcagacggaatcgtctgagtgcggacttgcctgtctggccatggtctgcggttcatatggcaagaacattgacctcatcgctttacgcaggcgccataacatatctacgcgaggcgcaaccttagcccatatcaagagtatcgcagaacagctgggattaataacccggccgctgtcgcttgagctgcacgagcttaaggccctgaagaagccctgtatactgcactggaacttcaaccattttgttgtgctggttgaaatgaaaggcagtaaattcatattgcacgatcctgcacggggcaggagaaccctgagcctgagtgaattttcaaaatcgtttactggtgtggcgctggaagtctggccgggaagtgtgtttgagaaagatacagtccggcaccatctgagtatcagaaaactggctgagggcgtaaacggccttaaaggaagccttgcaaaaatattctgcttttcgctcattattgaagccatcagcctgttactgcccgttggcacccaactgattatggatcatgcgattccggccggcgaccatgggctcctcacgctgatatgctccggactcatcctgtttatttttttacggtcattcattaccttcattcgctcctggtctactctcgtcatgagcacactgattaatgtgcaatggcaggcaggtctgtttacgcatcttcttcacctgcccatgacctattttgagcgcagaagaatgggcgatattcagtcccgtttcaattcaataaacctcataaaggaaacgttcaccaccagtctcactggcgccttgattgacggtataatggtcgtaagcgtggcaataatgatgtacgtctacggaaactggctgttctggatcgtactggccttcacgctggcatatataacgataagattttgcatttatcaaacttaccgaaacctgtctgaggaaacgctcattaaagatgcccgtgcgaaatcctatttcatggaaacgctgtatggtattgcgacagtaaagatacagggcatggtcgggcagaggcaaaacaactggctgaaccttgagatcgatactgtaaatacggaaattaagctgaataagctggattttatattcgatggcctgaacacgttgattgtctcgtgtgaacaaatcgtgatcctgtggctgggcataaatatgattatcgatcacgagttaactatcgggatgtttatcgccttcggcacgttcagagagcagttctccggcagaatccatactcttattaactttatttttaaactgcgtatgctccgcctgcaaagcgaacgggtagccgacatcgccctgcatgaacaggaaacaatgaagccggatgtcacgaccggtactgagaaacgtcccctttcgctggaaaccaacgacctttcatacagttacgatactcagtcttcacctgttttcagtggtttaaacatttcagttttacccggggagaatgtggccattactggcccgtcaggcaccggtaaatcgactttaatgaaagtcctctgcggtctgatcgagccagatacgggcagggtaatcgttgacgggcttgatatcagacagctcggcgtaaacaactatcagcgactgataggctgcgtaatgcaggaagacaaattattttctggttcaatacgtgaaaacatctgtggtttcagcgcaggtgcagatgaggaatggatgactgaatgtgcgcgggcaagttacattcacgattttataatgtccacgccgatgggttatgaaacgctgataggcgagttaggcgaaggattgtccggcgggcagaagcagagaatatttattgcacgagcgctttatcgtaaaccgggcatcctttttatggacgaggcaaccagtgcgctggataatgacagcgaaaaacaagtcagtcaggccataaaaaaactgaaaataacccggattgtcatcgctcaccgggatacaactatatctatggctgacagggtgattacgctgaaatagggcatctgtttatgtgacgtttaatgtatctgtaaaaaattccggcgatacggactttccgttcacagggattaccccggcgggataaataagcatcagattttcatgctctaattattcaatctttagatattatgacttttgatagatgaaaaaaagtcaaaaaattgttgtttgcatacgcacactgttataagtttgttattaaccattcagtaaactgcttttaaaattgcagtttatctgtctggctgcagtcccgtttcaataaatgtattcatttgaggaattatttatgaaagagattgatgatgtatttttagataaaatttccggtggcaacagcggccttgctgcagctggttctggcctgactaaccagagcgggagttccattgcacagggtgtggtatcaggtcgccacacacagggaaataatgccggaagcagttcatcgaacggtggttcccgtggaggaggcagacaaagtggtgataatcactaacagataattcagaattatgcagtccttgagatcaagggctgcatactctctcttgtctcactttcagccatgtcaggtcacccatgaacgccttcctgaagacgtccctcagtaaagataatattgctcttccggcattcgtggtgaatccgttttcttcgcttttcgaccgcgtcgtcacattttcccggaaagatatcaggcatcagaatcttagctccctttatatcaacctccgcgatttttttactggattagctcggggccgggcggaagttaaggatatctttctggtatacgaatttctctatcacctgcaatcaagccttcctgaggttaaaacggacgaatgcgttgaaacgctgcatatcgttcttagtcagtcttcaggtgggaaaaaccttaattcattgccgaaagatattcattttatctggctcggtcctctggctcctggcacattagattttgctaaattctggaagaaaattaatccgggttacaccgttcatctgtggacagataaaagaatcctgagcgcgggcattaatggtcgcatgcggaataaaaagggtggagttatcagtgagtcaggtataattaccgcgttcaggacggcttcttatcattatcttcccccaccctacagccggcaaagaccgtcagggatcagtttaatggctgccacatcttgccccgttgttgtatctgaaatctccggagaatcatctgttaccggtactcctgacgtgataatgactcacgatgtcagcgaaattttcaaccagattttttcacgccctttccttaaaatatatatgttcgaagtttttttcagaaaaaatctggcagctgcctccgatattttcagaatgcttcttctttacagtcgcggaggtatttacgttgacacggacacacttcctggcctgatacatttcagcgaaaggtttaaaaccgacgcatattctcaccttcctgttaaagactatgacagcagggagaagttagacgtcggcatgacgaatgaatcactttctttgttgcaaaacgggggggatttttgccatacggatttcgcagatgataactacagattttttctgtcggtcaaaaaacagctcatccgttgcacggatataggctgccaccctttcttttacaccctcgatgatgtccaaattcctgacggaaacttcctcattgcaagagaccacagcagggaacgcgtttttttcagcaacttcatcgcttcaacagcccgcaatgcttttactgaaaatgcgctttacatgcttaaaaggaattatgaaaaactggggctgtcagccctgctggatcgggccttaaaaaaacctgtgctcagtgaggactttactgaatacttttacgacggttacctcaataattcgctgaaaacgctctacatcagcggccccggcgtgttaatccatgccggattaatgtttttaatgcaacgatatgatttaccacctgactttgacagaaacgtgctgctcagtattttatggaatacttggggcaccagtcagcattcaatcaacaatgctaccggttttaaatcaacctggcgggacaaatagaacaccctgtttttggcgggtgcgcgttttaagtgcctgatgccgaccggccacagaatgaaaagaagtaaacaaaaagggctcttttaaccatgagccctttccttttcgccagtctacgttttgtctctggacatgtagctgtaagccataaagcccactacgcactcggccacaagaactaccaaataccatgtcatagatacctccttagttcccgttttatatcatagggcaaaatttgacctaagtgaacaccgggcatcccttctgcagcctgagtaagatatttctgaagctcattaccgtatgcctcaaaataataagtacaccatatgcttccaggcggcgttatcggcttatatccaatgaaaaaacagggatatcggaatgaatggccaagtagagtatactcaaaatgcccacaaaagaccttaataaaaaagtggttatgcatgatggtgacaaaaacgagaacttttctgaaagagtggaacgcgctgttcgtgtggccacgatcgacgacgttaacctgatgctgcatgggattttgcttttaggagatcctgaagggttgcggatctacacgactgagatcaaacacgctgaaaaaatcgcttttctcagcccggacgcttacgttgaaatcaggatatgcggtgacatagctgccagggagacgacatgcatagaatttcactccctcagttaacatcgtttgcccgtactgaaaacattcccggagatcgcagtgaaacccttcagccatttagtaaaccatccactggatgaaacttatctcagtcccccgggagacttctgtgcggagggtgaattgcccgaagaggagactgaggtgcgtcaggcgcttacagccatgtatgttttgacaaaccgcctgatgaacatcagcttatgggaccgtcttttaagaacccgtaaatactcgtcagccagccgttcggcgacagaggcacagcggaagctgatggcgctcgtgaacagtacgcccttacacaaagccgcgctgaggcgcattgtgagcgacatgcctgaagacaacggcggccgggaagcgctcaggggttatttacgttaagagggtggggccgctaaacctatgcagattgcacgtatttatcttcgcgtcagtacggatgaacaggaactgacacggcagaacagcattattgaagatgcccggggcaaaggtttttatgtcgccggcgtctataaagagaaagcatccggtgccagggcagatcggcctgagctccagcgcatgattgccgacctgcagcccggtgaagtggttgtggctgagaaaattgaccgcatcagccgtcttccccttaatgaggccgagcagttgattggctcgataaaggctaagggggcaaagctggccatccccggcatagtggatttgtccgagctggccacaggccaggacggcgtggccagaatcgtgcttgagtccgtccaggacatgctgcttaaggtcgccctgcagacggcgcgtgacgactacgaaacccgaagggagagacagcggcagggcgttgagctggcgaaggcgtcaggtaagtacagaggtagaaagccagacaataaaacgcacgagcgcattattgcgcttcgtgaatccggcatgacgattgaacggaccgccaccctggcaggctgcagcataagccaggtaaaacgtatctggtcgatatacaaggcagacagggccggggagtgatgacggttttggccgtgcgcagtaaggcaacccgtgtgctgtgccagtcatggcgatacatgtgaggatttctgaatggataaggtgacatttttgagctgggtgtgggcgtgcatcggtgtgatcgtctggtacatgtcaggccggataaaggaagacgtctgcgactggctggcggagcgccgcagccggaaagcgcgtgccgcgctccctgccagtgaggaacggacacaggcggaccatgaaaggctctccggtagatgaggccgttaataagccccgtaattcagacagaattttagaatttgtctgataccgcctgcgcagggtttatctgacgctgtgcataatctgaacatgataaaatagacagaacaaaaggaagtgttatgccatctgtaagctgctatatgcttctcaaccggcgagagttcacttcgctgaactgcccgggcgtggggaactttccagcattctcgggccagaaagagggcagaaataacccggacaaaacgaacgtgcccgacatcggcccgatcgtgaggggacgttactttatcgtggaaagaccgtccggcggcacactggggcccctgcgcgagcgctttctgaaggaagtttacggcactgaccgctcgacatggtttggcctgtatcgtgatgacggcaaaattgatgattacacattcatacagggtgtgaaacggggtaatttcaggctgcaccccataggcccgctggggctgagtgagggctgtatcacactggtccatccaatccagttcagctacctgcgtgatatgctcctgaaatacggccccacactcaatattcccggcagccagttgaaagcatacggaacggtacaggtatactgatgaagcggataattgtcctcacttttgtttttatcttttgttgcgttgcgctttttaaggccgtcgccgttcttgtgcctttttcagtgttcagctggctggctggccagttccacatttacggtgatgaagctgtaactgactttatggtcatggccaacattgtcatctctgtcgttctgtcgctgcttctggtgtttactcttcccaaaaaacccagaaagcctcgctgaaaggcatccccggacgtttttcgaatgtcagcgtgccggaaaatccggtatgtctgacttctctgccgcgttccaggaccaccagttgcccggaccgtattccctgtcatagtggacggtcttctcctgctttcgcagcaggtaatcaggcgtgttcatcccgaagacctccaccggcagtgcatccatgccgggaacgtccttcagcacgaagtccggaaacacgtcttcctcgccgtcgtagcgcagcggcttgatgaaggcgcgtttttcctgccacagtttttcttcaacgattccctcatagcccgaatccagcggaataaagcgggggctgaccgtcatcagtgccacgtcgatgacggtgctgcagctggacggccggttgcgcccgtctgtgtgcctgaacgtcgtttcaggcggctctgtctccgctatgacaacgaccttgatgccccggcgccagtcgcccagctcgcggccaaagctcctctccaggcgcaggcgcacgtcttcaggcagctccaggccaggaaagccgaaaaacaatcccaggggcagcgttgtctgcagtcgtgcttcagcagcctcattccagctggccagcacggacactacgatgagccgccgtttattcttttcggccgctctcaggtgttcccagtttgaaatgacctgcggcgtgcccttcatggccatgagcagtaacgactcctccagtggcacgcggccgacgcgtatccggcccgccgtctgctgaaggcgccagctcacccagccgggcgtgcgtttctttttgtcgaaagccgggtgccagacattgataccggactgttcccacagcaggtgaagcaaccccagcaggcgcattgaggggcggcgcttgcgctttacaggctcatcagcagaaacgtcttcagccggctttacctctgacggagcctttttctgcaggccagtaggcagcctgaccacgatggtgccgtccgaagccgagcggaccgcatcgccctgataaatctccgcatgccgttcgtctgaccacacagaataaaaacggcagtccggcttgtgttcgttacctgtaaaggcatatgaagagagccagcagcgttcagtctcctgagagtaatgcaccttcaggcggcgttttacggggtcagtctctgccggcaggcagctgcaggtgaccaccgtggtctttttgttgtcgcgggcgtgcttcagccagcgctgccacgtgggcgtttcattctgctggaaagcttctgacgcctcgtgctggccacgctgaccggtgaagtaaaccggataacttttttcttggtcatatacagtccacctcaccggcaatattaattatatttttttaacggctgcactgtacaggcgatgattccgcccagagccggttaaattcatcctgatactgcttactcactggcaaactgtctctgataaccagcgcattttcggcattacgcttttcagccgacgaggtgtaattataagaacccgtctgcacgccgttatttcctgtcacgataaatttgttatgcataatactgtactgcgcatctgttctgacctggatacctgaacaggccagcgcgttaaccagtgaccagcggtcgtgacttttcttttcgtcggccactaatcttacaggaacaccgcggcgcgacagctgcacaagcgcctctgccacaggcacactggtaaattcgtaagcagccacatcagcagaacccgtagcagaacgaatgaagctgatgatgagttcctgagcagtaccgcccggtgaaaaacccgcctgcaggtctgttccgtaacagggagaaaaaggcagtgtaaaaagaagcagacagaaaaaatttgtttttttcattattcattcatcctgtttaattagaagttaataatacatcttacgcgactaataaataaacaaattattttcacagctaaagatttttaataacttataacaattatcgactgaagtaatgaatcctgactccgataatatgagcaacagatacggagaggataatatgaaccagtttcatgaaattaatttactgacatcacgtggtgatattaatggtgcgctgtcgctgataaatggctggagcgaaagtgttgcgcgcaagatcatgaaaaaggccggatatcctgtgccctcggaaaaaggacgggctttctggttgtgggttcagcagacgctgatgcaggccgcacgaagtaaacgctgtggctaccagcaccggttctcacattcgttcagccgtgtaaggtcagaggcagaaaatcactacgaagattatgcgaaaatgatggctgagctgaacgggaaaagtgaacctgtatccccctcagaaagtcagcttcccgcgaagagaggtgtagtgcccgtcgatacagctccggaaatagacatccggatctctggccctgcagaaggtatggtaaactctgacaggaacacccagccagcggcgactgcttccgttaatgtactccagttcgagaaggccactggttgcatcgtaacgcacgagactgaaaatcgaagaatcaatagaatgtggtttcatgttacggcggattccctcctgtcatgtcctgtatttaacaaacgctctcagaactctaaaactcatgcctgttctggtttgtccacattacggctcattttaaacgttgcagttatttcactcagcaaatttctttttgtttattgcaaattccgtgtcatgagcgctcacttatttaaggcaaagtatgacaaaaacagactggttgatgaaattcaggcgttgccgttcgatggacacgctggagaccgtgtacgaacatctgaagtacgaaggcgatccaaaagaagactatgcgatgacttcagcatacgatcaccgtaaagctgaactcactgtcggaaagttgtatgaccatataccagcccacgtctggagagtggtcaaataaaaataccttaaggattttagaatccattatgaagcgctcgccgcagacctgtgaccgggcctttggcccgcgagcaggcgaggaagcgcaaaagcattcggctttcataatctgcgtacgcgctgtttcacatttggcgtagttctttattcacaggcttaaattttaagatcattttaaagtatttttagtgttttaagctttttaactcttccgcagcccttggtgtatctggcttcatcgtcgttccatatgggcatcgcatcaacctgatgtgggatctgaatcaagtgtgcatggggaatacagcatcaccttatgggaaatgcatcaagtgtctatgggaatcacatcaagtttgattacacgtttcctcacttgtggataactgagacctaaagcgttgctgtttttttctatggatgcgattatgggtaataaaattttacccataggttgaccgatgcctgctatctcactgaaaagctacaagaaaaaagtaagcataaaacagtcgaatgaactgacagaagccgcgtattatttgcctctccaggccaaaagagtgctgtggctgtgtctgatgcaggcttacttcagtgaagcgagtgaagattttgaaagcgatgtactcccattattcacagtcagcgtttccgactacgttaaatactttaacgtggctaccgctgtggccagccgtgatgttaagtcgggtgtcaaggctttaggtgagtctactgtaacgttttaccctaaagacggtgagttcgagcaagttacacgtccgtggctttcagaggcaggcatgaaacgtggacggggttcatggcaaatcgagtttaattacaaagtcatgcctttcttggttggcctttcatcgcaatttacaacctattccctttacgattgtggccagctgaatagtgtcaaagtaatccgcctctatgagagcttgtgtcagtttcgcagctctggcacttggatcacggatcatgagtggctttgtgaacggttcatgctcgctgaatctcaaaaaacaaataaagctgaaatgaagcgcacgttccttgagccggcaatcaagaaaatcaatgaaaagacacctctcaaagtgtcttacaagacgcttgatgatggtaagtttctgttcagcgtgcttgataaacttcttaccaatgggtagtgggtcaagtttaagccgctgtacatcgattgctttaaacttgatgcttttcccactttcactaacggcctgtttgtgttgaaagacctgcgaaagttgatgtgatccccatgtttgcccccttgcggatgttgagaaaagctttatataaaactcgataccagctgatgcgatatcttgatgtctttcccaggcccgttctgtccctgacttgaggtttttcccacatatgtgatccagtgaggcatccacgtctttctgtcgcttgaaaagcaggaatagaattcgaggatttcaaaatttttcccgatagtaaacggaagggtaagttgatgcttttcccataattatgccatcagatgaagttgacgcatttcccataagcaaatcgtctagcgaggttgctgcctccaccatactaaagccattccgtgatgtagacgcttttcagtaagcaaaatttggtgtgacgttggtactatctccctttctgagggcatttgagaagttgatgtgtttcccatgttgaggtcgaagtgataagtcgatgtgtttcccataacgacgccgtagtgcaaagttgatgtgtttcccataacgacgccgtagtgcaaagttgatgtgtttcccatagcgacggcgtagtgcaaagttgatgtatttcccatagcgacaccatagagcaaagttgatgtgtttcccacactgagtctatgcgtcaaagttgctgtgttccccacactgagtctacgagtcaaagttgctgtgtttcacataggaaagagtctgatgaacttgacgcatttcccatagatattacttatctgggcatgatagtgtcttacaaatcttttttgatggtggtgtcatctatgaatttgggttcacacagttaaataactcatttacacagaggttttattcagagttctttataagccataggcggcctcataaaactaaatggtgagaagattttttatagataacttcttatgcaaatgaggtattatggtgtaaaacttaaattttcgatgggggaaactttggatacatttacttctgaagctgtacaagatccagaagcctcaaaaaaaacaaaacaatcaaaagaagaaagggtcagtaaaaaagaattgcttcgtaatgttatagttttttggatatcaatttttttgtctattttcatctatatttttttggttgtttttaaaacaacatattcgtattttgatttttattgcattttaaacgtttcgctgtactctttaatagcaacttctttttttctaattatgttcgccaattatttccatgtacgtgtgctcctggctatgagaaatgatgatttgtacatacttagacctgctgacaatctgataattaagttttttatcagaaaagcgtacagatctggccataactatgtagggataaaactgcaggcagtaatagagaatgaaaaaccttcaatcaggatttctaagctaataaaatttcttcaaaatcagaattgcaaacacaaccgtcctgttattattcgctcacatatcttcacggctaggcgctggcgagaagagcttattaagcaacttgattctgagggtatgacatacagtgtagaaaccaatttaacgcttcagaatcccttcaaactgaagtgtgttactgccgcgataactgcgctgggtggtaaaataccatcaatctatgcccatgaagtagaaatagttgtgtatcccatcagtaaaaatgaatccttggcgcaagcttaaaaaaactacaaagaggtgtgtaatgttgagtcagacactatagattctaatttttatcccaaagaagccagaaagtaacgactatgactgtgatcgcgaatattgctgttgaaccccatgcgtaagcaggccagtaattcacagcaagcactccaaaaccgagaatgagtattgccggaataagcgtgcttgcaaaatatgtcagctgcgagcgcaaccatctttttaaaaaatcaatcatctgataatccgtacaatgtcgtcagctatgtccttgtctgatcgcgaggaatttatactgtgcgcatttcggcttataaccggttcaacaataaaatagaacatctccagtttttcagcatagagagcagagtagtatcgcggattttggtttttaagacggtttgctgcatctgcggccatctgcacatacccgtaatagctcaccagggttatagttgcagcggaaacttttgcgaggtttctagttgcgcccatcctgatcccaatactgtagctggcggccattgcgatagaataggccagagcctggtttgtcaacgaacctgaagctattgtgactcccataccgatcagtatcttcctgatacgggttatgcgttctgacgtcaatccctgaagcagctggttgacgtaaatctcaagcatttttctgacaacgtggtgctctttaacaagctggccaatggcttccataaaccggacatcttcgtgtttctgatctttacacacgtcctgatagttttcagtaaaacatgatgtgtaaaacaccagacgcctggctccgagctgaatgcggtttgcctgttcaagtacttcatctttcacgccactcagagccttatcaagacgcactccgaaaaggctgtctgcctgcattttatcgataatatctgtgttgctgatcatttagtcttttgccagaagttattctgaaataatgtccattaaaacgtattttagcaggcaagaaaaatctggcttaagttggtgggtccatcatctgctcgatggcaaacatgagagcgggttcaacctcattacttcgttccagacgtgccctcaacaaaagtataagatcacgtttgatttcttcgcggctgattacgtcgccatcactcgctttcctcagacaaaccatgccggtgagtctgcacgcttcccggtaagtagcctgaactgcgtcatcatcaacgttctgcattggatatctcctgcagtgtctcagttagttatgcgcgacagcgcatgtaggcgccagctgatgcccgccagggggaactggccacatggcgccggtagcccggcgaagccggttacggtttgatagattctgcctttcgggcacttcgccctgcaaagctaaacccgctttccgccgcacgaaagccactgtacgccgtcggagtggtcacgacaaggcgaagccgcagtcggggcgtatctccgcgtcagcgggccgtaagggccgcttacgggcgtgttcactgtaccctgaagcaagtctacttacagcgacacgaaaaccattagttacaacacccatttatcagccacgcctgttccggcccgaagggccgggcgggggcggctggtcagtgggggcgatgggttatcaggtccggctccggtccctgcctggaggggcactcagggtgcaggactgcgtcggcgctgtttacagtgaactaatgtatgctgtaactaaaatgattgtgctttggggcccgcttaagcgggagctacccctgactctgagcggcgcggacgcctgcggccgctgcaagcgaaggccttatttatccacacacgatgcctgcatgaacaccttattttacttatgaatatttctttctgacgtaagtcaggaatgttttgcgggtatctcatgagtcatgtgcggctaacatatttttcacgattgcgggtaaatgtggataaaaaatccgacggtcggttttctggccaccggcactcaattcagcagtaaaaacagggcgtggtgtgcatgaacgttgccgcatttgcggccggcacaaacgactttaccgccagtcaaggcggttgaaagagcgaggagagtcagtgtacgacgtcgggcggcgccggctcatagccgaggcccagctccagctggttgaggctctgccacaccagacggtcgaagccgtcagcatcgaggttaaaaagctcatggtttggacgggaacggatcagccagctggccatcgtctgccggcgttcgtccagcggcagacgactaaggcgttttctgcgtttctccttcacggccttttcacgccggtgaagcagcgtggccatacgcatattttcgtaccagcgcttacgcgctgcgcgcacggattcatgcgtgcccggctcgatgatgccttcagactgggcctgcagacgaacattacgctgctgaagcagcttatccatgttgacgccggagagcttccagaagcgatcggtgaggatgatgtggcgcggcatccagtatttttcaaccgggtcccactccagttcaggcagctcaatgatgccataacgcgcaagagcctgaaaaagcctggaaagacgacacggttcaacccgtgtttccggaatgacgttgccgctttcatctttcgggctcagctctctggccagcccgctgccgtgaacggtgactaccgacgtggccatgtctgcccgctggacaagcaaaggtgcgatcgcatcgatgaggtttctgcgctccggccggaaatcgcgttcgcggcctgcggccttgcggagtttcacaaaataggggtgacgggaaaggcgctggcgcaaccgccattggccagttaccttgtctttaacgacgtagttacgcatggcatggccatactcgcccggcaatgggcggtagttttccggcgcgaaccagacgggttcagggcatttgcaggcaacagaatggtcgccgcgacgacgtctgtcttcctttggggtcgggcagtttaacccgattaaaatctgatcattcaccctgtcccggacttatggcgggcagggcttgtcttatgaaatgcatgcgttataatccttcacaggccagcgcctgcttatgaaccccctgaatctgaaccttccgccaagttgagacagaatcagggggtttttgcattcagagtctggtgatttacctcgctctgtaccctggacgtttttacggatacgtcctatccggagaattctttaccctcaccgcgcatgaccggttcggggttatgctttacctgccttcgaccaccacagtacccggcaaggatcacactcgatcgccggaaccacccggcgaagtctgaaaatcataaccgcagccaaccgctaaatccagcactgaataatcactcagcgtaccggatggataaaaaaactcatatttagtcggtctttatggttcacgaagtgcgtatgtgtcctgatgaatgattaaacgcatggcggtgcgttcagagcatgtccattttcgaaaggctgtatctgttaaggaaagggggtgacgatcgcaatggatcacacccaacagcgagggaaatcgtttgagttagtgaagagcatatatgcttacccccattcacgcggaacggagatgtctgggcttttgttataatcgaataaagtaattaatatcgcttgattaactctatatatttccttcggattaaaagtggaatctgaggattgaattccattgctagcgtagaaccgtcatcttcatttatttcgttcagatgctcgacttccatgaagttgttggggtgattgtcacggaggtagtcatgaagcaaaacaaaaaagtcactaaaatttatgtcgtaataacattctgacaaaatttgcgactcataatgataagcgcgtcgtttagggaacatgctgtcaagaaaggccaaagcccccttttcaatctttctgagctgctctcccgttgtgcctacaacacattgaaaagcacaaaaaatgtgataatggggattggccgagctatatgaacgggatctcaaatcgcccagtgtaagccctacctttgcgtaacaagtgtctcttttatccgctcccaggtaaatccagatgttggaagactcaaagtttgccttatcacgctccatgcctacggccattttgtaatcgtcgtcaggaatatgaaggtcgtatgtctgcgttggctttctcacaaatccctcttcgtaaccggcttatgtctgtgttgagctttgtaatacatttttccataaatctatggatttcaagcccgagccgataatataaataattttaaagtttcccccaaaactgaccgataaaccccgaagacctgacatcctcaaattttcgtcgctgaaaggccttcgggtcccttagaggagccgtatagattatggagatatttcaatgaaatttatgaagatagtagtgactgcctttttgtttgcctcaacccccacgtgggcgggagatctgactgggcctcagaataatgccgccagagccgcgaagcagtatctttcgatgtcgggcttctcacgagatggacttatacaacaactctcatcggatgcaggcgatggtttcgagatttctgacgctaccgtagcagttgacagtctaaatgttgactggaaccatcaggctgttagatcggcgaagcagtatctcagcatgatgggctactcgtgcaaaggcctcattaatcaactttcctcaagttccggagaccagttcaccgttgaacaggctactcatggggcagaacaatcaggtggctgttaaaaaagccaggttcaaatgatggttactttgaaccactgagattaactgcgtcagtttttactctaactgtatgctggtttattaacgctggaccgttaccgttttccgatcacatcccttattcaaagccttataaacaaggggtagacagatcttttactgttagatattttctgcttaagacaaaaggaaagtcgcatgacaactcaaataactgttcatatcgtcaaaattagaaatatatttagtaattaccatatcgttgaacaagaagtcagcggtgtttgtttatatgaatgtgatacccaggaagaagccatagagtgggctgaaaacaaaggctactcctacgaaatccaccgtgaacgtaacagaaagccaggcgacaagcacggccagttccgtaaacaatagtatggcttagccccggcagcgtagttccgccgccgggctattcttactttccggacgctttgatgatggcctgctgcatgaccgcttcgctgaccacgccaggtatgacggtcgtattttccgggctggcattctctgccggcatgacgatgattcccggtgtacccgtcagccccagcaactctgccagagagtcattactggcgatgagactgtctgattttgcataatcctcctgtttttcaggccctgcacccgctattttcgcagcagtttctatgtcttcagctgtaatcttgccctcattgtgccctgtccggtaaatgccattgtggtaatcaatataggccgcagcgcctttctgccggaacacgtcaagaccacgtcgtgacgcctgggtggactccggaaaacgggaggcaaatatcgtccagtcacggaatgcaaacctgacatccgaattactggccatcaccttttccatcaccggcgacatcatgctgcaggcaatgcattcgtaatcaaaaaactccgtcacgatgacctttgactcagccggtcccgtcaccggcacgccgtcgagttgcatcagcagacggtgggctttaacggctgcaccgacataggccttttgtttcatctcttcctgccgcgcctgaagctttttactgacttcaatcaggacatccggatgcgcaaccagatagtcagccgcaatttcgccgattcgggcctgctgcgcaggcgtaaagtcctctgctgcagccgtcggtgccgcctggacagcacagcaaatgccagtggtcagcatcactgccgccagttttacgtgttttttcataatattctgttttctctttcaggaattcagggaagtttatggctggctgtttcgccagatttcgggagctggagggccgtgatactgccctgcatgtgtatcagcgctctttctgaatattgcgggtaatctcaggcacaggttcttcacgctccctgccgcgtccttctgccggcagggttggctgactctgtctttcaagctcacgcgccgcgctggcaatggcgcgctccgacagttcggcttgcgccctgacaggggcctgcacagaccggtcaagttcttctgtcgccttccggatgacagatgccggtatggcacccgccccgcctgtctcagcaggcagccgtatatcgccaggcatgccgccgttcgccagcgcattcagcacagcgctggctgaagccgcattcagacctccctgcgacgaaagctcgccagcagcctgaccgataaggcgtgcatagtcaggttccttttcccctggcaatgccgggatttgctgtttaaccgactccactacgcgtgtcagaagtcgtgaattcagcgtctccttttcagcatcagtttccagtttcaccacagtctgagcttcagccataagctgcttcgcaagcttctgcaactctgccattccgtccggctctgttttttcgggtagcttcatgtcttccctggcggcttcggtagccagctttctggccagcgctttcatatcgggttctcctgcccgttctgacctgtccgtttcaggcagtgaaagtgacgcaccctgcgacttttcaagcgccacgagggccgcctgcagcagggctgactcgtcgcggacgggaccatccggaggcagatttctgagcatatccgttaactcatgctgcacaaggctcaccagcgcagcgtcggaacggtatgcccgttctggctggccaccggcgactttcagcatcctgtcagtcggtgttttacggccagtctgaaggataacgccggtatgtggattcgttctggcagcgtcaagcccctgccccagtgaagtgactatcatcgtttctccgttccggcttttctgcagtacagcagcctgagcttcgcgggtggccagctccctgcccgcacctgttgtcatctgaccagcgtccgcactgattgggtagagactgacgccggcagtcttaccattgccgtcaaagaccggcagggccaggtggggttccggatactttttagtgggggggataattcgcacggttaacggactgtttttaagcccctgttcccgcagaaaggtccggcctatggccgtttttgacgccggttttcccataccccagatgagtctcgcctgagagcgttcaggctgaggatcgatggcatcgtgggccgtttcaggcccgttatccctgttgcgaagcgtggccatccagtctgccattccatctgtgtaaatctgcacgtggtcaaccgcacgagagatgctgatgtaaaaggcgcgcataccgctcatgcgctgtcgtgccccctcagtaccttcaagcgctatgacgtactctgcactggccccctgagcaccgtatcccgttaccgcccacgcatagtcaatatgctggtctgcggttaccttccccggctctatgaccttttcccctgctgcactcctcagtaccacctcgccattatcccgtagcgcctgtacccggtactgttcatgcgctgtgtgtccggcctgtttctgcgttttggtcatgcgcagactgtcgccaacccgcagctccaggcttttacgctcaaacacctcgatctccgtggcattgagttcagccggtgaataaaactttgtcctgccgtcttcatcccgtaacacgatgcggttaatacccgaatcaacagccgtcacactgagatagctgtcgttcaccataaccacctgccctgacttccaggatgacgtgcggttaaagtcatgcctgccacccgtgacacgctccagaacaggaacgttcacggctttattacccagctccttcgcttcaaacaacctgtcatgaatgccctgattgattgcccgcctgtcttcattcagctgtgcgatgatcagggtcttttccctcgcccctgccgttcgccccatgtagtcagcaacaatggcctccaccggcgctttagtttcagtaactgaacgttccggctgtaccacgccggctgcacgcggaaccgcagagggctgaacctgcatgattttatcaatcgcagccgctgctttattctctataacgctgtaaaccgcagacttgatgttttcatcacgctgacggacgatttctttcattacggcgacatcaatggggctgcgctcctgaacaagcctgaagggtgcaccactctcgggcgaggtgaactgcgcgatgtccccgaccgacaccgcccggccgttgccggtcgatatggccttgtaagccacggccgtgtcctggtttcccagcatggaagactcatcgatgaggaaaagtgtgttttcaaagcggacgctttcacccgcagccgcgcgctgctgccagtcaacgatgaaagatttcagggtctgtgcctcaatgccgacgcttcgcatttccttcaccgcccggtgcgtaggcgccagcccgatgatctgtggccgggagccctccgggagcgtgtccagcccagctttaactgccctgaactgggtggttttacccgtaccggcatagccctggatggctgtgaacctgtccttactctcaagaatgagtcgcgtggcgtcggtctgtccagccgtgagtcccgccgtcaccgaaccactgacgttctccataagggcaggtacagcattttttccgtccgcgatttccctgacgatggttttttccatttcccaggtcgcgcgggcgacgtagcggaactcaccaccaacctgaacacgtatcagatccctgtcggctacctgctgttcaaactgcttctgcagatcgggaacgcctggcccgaacttcattgcctccttgagcagttcgacctcagtaaaggccacatcacgcatctgctcaaccgcgcgcgaaaacgccttctgaacgtctgtctgcaggccgcttttaagagcagtcagtgcttctgctgcgtcatccctgccgctggcctgacggaccagagacaacggagaacgggttgctcgcatccgtgcgatccggtcctctgcccggacaagaggctctcccgtaaacacctcggcttcgtggccagagcgggcgagactgttcatcatgttggccgtcagatcgcgaccattgaggctggccagaaccgttccacggtcattgtcctggcttcccggggcggacacataggcgtgggtcagataaagcggccgaccggtttcaacccgtactggctttttctgtccgtcacgcaagagtgttatctggccgtcgctgacggactcaaccgtcagccgatcgcgcgccttaattcctgccggcttgtcgccggcgacggcaaagagccgctcgccgcctgcgacctgcaatgattcacgctcaaagagccgccagtcaccagtgagcttccggatgtcctgtaccgtctcaacaccatcggaatcaaccagtgacagttggcggcttttttcatgaacccggtcgatgacgtaatggcgtgtttcgtttttatccgatctgtcctccagaacctgcccgggacggtaggtattggcaagctttcgggttttagcggacgtataaacaggtatgcgcgcctctacagtcacctcttcctgtccgagtttaccggcatctttaagcgccgaacggatctgatcgttcagctgctgctgttcacgttcgccgacgaccgtcgccgtcagtgcggtttccggatcgctcagctcagcataacgcgtggccagtgcctgatagcgatcgcgcttgtccgcgatacttataacgcgggtttccagtccggacgagggctcgctcagggagagtcgcggcacaccggactgttcaagaaccgacagtgcgctggttgccgacgtgcggccggctccgtccaggaacagcagctgcgcattcttctccagagcttcgccggtcagcacgagcatttctttcaggcccagtcgctcggccccctcaaccacaagcgtgctctgtggtgtcagggtaaagctgctgtccagaattcggctgcggtgcatcaggttatctttcagtaaatccgatttaccgagtgacagcgcacgctctgcagaactggccatgaccatcacatctcgtccgtgggcacgtgacaatgtcaccagatgttcagcggtttcacgctgacgcagggcagatgagggggaattcaggatggccaccggtgactggagcgcctgaacgaaacgctcaggtgtttcacttttcggcgtccggaagctggccaccacgttttctttgaccgcgtcggcagccacagactgcagtgacagctcgtccagcaggtggatacgcgacgtaaacacgcccttttccgcatccagagggataagttcgccgctgctgatcacctcatcaagcgcgcgtttcaaatccggtattttttcttcgtattcgcctgcgctgaacgcggtcaccagaaggtcgccgtaggtaaaacgcgtctgactgtcgctcagaactgaaatcgcttcctgaactgaccagatggcatttttgctgatatccgcctcgggttcagtctgctgcacctcgcgggacttcgcctcactgatgacttcctgaatgtcaaaacccagcttctccatctggattttccagcgctcctgaagacggctgcggccccgttcagtttcgggcttggcaatgggctcctcatcctgaaccggtgtcatgtcgtggttctttgcattgcccgttctgtcatctgccagcgcgggttcagtcagcggcagttcggttgaatctgtaatgaaacgttctggcccggacgccttctcaggataatcgttccttctggccagatcttcgttaagcgggcctgtaatatgctgttcttcattgccggcaaccttatctgagaggcctgaaccggagacgtccggcccgccggaatggctgatgactttacctgcagtttccggagagacactgtcagctttgttaataccgccagcctcctttaagacgtcggccttaacctgcaacggcgaccgctcatcccgaacggccggtgtgctgttttcaggcaccgttttcgtgtttacgtcatcctcaccatagcgatcgagagactgttttctctggcgggtatcgagcgccgccacatcgcggcttttcaggctggcttcctcacccacgctgaggtgaatttccctgtgccgtgatgagaattcttccagcacagtttcagtaaagcctttaacttcccagagatcatgaggcccgccagtcagttcagtctcataccccagcgcttcggttttccctttaagcgagctgcggtaaatctggccaaacttcacctggtgtttgtaaatcgtctcaataaatcctgtcccgtgaatataatcggtggacagagccttccatttgccgtccagctcagtggcgttaacaatgacggcgtgggtatgtatctgcggatcaaggttacgggacgtgtcatgggtaaacagtgccgccaccattttttctgtgggtacaatgcgcgttatgccgtcctttgtatccctggcgctgatcaggttttcaatcacccccagcgcatcttttactgcctcatggtgagcatccagcaggcgcttgtcgccaccggccagaatgagcatggatatacttttgggtgcggaaaacgtcagatcatggccgggccggtggacgtgggaaccctgaacctctttgcccagttcgacgccgttcggcagcttaccgtgcaggacgtctgtgaacgtctgcaggtcaaccggtccctccagtcccagctctttagccccctcgcccagccactgactttccaggtcatcaagaaaataatagttatctttgctgctgtagtagctggcagcatcggcggccgaagccaccggcgcaacggtcatcatctttcataccctccgggttcatgatgttctcccatttcctgccaggcctcgtaatcttcacggtggcgcaggatgttcttttcatcgtcagccattttgtagttggcctgccggtactgatcggcgtaagcctcttccctgctgtcgggaccggttttctgatggccagccgtatgcacaatcaactgaccggcatcgtctttttccgccagcatttgcagatcgggtgcctccccctgagcggcctcatcggacatcaccgaatcatcatcagtcgcgggcctgttgttccgtcgcgccagcatttccagcgcactcgccgttctcaccggtgatttagcatttgcaggagaaacggaagattttgcggcaggaagtacggctttttcagcggccggaacggacggctgcggcctgtcatcggaacgttcagccgcgctctctgcactgaccggcgcctgcgggttacgaccaggaaatgccctgacgttgtccggcaaccttcttccggactcaggctcatcaatccgttgcggtatattgcctgcgggtttactggcgtttacggcgcccgaccgctgaggttcctccacaggcactgaacgtgctttggtcagcactggctgaaccggggtctgcatttcctgtacgggctgctgatcatgggcttcagcagccggcgcagaggcgacgttaactgcatttgccggtagagggttttcaggaggaaaaataggtctagcggtcggagctggagcctcacccctttccagatgttcatcgccggtcggaaagcgcaggccgaggttgacggcatcccgctcgttccggttgatgattttttccagctcaggactgaggttgtccctgaaatctcgctcgatgagcgcagggtggtattttttctgttcgcggtatttcaggctgagttttactaccggatattcacccggcagacggacgtaaaaccgcaggttgggcagcttcatgatgttgtcataatcaacaaccggctccctgaccttgtccttgctgatagaaataccgtcacgttcctgcgccagaccaaagctgttctgctcccgggcttcacgccggcgttgatagcccagatcttcctccaccatttttgccacttcagaactgggagagcggccgtaaaagcgcgtgttcagcaggtcaaaaatggctctggccatttcgcggccgtaaacgttaatcagctggggcatgttctgaatacccagtacaaagcaggcaccgaacttacggccctcggcaagcgtttcgcccagatccgggagtttctgcaggcccagaatttcatcgccgataatccacacccgtcgctggctgtcctcgcccatgctctggataaacaacgtggccagcgagagccacatcgttatcagcgggcggacagatttacggtgacgggccgtggtggagataaacagccagctgttgtcatactgcttttcagtcatccactcccggatgctgaactcgggtttaccctccttgtcgagcccctgcaggtaacgcagcgacttggcgtagttggtcagaaccgagcgtatcgagatggcggttttttcaattttctcctccaccaggttggcggagggcgtgttcttcaggaattcgcgcaggcttttcagatcgatggacagcagggttttcaggaatttttcaatgttgcgatccgggtccgatgcgaactgcatggcagtatcgctgaagatagtccgggaggacgaaacccagaaagggtccgaatcgccctcaaccggcatcagcgcggccgtcatgttctcataatccaccacctcacgcccttcacgccacagcacccagttttcgcagcgtctgtcatgcgtgttcaggattttgtccatgcgttcgtcatagtgcgtttcgacaaacgtaccacctgagtcgtatatgatggcgcgatcaccccgcttgcgtatgtaatcaagcagccagcggataatggtggacttaccgacatttacggtgccgtgaatcaggtaattcatgatctcagcattacgaaccatatgaagcccggccacctgcagatttgatttttctccagcctttttgagcagccggttaatctctttcaggtcatcggtaagctccatgccggatataaattcatccgcactctcctttttgcctatccgtcccacataccagaatacaaggctgaatagggccattgccgcaacgccgcaccagaaggcacattgtttgagattctggacaagcagcgcaccctgctcctgcatccagggatttgctagcagctgagcgagggtaaggttaatggtgcatattctttcgggttcgcagtgccagcgaatatcccacacgggcgggccgtcgtgctgcatcagccggataaagcccgactgcacatagcccgtccagtaccagaagccgtttcgaagcgtatcttccggggtgatgtaccagaacaagcccagcgtcgtcagaacaaaaaacaacaacatccagtgtgaaatccactggttgacctgtatgaacattcgcaggcggtaggccgttatctgaccgccctgagtaaggtttttcggcgtgaaactcatggaataactccggcagacgcgcgcaagcggcccgccccggttaacaggagcgggctgggggttacagggaaacgaaagcgccggacagagcaaaccggcgttgggcattacaggctcagcccgggattttgcgaatgaaaccagcgcgcttaagcaaccagcatcccgccagagccggcagaccacagactacgaagagaacattccagcagagcaatgtcagtacagacagcacggcaccggccgtcagcgtcagcagtgccatcaggcaaggaatcattccctgcggcgtcaggccgttttgtgtgcttctcatggcaaggtcatatgcgaagaaatcgctgtgcgacatgatgtactgagtcactggctggccaaactggcaaagaacaaatgcgctccaggcaagaaaaaaagtaaaccatgtaatgagggtgcgcagtgcgccgttaaattgcagcataggtatcaccttattatcaaagttgaacgggaggcttgagaacgtagtttttaacgcagcgcccgccgcagacgctggctgaataagccggcgcgaggaggcgaaacgtttgtggaacaacatgaggcacgtacgcccggagtatgaaaattcaagcgttttgagtaagtgcagatgaactggcaggtacaaaattagaacgacatgcgcccggttgtcaggagagacggtttattgtcgtccacagacgcatgacgttggtctgattgaaagccgcggtgaacgcggctttcacaaatatgatgcagttacgcgaacgttgatttcgtgagcaattcagttacggcagaatgtttgtgattgatttcgccagctgggcttcgagcaccggcttggcttcttcaaacttcaggttaactttgttggcattggaaaccacgcgggtctgatatttcatgcggttgccctgctcgctgctggtctgcagtttgatgccggatgttccctgacgcagagctgcaacgttatcagtggtgaccgccgctttactgcgctcagaaatctgcagatcggtcaccatcgtatagttaacgtcttccaccattgcatctgctgccatgcctaaaagacctactgcaagacctgcgccgagtacagcgccacctgaattgccgttataagcagtgatacctgcgcccagagctgctcctgcagctccaccttcataaccactggtcagaaacccctgagcctgacgtaagtccattttatctgctttcagtacgttagcctgaacccagtagaatgcggtgtcagggctgctggacaggctataaccttttgcccgaaggtcgttggagatcatggtctgcaggtcacccatatctttatcggaggtattgcgcacctgaacccagactgttttttcactcgaaggctccatccagaccgtctgactcatctgagtcttcacgtcgagattacgctttttaatagctgtgctcattgcaccacaaccagacagcacaagacatgcagcagcaattgccgccacaaaaaatgaacggtttttcatttcagtatccttgttaaacgaaaaaaagggcgcagttgcccgttggttatgtcttcagagggattctttggtggtgatcccttccgtcagaaagacggaagggttatcgacttgatggtttgaaacttaaatctttttgataatactcgaaattttttcgagagccagacctgcccctagtcggttaatttccgcaccaatagcgatgtttattgtaaagaaaaaaacgacttcaagggctgtcactccaaatgcaaaccacgaattgaaacctgccaaaacagtgctaacacacattaatactagaaaaagtattatggttttctttgcaattttttttaggtggctcagtatcagtgaagtttcacgtacatgcttaggaatggacatgtacattatcatgttgttgtaggtcatgagcgcaaagagcattcccacaattgctgtaggaagaacaacaatccaaccatcacttaccaaaaactcaaagtaaccttcgattgattttgacgctgagccaggcaaataaaccgacaccgtgcttaagagcgatagaaaaactgaaatcgcaggaataaaaaaacttgtcttaattaagcttgagtttgatgggattatgcgctcacccgacgaaaacccattagtaagcatcgttatatctgcgttaacttgtgctgtcgttagattcgccataatccctctcatttaagcttattatgaggcttctttttgatgagctcttaattgctcaagcttagccttaaacagatccgtttcattgacatcaacaacaggcttggtctgcctaatatcttcttcagtacgacctatttgctggttgttgaccgcaccctggtgctctcttttgagtatatcactggatgcctgaacagtgcttttatttttgcttaattctcggtcaatgtctcctatttttccagtattttcaaagtttctgtctgccactttatcagcgatgttttgtggcgtattcagtgagccagcctgttcattcacacggcttactcctgagttgtaatcctgcgcgatcgccggtgaggttacgctacctcggggagtaatgttccgctcgttaacggtctggctgttttcgcctggcccactattgcgaccatgagaggtgctcccctggtgaactgtccttgctgattcgttttgacctcgctgatttacctgtaccggatcatgtgacgagccctgactatcattacccgtgactgtaggtaacgaaccggaaggtgtcagcccctgcgttgcggtctgctctgttctccctgcatagttttgcattatttccggttccagacgttctttcatgaattcggtcgctgcagtctgggccgtatttacgttggtcaggacgtgctgtgcatcgctgccgtatttggcagtagtccagtccacaaactcctgattgtagtttgcgtccaggctggcactctggttctgcgcaagcgtggccatccggctgaattcctgactccgcgtggtgctgtcggtgtactgatgatactgacttttggaatcattaagtgtggccgcgaactgttgcactttcgaatccgactcgttattgctgtggcttcccgattcgctcaggcgcgttgaggtaaccatgtccataccctgtcggaaatccttcgcttcctggctgttttgatccttacggtaatcatgaccttctgcatggctgtcctgcgtaccgtgtgagctgccagaagaatggcgccagtcagcattgaggttaacttcccctcccgcgctgaggccggttgcccatttacccagtttgcctgcaagctggtcacccgaatcgaacttgccgtataccctgccgccagctcccgcactgccctgattggtgatatccatgagctggttgtaagcctgctgctcagaaatgttgtgcgatttcgcatagctttctaccgcagactgcatctggctggccccgcgcgaaacgtttgaggcgacgctgttatcactgccctgcgtcagcgtgtcactggaaccactttgatgactaaactgctgcatctgctggtagccactggttacgctgtggttataaccgtccagagccgtctgcgcctgttgctgcgcctgacgtgactgttctgagaaaccgctgcttgccagcgaactgagcttcaggttaaccggcagatttgagatggccccactggtgtcgtaaacgttgtggccatcggccgtctgcgtatgcattgcgccattgctggtctggaaagcctgctgtccggagcgttgcatgacgttggtgtcgaacttgttggcactcacgttatccatcgacatgttgttgaaggaccagttgccgtctgccgtcgtggatgcctgcccgcccgttgagaacgcgccggaactgataaccccgccgaccacctgagacgccaccgaagccgcacccttcgtcagaaagaacgacatcgcggggatcgatgcactcaggtagcccgctatgttggccgcatccgaatgctgaagggcgacctgatcggcgttggccagtaccagaggcgtggcaccggttttcgactgcaggtagaagttcatcattgaattcagaatggcgtacatcacgggccacatctgaaagtacagaaagccaccggcatacatcttcagcgtgtttaccccgaaaatgctgtggttagtcagggcaagcgcaatcaccagcgggaaaagcccaatcaggatcagcatcatcagcgactggaaaataggcagcgttcggccgatgacaacaccgaaagaggcccagctgagccgctgtttggtcatgctggattcagtggccagattcacgaggtttgctgtatcagacgaacgcgccgcaaagcctttccatccatcacggatagctgcattggtcacgttgttccgcatgatctgcgctgcgctctgaccacctgaatagaaaaagccatagctgtcgttcatcgcattacccaggagcgtgtctgcgctgacgcggttaccaaaaattcgcgtggccagcgtgtgccagctgagccctccaacacgaatgtcgtcgttcatcagcgaacgcatggtgaccgatgcctgctgacaggttacaaactgccggccattacctgtgtcctggaaaatgccccgtagctgacttgggttactggtgataagcgtcaggggatcggtactgttgagcaactgggaaatggtgtacttgttgttcagcatgatgtcgccgatcacgcagttttcaacgtagtcagtaagcagcgcggccagctgaggattctgcgtgcggaaatctgacgactgcgcgatgatttgcgatccaaacagcatgcccgatttggtatacgtcagggaatcaggacgcgccagagtataatcatacaactgagccattccgaaacctgtgcctgtcgtcaggcccgcaatcatcgccagcccgaccggcacgttatccacttcatacaccgctgcaggatcggtgatatcgattatctgcacactgcgcttcggcaccagaaggacggaagttatcagcatgaaaatacccagccagtgaagaaatgccatcgggttgcgcgttttagtgaatgtgaccatcacgcccaggatgctgaacgtgcccacgatgtgaagcaccgtggtgaacgtatcggagcccagtatggtgacgacgccgttaaacatctgccgccacatgtctccgccgtaaatcgtgtaaacctcagtcattgccgtttccccagcgatagttactctgataggaggttgagataatggtggacacctgctgctgcaggtactgcaagttccggtcaatgccgtcaagtgcattctgatccgctgcagactgcagcttcatctgtgcgagaagggactgggcgttaaggacgttggcgcgtagttcgcttgccgcctgttccggatagtttttacccgcaagggactggctggcctgctttaccagctcctgcaggtactggatcatcatgtcctgcgcaatgaagtctgcgacctgaagcaggtaggtcgggctcatgcccatgctgcgggagttagtcaggtatttgaataccggcaccgacgtcgtgttgatgaaccctttttcacggtcagtcatcggagtatcgctggtcagcttactgtcgagtgaaagcatgatgttgcggacctgcgtcaccagcgccgcatcactgctgatgttgaccgtccctaccgtcggaccgagacagatatccatcgtgtcacagccatagatttttgcgctgccgccccgcatcaaaacggtgatgatgtcgcggttatccaccattggggtcagaatggtgacctgcccctgggcgttgaaaacgatggagccgacgatgctcatcaccagttctttcaactcgttgttaccgtcaaacagatggttacggctcagcgcgtcccagataaggtttttgtttttcagtacctggtctttcatctggtcaggggcccggctggtcacgctgtcgccctgcccgccgaccgtacagccctgccgggatgccgcccagtctgaaaaaatgttgctctcgccggcaatgtcctggcagattttctggtttgacacctgtgacacgggccacagccccccgatgatgccctgcgccgcctgacaggaactcatgtttgcagagttgacgtctgaggccagtttctgcaaaaagtccttagcctgcttgagttcagggaccattgtctgcagcgccaggtcaaaggcatatccggatgcattactcattatctgtttgacgaaccgctgcagttccgcgccgttgatgaacgaaaacgagcccaaataagcgtcaatgccgccgcagcccgcattgagtgagggcacctgcatcgagataagctgaacctgcttgacgggattacgcagatatattgaaccgcctgtgatatagcccgccgcctgcccctgccaggcctgtgcctgagaaacattgccgtcaaacccgaggctgctgaaatagccattcaggtcaccctgtacgtcggcctgagccgtactactgattgtcagcgctgtgaaggctgaaaggaggaactgcctgattttcatgttctgcgttttccttttacgagcggtcccactgagtgattcatcatcattaactccactgcgtcataaacccattccgccggagagtgatactgattagcgcgccacaacctgatcccccggcgagggaaagcaggaagagcagcggaaagtcccggacggcgctgagcaacccggcatccggtccgcctgtcagaaccagcaaaccgccctccgtaaactcacagacaaaccaggcataaagtccggctgatgccagaagcgaggcgcagataagcagtaacgctgtctccagtctggagagcgtcaggggatgttcagtcatgattttttccgtaggtgacagcgctgcgggttactgaggcgtcagcgctccgctgctgggaaccggccctaatgtgtccggagaaaggtgatcaatatcggcttcgatcatcagggtcagtcgctggcttatggtggccatgtcagcctcaccctgataaagcggataagccacgttagtgttcacgttaaccatgaatgtggtcggggtcgctatcggcagcccgttaccgaagaatgtcagaatctcaccggcaatcggctcgttcggtccggcctttcgggggatcagtacgaccggaaatgaactgtcaccgtatccgtcaagcgtgtagggatagacctttatgcctgcatcatccgcccatgccttcagcagcggatcaaatttggcgctgtgcgtgcagctgcgctgcatgaaaacgaccacggcataatcattcaggtttgccgttctgccgtcaggcagcgtgatcggattaggcggcctgggcgtggcacgccgcagcggcgtagcggccgggagtccgaaatccggtagcacggcaccccgttgcgcctttgtcttctccatcgcggcaatctgatccgcaacggtagtggcgctggcggcaaacgacagccccagcaggagggaacccagcagaatataatctttcattgtccggtcactcccggccgtctggtgcgcctgagtgcctggacgagtgaaaaaagcgccaggacaccggcaatggagccgcaggttacggctcccgtcaccagcacatcgagagtgagtgcggcagagtaattcaggagcattcgcaggcagttgaagatgactgccgacatgaaaaaaatggcgaccactggcagatgattcatgattttttaccttttgcatgtcccagatatacccacacgcaaatgctcaggcagagagaaagtaatacgccggacttgtagagcatccacaacgtgttgttggtctgttcaacccatgcatcacggctcactggctccctcttgcacagaaccgtaaccggagcgggcttcagctctgaaaacttttcagcggtgcctgttttagctgtgccggatacgtcaggaggcgtgggttcgggtgacggctgacacccccagacctgcgaggccggtgcgtcgcgcaccaggctttccgcagagttcaggagcatctggccgccgctgccggcattcatcgatatccacaaaaacaacagaaagaaaagcagcgcaggatgtatcacaagcgtctgcagaacgagatttgccagacgacggacagcaacagcgcgcccgtgccagacaggtgagagtgccagcataatgatgtcctcagaaattgggtttgaagccagtggctacgttaagaaaacgctttgccaggtcgtcctgggtcatgaacccataggcgagcggtcggaagttttttgatttggggtcaacgaggaaaagtgccggataatgcgtgatccccatgcgtgcactttgtccgtcatccttacggctgtcagggacctgcggtgaaacattcccgtccacactgaccggtatcagcgaaatgtgccgcagttgcgcgaaatcagccaccacgcctgccatctgcgcgtctatcgggtcaccgccccggtagaaataaaacagaccgtactgtccggaaagttttgtgatggcctcattctgctcttcctgatcccgcgcctgctgaagcggggccgtactgttgtagtgcggatgctccagattgtaatcgaggtcaggatacttgagctgtgccacggcaaaagactggctgaacatcgaggctcggtcagtccagaacttctgccagcgcagaaacgttgccgtgttttccgctgaggggtgcagaatcgcgttcgccttcgcctccttagtgtactctttcagtacgtccgcctgctgagagggcgacagcttgctgaaatccggtatcctgggctgtgccggcgtgagtctgggtgccggtgcgtccggcttctttttgggttcgttgtaccagtgccatccggtaaagggttcagcaggcgtcaccactgcatcagcagggacaccatcatcggcaaaggccggtaaaacgcctgccagtaacaggcaggccagtagcgtccgtttcattttttacctcctgtctgggactgaacctgtgccgcaatcctgtcttttgcctgctttgccattgcatccgcgttggggattttctggttggccatcaggtcgctgtaaaagtcctggaagttaatcaggtcgaagttgatgctctgcagttcaggaaccgtgatgccacgacagttcggcgaatcgccgctgccgaagtccacgtgcagctggtcacgacggccctgctcctgaatgatgcggctcagtttgccgccgaacacacagtaaacctgacttttctgcacgcagacgccgagaaccgcgtgatcgcacttctcaccgacaaacaccgtcacctttttcgccttcgccttgccgatggccatttcctcactgttgcagttggccagtccggaactgttgccccagccggtatccacacagcagtttgaaaagcccgcaacggccttacggcacgacatggcctgaccggtaaaggcccggatgtcgatctgactgccgtttttcacgtcatcccctgcagaggccagtcccgcaagctttgaaacggccatgtcgaatccgttatcacctgcaccgtccgtgtcgctgcagtcgccggtctgacagaaatattttccaccacacatcagcccctgcgacgagtacgttgtctgacactgataggtatcgttttcatgaatgcaggcagtaccgtaggtctgtgagcaacttttgcctgccagcgtgcagtttcggttgttgatgagctggtcgcagttgcccgtggaggttaccggcacgacataagcatcagagtattgccagcagtcgctgtactgggtgtaatcccggccgttctggttaatggtgcggctgcctcccggatcaacgcactgtgttccagcgttacctgttgactgtgatttatcaaacgggcagctttcggtccagacaacctgtgaggttgtggtgtcacgttctgccgtcatagggagcgtaattcgtgcaacgtacttcccgtttgccaggctattcttcattccatcacggtaagtgtcattgtggcccgaagcattccacctcaccatcatggatatgacctgccccttactgacatgctgtgccgcaatggagaatgagcccgagctgttgaggtcaaaagtgatcgactggcctaaagactgcattgaaaaggtaaatccgcctccgtgatagtcgggtgagtcaggctgctgaaaaacccaactgccactgctaagtgttccgtcatccggcacagtgaagtcatagcgtacccaccagtccccttcgttattgcctgatgagttcctcgcgtccattacaaactgtgtggtgtaggtctccttcgagcctgtcacctggatacttgcggtgcgcgcgcaggtctgaatctggttcacgtctctgtcacagctgtagttctcaaacaccgacttggatacgaccttctggctgcagttggcgttggagccgtcaacaatacttccgccgttggcctcggcgtttttgccgttctgaataaagtccgcattaggatcgattttcacggacgggtttttggtgctggaatcattcaccgtctgaccggcttcgttctggccgagcgatgtctgacctttatccgcaatgccaccatcaccgccccgaacgccaccgtaataaccactctgggaagggctcggcgtgtagccggggatcactgaagaggggtcggtcccgctggccgccgacgtaccctgacttttattgttctgaccaaaattacttgcatcgttgaaggcgtcactgttggcgtcagcgaggacaccccggacgccggtaagcagcagaagcgcaatcagacagaagcgtttcatcgtcccttctccccttcctgcagcatctgcgctgccgtggcgctgcagtcaccgcgttgcttaacttcctccagcgcctgtttaagcgtcaggctgccataaagaacgtcgaatttctggccgcaggtcaccaccagtgccggcacggctttgatgccgtacttctgatagagcgtcgggtcaatctgcacgcccgcctgcttatcctttttcgacagttcaaacatcgtctcggccgtcttgcgaaagtcgttgtccagcagcccgcgaagcgttgccggaatcccgaagcgccgcgcatcctgaagcatcggcagcaagccttcttccggaatgcccaggctcacgaaataaacagcacgcggcgtcggacgatcggcgctgttttcttccgcctgcgaggccgcgatctcgttccggaactgattaaccctgtcctgctgcatatccgggagggcgatgtttgcgccctgcagctgctgtttgaactgttccagttcccgctgctgctgtttcatgtacgccatatcgctgtctgcgataacgggctgttcagcggcgtgcgcgcaggagactgcgatgctgaaagccagcaccgtcatcagtatatttttcatgggaatccctaaaataatggaggtgatttctggctggcgcagccttaagcccggacggggtcggcctgcccgcagtcctgataacgctcaaaccagaacactaccggttgcgttgtcacctgaatctgcccgaaccgttcagcagtgcggaagttgacgctggaggctctggccctgtccacctgcctggcaatctgctccctgaacatctcaacgctgtaggtcgctttaaacagattgcacggggcgcacgccgggaaatgattatccaggctgtcccgcagcgtaaaggtcacgctgccggtcgctttcagtttccacacgcctttcttgcgtgcctgctcatccacctcggaaatacgcagaacaggctccacgtgatcggcgtgccatcccttttcgggtaacacttcaccgcagtaggcgcagcggccaccaaacttcaggcgcagagctgcacgctgcgttttagtcagtttcacggtattcgggctcctgaacgtcagaggtatacgcagtttcgctttcgccagagcagccagccaaagttctttttggtggcaggcgtgttgtgggtactgccccagagctgcgtcgaagtgccaaaaggatgacagtcactcggctccggatacatgttgaccatctgatatcgccagcgggtttttgggatgatcggggacgggtattcataacagaccgccacatccgccccgaccgtctccatgaccaggccctcgcggtgcagcttgaaggccattcgctccgtaacaagcaatgacgcctccagcggtgaaaactcgttactggtgtagcccgtgaacgggtacattgaaccctgcgcgccggcacaccagaacagcggatcgagtggcagacctgctgtggaagaaatggaatcggctgcacaggctccctgcgcaagcaggttattgaacagcgcgacttccggattgatgatcatcgaaagcgtactgtcgttccagagcgggtccacttccgagagataggcaatatccatgtccccggtctgcatacagccggtactggtgatgatattcagccagaacaaaagcggatatttgtaccagtgaacgtgataaaaactgcctggcgtgggggcgtcactctgcccggcccgccccgttccggttttccccagattgattttaaagccccccatattcaccatgacgcccggctcacgggtcacatcggccagggcgagaggttcccagaaaccgatggccagccccagacggtaaaagatgccgtaggggcataactgaatgggtgatgccggatttggcgtatccggatgcgcgcctgacgccagctggatactgccgagtgacatcggaaacagacacttccagcagacatcgctgatggggttcacccagcgcccgtcaccggcattatcaccacctgcaagggcaggtcgggctgcaatgactgaaagcagcaggcacagcgtcagcaataatcttttcattcatccgccttttcagccagcggacagagccacacacaaaccgggccgtcgtcagtgtcatgaatactgcctgtaaaccagccctccccgagcggtcttataggttcccagtcactgcagttaccggttttccagtagcgttccatctgcgacggatcgacgtcattttccatccaggatgtcgcggatttaagtcggtgcgcgttgagccaggcactgaaaccgtcaaaagcggcaaattcattcccgtcaacggaggtaaaatagtcaggatgggtccagtgtccccagcgatcgcgcacgacatcgcgcgctgagatttcagcgtgaactgtcataaaatgaattccgtgattgtggcagcagcgctgccgtagccagttaatcaggcctgcctgcggaatgcaggctgaggcgtaccgcagcagggcgaggaacgaacagcctgtgtgccgcgggcggagaatgtcagaatatcagggggagaatgctggccagcacgatgaagcctgcactcattaatattgacagtgtgattaaagattcaattctgttcataaacggcctcgggtctggtcaggtcctgtgatgcggctttgaatgttctgaaagcccagccgccagcagcgcgcttttctgctttttccgtgatgccctgctccagtgcggtggccagctccgtgaagagtccaacaagctcctccttccggcgccaggcatcagcctccagcacgatccacaggtggtcctgcgtcatatcgcggccaccgctcaggttttcatgccaggcccatgcgacaggctccacgcaaccgtcctgtgtttcgggcaggaagaaaggggacgtatacgtcatctcacaggtgttgcctgaccagaggacgggctcacttccgcgtccacaagcctcctcctgtttccgaaaggcctccagtgttttcccgaacaggtgagagtccggacgcgtttcaggaagcctgcagggaccgccgtacgtgcagtcaatgctgctgacgtggtcgttccagaaaaaatattcgaagaagtcgaagtttctgagaaatgccgggatgaccgaatgaagcttgccggccgccacgctgcaggtcagcgtgacctgacgcaggggttcatggccttcaccctcccccggtatggccggataagcgcagtaacacatcccgcacttttcatgcatcaccacgcggtggcaatcggggaagtgactcatcctgacgttgacctgatgcaggaaaaaagacaggtcgcggtcaggcattccgctgtcggtctgtatcagcacgaccagccagtcccggtcctgaccgggcctgaaatctttgagagcgtctgtccagttcatcgtcccgaccatccagaaattctctctgcaaaacctgaaacggctcccgggcccttcctgcagttgccagctcacacctcctacgctgccgcgcagttcgccttctgactctgcgagcggatgcccttccagcctttctgacatggcttctatcacatcgggaatgcccctttgcagccctccaggcgcagccgataaaatcagcctgtagtgagtcagtttgcctttttcctcgctctcactgctggcgtcattctcgttcttcagttgaatgcgtgtcgcggcattgcttaaacaggcatgattaattgcatcagagggtatctgagtcatattgggttatctccagaatagcgttaagccgccagagaattccgcggcttgtaacacgagtgtgtccgcgctgcctgcattctccgcgccggcagattttgcggtaaaagcacgaaccgcgtgccccgtcagggcggggaacgaacagccagtttatggcgggaaggaaaatctcagatgttcagaagaaaactgtatttacgcaaaggcgcacacagcaatatcaccttcactacctttcggtaactcatccatgagctgagcttttacagggcgcagagaggcttgtagcgcacgttgaggttaaaggggggattaaggcgatgaagctaatctccacccccgccaccatcacccccgccacagtgcccccccatgtcggatgagccacaacttacatcatgccctccggtatgtgtgtcgctcatcagaacggacgtatgcacactgctgtcatcgtctgagttgtttgctgaatgcgtcctgccctgtgagccggattcagataaacgggagataaagtgatagataaaccacggcagggttgccacgccgaaaaggaccagaaggatttttgctgtatgcatgattcaggtttcctttcagaagcccgcactgtctggcggggtgattaaatgctggccggcgctgcgggataagcacgaaaggcgtagccactgtcatcatcgtgatcgcctgcggccacctcacctttttcaatgcggctggccgtctgctccagaaaccacacgacttctttatctgtagtatggcggttcagctgcagcagcacccacagattttcctggtcagattcgttacatggctctccaaacacctctgtccagacctccgggcgacgtgaccgccacatcccgcggtgccaaagtaagacggcttgtctgcgttagtcctggcagtcataagtacggttacgttgtggtctgaaaaaaaacgcgtcatttcaattccgggcgaacacaactgtgaaaccggaagggttcgcagcagtgaaggtaaagatgtcttcagggttccgcgcggcgctgatatgttcaggctaatctgtcgtatgggccaggccttcttataccaactcaggtgcgtgccgaggctttctgccagcctgctgagttttttatcttcttcactcccctcaatctttttccagtactgtcttaagtggttcatttcttccgaatcgttgtaaaacccgtaaattctttgttgctgcctgtccagtgctgccctcagttttctcacctgccagaacagaaacagactgagtcctgcagcaatcatgagccccacgtacagcagatatcgttcatgtgtcatcgtcatcccccttgttgtgacatggccccgaccgcccagtcgtctttcacactggctgactgtaaggggcgagcatgtcgtgatggataggtaataaaagcccagccggtataaccgtcgttaacgccatactggacgatccctttttcaatctgctcagcgacagaccggagaaaatgcggcagcgtttcaggcgcggtctggtgcgtaccctgcagcagtaccaccaccagttccctgtccggcatcggcatatgcgggccaaaaacctgcgtataggctcctggctgcgcggctcccccaaacgagtcgggaccaaaaaaggaggggctgtcagcggtgatgtccgactccatgtgccagcgtaaaacgccgtccccaccgagtttcccgccggtcgtcgtcccttcttctttccggaggaagcgggccagctgacgcagaccatcaggaatgtcccgctgcagcgtgcctggcgagccccagcacatgatgctgacctgctgcagtggccacatatcctgcaaccagcctgaatgcacatcacgccggttcataaacgactgaggggtgatggccttctgggtatcagcgtgctgcgaggcattgcggccgtctgcccggcctgtcagcgctctcagcgtgtgctgacgcaccttttttccgacgatcacggccagccacacagtaagggcaagcgcccccgctgcgaacagcgcattgagtttatccaccttgcttctcccgttcagaggggcagttctggtgcatcgttaatgaggagtgttctggagttcctggtctgtcatgcatggcgcttctcctttccagaccacaaaccagcctgctgcttctgcccccctccggcacatttctgtccagccggttgcatggccatcttcagttgcggaagccagccgcctctctgcaacttcatctgactgaaacggtgccagatagcgctctcttgccataaaaacttccgcacctacacgctggcgtacataacgaggaagctctgcagccgacttagcatcggttcgcagcgtatatccctctttctccagcgccccgccaaacgccgccagcaggaactgccagtaacgaatgttttcgctctcagccatataagcagccatctttcggcttccgagctgcggaggagaaaacacgctgaacgtttcttccggctgaggcgtattcgccttccggggcgaaaattgccggacaaagcggcgcagaatcacggcaaacgtcaggaggagcgcaaacataccggctgcgggaagatgatcgataagcgtccccagcgcccgtatactttcaggcgcgatgacgatttctgaccggcagctctgcagtggctggaggtctgccatcgggtgactgctgagaggctcagccaccatcgggacgggattctcaaaggagccgtccggtacggcggtcagcgttcgttcagtcatctgtacggccctccgtcgtcagatgcgccatgccctgctggcgcatgacttcacccacgtctctgtcggtcagtgaggcaagcacaatggccgatcgggcagaaccactgcacgcaagcagggcctggagtgcggcacggaggatgacggattcagtgtaaagcgggtactcgtcaatcagcctgcgaagaccatttttgtcattatcatccaggcgaacctgggagttatgacgcttgattttttcaggaggcacctgcccccttgtgatgtgactcatctcagtgccacctcctccaccctgagcgccctgtcagcacgcgttatccgcaccggcgtatgctcaaagccgaattttgttgttaacgttccgtactggtcgaaatacaccggctcatcgagcgccacgctgctgtcgtgaatgttgcccctgaccagaatgactttgaaattctgctgtcctctgacctgcgttttaatccacgccatctgtgaagggttatcaccatcaatgaaatagagcgtttcactgtagggcaccttatccagcgggttaaccctgtctcccgctctggcaatgacgtttccgcgcatgtcacgtacggtttcacggaccgtaaaggtcgggtcgtagagaaacgcacggtctttaatggcgggcgtcagcccggcaaccggagcaggcctcacggcgtgtgctttaacccgcgcttcggcttcacgctgaatccgggccatttcgccgctgtcctgcatcgatttcaggcgctgcgcgataaatgtcagcagatccggttcagcaatctgaaacaggtggccgatactgcccaaatctttcgcgccggccggtaatgaaaccagcgcacagatcacaagcgcgaccagccgccttttcattgtgccccctgcatttgccgggcgatctcagactggatttccggtgtgatgtcatgtgccccgctgacaacagctcctttcacgaggattaccccgccgtgcttctgcttccatgcgttcaggctgctttcaagggccgaactgaaacggcgggtcagcgcctcagccgcttctttggtcagctgcgcctgcgcactctgctgtgtaaacgtgtcgagggtgcccttcatgtcaaactcgaccgtctcctgctggtagcttgcagaaaccagcatgctgacaccggcattcagtcccagcaggagcaatgcagcgagcgaaatgactaaaaaacgccgctgtaagaacggcaccattttgctgccttttttcgccgaaaccgctttttgttccgctgtggccagaggcgcatcgtcttcgcccgcgtccaccgctacatcgttatgcatattcttcctccttcagaccttcggatttcggcatacctgcccagagtttcagtttttccatctcgtcctggtacatgtcgggctccgaagccagcagccatgcggcttcttcactggttgcacctgcatcctgagcatcactcatgtactggtaatctgagccttttgtactgaacattgcccgcgttaccggatctacaaacacccgatagaacgaactcagctcacccgttgaaatcatcactgagccgtagcctgttctgcctgccttctcgaacccacgaatgatctccgtttccatatcgctgaactggtcagggttggcgttaagatatgttgtcagggccttacggtcctgaagcagcgtaatcttggtgccgctgttgtcccatgctgcagctgcagctgacggagccggtttgtcaggaagtccggtgaagtctttcatgccctgagtgatcgtaatgaacgcacctttgtgtcggcgcacggtgcgataaccggtttcgatgaagcgtgcggcgtgcgggttctgcccactgaaaagacgccaggcctcatcgataatggccagctttttcaggtcacgcggtgagttgtacattttttcctgaatggcgaggatcagggagtaaagcacggctgacagcagatgtggcctgctttcaaggcttaacagctccagcacggtgaaacgcgttttaccatcaagagtcggcgcgtcggagttaaagtattccccgtcacttccccaggtacaccaacggtcaagcagcagaaccagctcattcatacggttcatgatcgtcggctgagtgccgtactcgcgctgtacttcctccgacttcaggtagttcacgacgtcgtcgatacgtgcacggttttgtcgtaacgcataggccgcgaccacgcctttttgcagtatggcctcactgatttcatcgagcctgccctgcgggctggccagaacggccagcagaccggtgatcccttcagccgactcactgatgtctgttacgttggcaaacgggttgaaacgcagtgtttctccgtcaaggtaggaaccaccggcctgtctgcagaagtttttgtaactgccgcccatatcgatgacgtagccgaaaccgcctgaattgagcacctcgcgcagcacattctgaataaggaaactttttcctgccccagacgtgccggtgaccgcccagttatagttgctcgcctcactctcatcgtcatacatgtccagaaacgtcagctgattccggtaagtgaccaacggaatccctttacgggacatcttgcgctcggcaacgacaggcatcaggttgacggcattgaaacttttacagcgcagcgtggcgcccatgtgcttcatgtcatcccacagcccttcctgcatcaggaaaggcaacgtggtgagccagttgcgcagctgctgatagcggggagcggaaatttcgagatcgtttttgcggaacacgttgactgcagcatcttcacaccgctgctgctctcccgcgtcgtccggggtgaacagcgtcaggttcagactgaaatcacacatggctatttcattgttaaccagcccctgtcgcagttcacgccattcctgataggcacgttccgtaccggggaaaagtttggcgtaagaggtggccgcttttttgccgaggtcctgctccttatggaaagcgtcattctggctttttacctgatcctccacacaaatcgtccagctcagaataaacggacagggaataccgaggtcggggaaacgcatgttctgaagattgtctgaggcctgccacagcgcaaaccgcgccggtgctttcgtcagctgcatactgacaatacgggtgctggccacggcgtcatcatcgccctcactcagttttctgtcctcgggctgacgtgctgtcgtcatacgaaggtaacccggatggacttcaagctcagtactgtggtccacgctctgacggtgcaactcctgctcggtgttccagtgtgagtcactggccgtcacctgtccggggcgatagttcagctgttcacgcatgacggacaggaattcttccggacccaccggcttcgactccatatgggcagcctgcagtgaaatacggagggtttcacgcagctgagtgaccgcatccatcgcctgaatcccgcctctgcccgcctggccgtaaaccagaaaaacgcggtagttacgcagatacaggggatagccacgcctgttactcagtccacacagtgacgcgcgctcccagaacgctttcgttatgttattcagacggggggccatgctgcctttccacatgtccctgctcagcccctcatcaagcatgtcgcccacacatttactggccaccatcagcacggtgacgggtgtcttgcgcggcagctttttgcgaagcaggtcatccagcccctgaaccacttccttgtttgccccggccagcggggagacttccatgatgaaacccagagaacggctgttgatgtacaactcggttttgtcatcatacatccgccaggggagcaggctggtcagtgagggataactgaaattctgacgcagcatgctttccgcgattttcgcgctgccttcatgcttgctgccggttaacagacctgaaagctgattaaggagggattcaatcatggttactccccttcactgataacgcgatagtcatcattccagcgggattttttcttcacaaactccacgaccgcgggctgatgaaaactgtcctgctcatccacccagggcgcgatccacagacgctgtgttgcgtcagggatgcgtcgggcatctacctgaccggggccgttactgtctgcggttgttacggtgccggcaggcagcgacgatgcccgcacgggaaccgttgacgctcttattgtgcctggcgtcactgcctgacctgataccggacgaggggcaagcgttgcgacgctgactgtgcgttgagggtttatggcgggcttcacattgccgggcgtcgccagcgcctcagcggcagcctttggggccgcgtccttttgcgcggtcaggtcatccagacttttacctttgtcagccagatgactggcttcggacatcgtcaggcactggtcagtcgcggttttgttgcagtcgaaatcagtgttcataccggcgcagccggtgagcgcagcgcacagcagtgcgcacgcaaacagtttttgcatggtgaagtcctctggtgcggcagcgccgcggataagggtgtgaatgtaaaaagtggcggtgagaatgacctgtcggattaaacggttttcacccaacggggctaactggcttccttctccctgataagggtcttaagcctggacgaggtctgggggccgctgctgctgagcagcgactgcggggcctggggcgttaccgcgcccggccacacgctacacagacagatgaacgacacaacccggcagaagcactgacgcgttcatgaaaaaacgcctgagtaaaacatgcctggttcttcagtggttttccttgtccgtgcgttcataacaaatatcattaacacaccagtatttaccgatatcccgaccgtccgttgtgagagtggttatcggctccatcactgctgtgccaggatcggcattcacacaaccgctgactgtcaccacgtaaccgctggtcatcaccagcacagaaacatcgtcatcgtggcgaaagaagccgtggcagttgtttttcaccatcgccagtgagccaatctgttgcagtttattttcacttttggcatggatcatcatcggcaacccataaagcacgcccaacgacagtaacccgcaaaaccccgcgaataagagaagtgagagcaggatttcaatgttcttcgatgatcggttatttgacaccttacgggtcgtcatattctgtcactccttgccgcgtcatacgccgcttagttattaacttcagaaattcgctggccattcgctgttcctctttcatgaccgctgctgtctgctgaaggcagggggtctggctcaatacaggggctgttcagtgactggttaacagattcaatggccgtcagcagcgcagccagggttttactgtcggcctgtgacagccatgctttacgataccggatgcggagcgagcagagccgtatccgcgcttcacgggtgtcggttgtcgtcatgatggcggtcctctgtttcatagcccattttgcgtgacgtgaaagcgaactcccgtcggttcaaagcctgttgtttgtaccgaattgcacattcctccgcttttacccattcatccagcgcctttgggtcaagatggccatccgttaaaacactttgctgtagtctggcaaaagcgtccggatcagtgggaaggtacgaaaccagttcatctgcaataaggtcagcccagttatgcggtttatttctccaccgaatccataacacacccgataaaacgaccgatgccagacctgccgtcaggagtacggggcggatttgttccgaaaaaaaatcatccagattgattaacacgataaaggcagtcacagcccacacagcaagggtctcaacatgaagtgggtgtctttccagccatccgacattcatccaacggatacgattaaactgttttcgctgcctgttaaaattatcctcagtctggctcaggttcagattcactttcccctccactcaattgagaaacggtaagcagccgctggtctacccagccctctgccctgcaggttgccacggcagaaaacgtgttttccggcgtccagttcagcaccgccgcgttgttttccggcacgctctttacatcgtcgagttcacaggaaggcaaaaccgctttcccgtgacgaaacgccgtcacgatgatttttaccggctggccactgacaatgtgtgcaggaacggcccactgaaaactgacgtcagactctccggacacgggggctggctgctcactgcccccgccgctgtctgcctcacgaagccggctgtttatccattcgcgatcgctggaagacaaatcgtgctgactgagtaaccagaccagcgcagccgtacccatccagccgggaccactggcttctttctccctgatgatggtctgaagccggggtgagggctgaggcccgttgttgttcagcagtgactgccgggcagtaggtgaaggccggtatcccgaagacgcgccgttaaccctgcccgctggactgccgtttcctccggcagatgtcgcgctgctgcccgattccggcctgaagcttttataggcgggcgcgctgcctgttgaggagggccggtaggacggactgcgggcggcaaagcctgatgaagatttaaaagatgatcgggaagagaagccgcccgccattacgggcagcgtctgcagaaggcaaagcgcgacaagcgcacccctgacgagaatgttcatttcgcctcccagtttgcccgcccgttcacggtgataatgcttcggtcttttgcaagggtctgaatgcgcagaatctctctcgggctcagcgtagcgggggcctcggcagtttccagtttgttgtaacagtcgccaatacagcgcaaccgccacagcagcgcgctggcctcatcgtgctgctcgttgtaaagacggctgagactggcgggtgcccttgtgtcgcctgcaagccaggcctgagcaaaaaaggcagcggcacggacgctgtctttctgcatccactgcccccgttccagtacgtgggcagcagtggccagaagacgcgctgacgacctgtcacccgccgaatgcgtggcaagatttatcagttcttcagcgagttggggcatccgggattgcagctcctccggcgggtcatcccgcataaacaggtcaatgaaggcagcgggagagcgccggtttaacgctgtgcggtaaagtgaaagtgcgagctcctgatacgcagtatgcacttcctctgagcatgtcgctctgaacactccgggatggcagtttttttccgcgtccttgttcagctgctgataggcctgaaacgcatcaggattctgcagtgcttttgtccggtcttcatcaaactgcctgtcaccatagtcacagccggccagcagcatcacagtcagcagcgcgagtgtcgccagaaacacggcccgcttttttttgattacgttcatgtcctgtactcgttgcagcttttgtgacggaacctgacgccttccttacgcagtttccgcaaatccagctcaacgatgcggcccatcagggtaacaagcatgaccgcccgctttgtgccgtttggctcatgccagacggcttcaaaaccctcaaaaacgccgctttccagaatgaccgtgtcgccgtgagccgggggtttttcctttgtttccacaacctcgcccgtcatttctttaagcgcgtccatctgactgtcactcatgacggccagacgctccccgaaccggacaatctgcgagacgccgcgcgttgccttaatggttgtggtgtggatttcctccggatcgaagcgcgcaaaaccgtagccaggaaacagcggcgttggcttaagggaggttacttttccctcagccagtcgtctgccggtgtaaagaggaaaccagcactccacttcctgattaaccagatgcgcttcagcccgtttttcctgggcaaagagagttttcagtacgtaccactgtttcatcgcgagtcctttcagttgatggtgtcgccgagccgcagctggctggcctgcctgagcacttcatccgggttcagaacggttgaatcagaacccccttttgagcttttagccgcagtggtggccgccgtctgctggaccggattagccggagactctttcttctctttctcagcgtcttcctgttcgatcgttttcagccggaagccctgctggaagaccacggtgaccgcgttacccgccccgatatcgataaccgggtgatactgctctgcacgcttgatgtaatactgactgagcgtatcggccgctttgctggcaccgccgccgaggccctgtttgaaaatgtcaccggcaccaatcgttgtcgcaccgcccagtccgaccataggggtggcggcagacttgaagccgtcgcccaggccagacaggaagcccgccccgcccgcattcatcagaatttgtccgttacgcatcaccggttttccccgaatgccgaccttaccctggtaggacacgtgcccttcaaaaggcatatcgatgtgatcgccgtttttcaggatacagctgatgtttttggtccggacgtcaccgcgctcgctggagatatcaccgtagatttcgccggtcacgcggcacttgtccatgttgtaggtgcgtccgttcggcatggaaacgtcgccgagcagcgtaatgaccacgggcgaggtgttctgctgaccggtcacgctggcgttggcgtcagccccctcaatcatggttgcctcggagaacgaacccgacggaatccacggaagggtgtactttggcttctgtagcgcggcataggtgaacgtgtcacgcttcagtcctccggggcggacggttccgctgccgggataaaagccctgtcgttcctttgagggatagaactgaccaccctgaccggatgccggcccgttggccggatcggtcacctgccactgcgcagggcctgcgggcccttttgacagcgggccgtttgcgggcatcccggcactgctttgtgtgcctgtgccgctgccggctgaaggcggtttgtccgcctgattctggagcttttcgagcgcaccgctaatctgctccagctttcgggtcagggcttcattctgcgaactgacctccgtggacagtgaggacaggcccttttccagcgtggccgttttgttctgctgctgtgtcaggacggagttggtcacggtttcggtaaagtcggaggtgaccagtccgtgtccggtcaggtccaccttcaccggcgcaggttttttctgctcctcctgatgatgtctgtaccaccagacgcccgtgccgatggccgtagcgacggccaccgtaatccccgttatcacccactgacggcggcgggttgccgtgttgatgttgctcattacgaaccctccgcgtcagtggagaaaatcacccagacgtagccctgcccaccggcgtacagcgtacgcgtggacagcatcacggcgcgtatccctttctgccagaactgcctttcgctcagctcgcgcgtcacatagccggtgttgctcatgcgatagcgcatgacgcgcagatgggaaccggcaagctgacgctcgggcgtcagcgtcacgccggcggcgggcgtgtaaaccggtccccgatcggcgctgagctcggtataggtatccggtacgccaccgttcacgacggtacgggcgacgctgacaagcgtcttctcccacggctgactttcttcccaggcttttgcgtcaggattggctttgatttttgtcacggcagggatgaggcgcagcgtgcgcccgttccccggacggggtgacacatccagtgaggcgctgatgccgctcgccgtttccaggaaaatggtgaagtcctggccggtcgtgggcgtaatcagcagcgcgccgtctgcggtagtgtcgcggttgtaggcattctcagggccggtcacgcccgtgatgagttcgccgtcaatgatgactttattaggactggtgttgctcatctgcgccttcaggtgggcattgttttcaaacaccgttcccgtggggccgctgacggctgccatagcgctgctggtcaggcaggctccggcaacgagtagcgcggtaaaggtcagtttcatgattttttccctgagtcgtcagcgtcaaaggcggctggccacttcacttcggagaagtctgtcaggcggataagaccgtcaacgtagtgaagattaaagcggtaggcctttctggcatccggaaggtcaatcctgtccttgccactggcggctctgacgcggtgtgcatcaggcgtgacgaggtcaagactgccgttggtggtgctggcatgaagcgtgccgccgacagtaatttcaccggtggtggtgtcggtgaattcatgttcgatgctgaacacgctggcaatgccgtttttcttgatgtagtcggtctcaaccgcaagggttttcttcatttcggagcgctgctccgggggaacccagctgagtaaacgcgcgtactggctgtctaccgtttctggcgtcacgttcaggcggaggctggcgagagagcgaaccagcatgctgttcaggttcgcatcgcctccggtggccgttgagctgaatgcacggtcaaacatcatcggaacggtgatggttttctgtgtgctgtaaaaatgccacgcaagaccgccggtaatacagttgccggcgacgctgagcgccagaaggccacccagtccacccagcagtgccaccgtcagtctgtttcgcgtctcttttacacgaagtttcattatccctcccgcgcggggaaaaggtgccgccccgaagggcggcagggtcattactgcatccagtgccggttggctgaatcaggcacgcgccggaactgcacccgaaacagcatggtcggcagataccagtacaagaggttcagaagccaccaggagccctgccctttcttgaggtgccggatcaaaagccagagcaccgccccgacaacgagcatcacgatgaacatgtcgatgtaaaagccgagcagaccacaaccgaggaggataaaagcctcttcaggcggcagcccgagccatcgtttctgctggttcagtgtttccgggaagcggtatttggatgattcccgctcgtccacgattcagttcgcaatcagtgggtagagcgtacgggtggcaataatcaggagaacgaggccgccgaggaccatcgggttacgggttttgatgtaaagccacagacaggaaaggaactcaacgatatacaaaatccactcaaccgtaccgccgtggccgaatgtgtcgttgatatcggttttctgccccttcagcaggtcttccgcaaatgaaatctgagggaatgcagaaagcaaaagcatgaccccggacaaaatgagaagacgctgcataaacgggctggatttgacgagcaggaaaaacgcggaggacctcagtttaaagcgggcggagagctggccgataacactgcgttcaggtggtctgacaccgtccggtaatgctaccgccaccgcccctttttcaaggggggttaaatcatctggcttcattgtaattaatccttgatttgagttaaggaaatgtcattgcgcgtaaacggatgtaacgctgcgtaagtgtacattttctcaaaaaaaaaaatctgtgacacatgtcacgcttttacatgaatgttcagtaaattttaagattaatcctgaatgccgctggcgtaggcttgggccctgacaagggaatacctcgcaaggaggaccagcagcatgaaagtgaaagaaaaaatgggcgacggcagaggaaggccgaggaagtatgctcagggtgaaatgcagtaccggaaactgtggctccctgaaaatcttctgaccgagctgcgcgtagcggcaagggttcgcggatatacaacaaacgatgaaatcatcagcagattaattacctccctgcagttttctccccgaaggccggtaattaaaacgggcgaaggtcagaggctggtcgcactggccaggttgtttgatgaatttattcagagcaggctggaagttattcggcagcaatatgcagcagagttaaagaaccaggaggataaaaaagtatttgtacccggccagaagcgcgcattcagcagcagtttcccggttaatctgagaagagatattgatatcagcgcccggtttaataagcagagcatgaacgaggaaattatgcagcgcctgctgggctcactgaattacctgactgagcaccagttacctgaaaatgaagaggttcacaggctgagggaactggccgtattgtttgacgagtttattactgaaaaagtcagccgggctgagaacccgctttcatcaaattagacttgtattttattcacgccggttcatcctgacagtaacgattaaataccttttcagcacactgatatcctgagtgcatggcgcggtaatgtctgttattcaggaagggcgaaacgttactgacgttttgactcagtaagggtttatcactgaaaaaaacatcttaagacttaacacagcggagattaagggcgaaacgaaacaggacataagttcctgacgaattcgcccttaaattatttcagacacattccctgactcaccgtctgaattcacattcacaacttatgccttacattgcctcctgaataaaaccgccttcacaagaaccgccacaagcagacagtgataaagcaacatctgaggcaacactgagtagattgccgtgaagaaccagcatagcttaacaggatggaccttaattaaatgcttcagaactatctggagggtaagccggataacggatgcagggataaggaattcaaaaaaaactgagccggggattaacccgactcatacaacagatgaaatcagtctttctggataaagtgcttgctctcagcgtcatattccgcctgactgattgctgaaagattttgattcagcaactcgcccagcctgtcgtcagagttttcaccgcgcatatgcagatacatttccgtcatcatggccgtcataatgctgataccttcacgcacaccagccactttccggattaagtcacggttaaaaccttcttcatcaaaagttttcccctcaccctgatgttttttgataatcagaccaatcccgaccagttcattaaccattgaggaaaagttaatttctccgtgcgtggcgccgttctgaatctcaatctcaacgagttcctgaacatccctttccgttttttctttaaagtaaatatttcttctggccatgtctcactcctgaatgccgttgatataaatacgggcaaagcgttagcttaatgcggatttaagttttgctgttcctgaccacgaaagcggtgtaaaacagatgtgggtttcttttttattattcggctgtttttaactgtgtgtcaatcaggcactgtaattttatttttgagctgattttcatgataaaagacacctccgtgcggaaagccattttacagaaaaacgggcgtttttagccgtttttcagtgtgttaatccggcactgtggccataaaacagcgtaaagaaagccctttaagtgcccgttccaggtgtgttaatccggcactacagggctattttgtgtgtcttaatccggcaccatcgcagaataaaactcacttaagttaatgattaaattatataaccacaattaacacacacgacagtgccggtagcagtgcctttttgacacacaatccggcactgcatcaacacacaatccggcaccttaaaaacacacaatcaggcactgcgttaacacacaatccggcactgacatatcatctaatccagcactgcaaggtgtgttaattaacacacaatttagttttaacctcaaaaaaaacataatatttgaaacctaactccttgttttaatgaaacaaaaccgcaagatgaaatcttgcgtggggtgtgatgaaagagaaactataaaagcggcttgttgaatatgtgtcttaagtggaatttaattaacctctgccaggcactgacaacaaacatcaagcgcagagtgcgcgcctgtaacgaattatcttgcacaggatgatctgagaaggtattttttgatcagacacagcacggcgcattttgcgcacgcacatgagattccataaatatgaagtggttacccgccgccgtcctttttatcgcattcaccgttcaggctgagccagaaatgtgtttcacgaaagccgggcatgatttcggaatcgatccgcgtttactcatggcacactccattcaggagtcgcgcatgcgtaataacgcaataaacaacaaaagcgcacgaaaaagcactgacgtatgcaatatgcaaatcaacagttcaaacttcaacgcgttaaagaaattcaatattacgcgggaacgtttactggctgatccgtgtatttgcatttataccggcgcatggatcgaggcgagcaatttcaaaaagtatggcaggacgtgggacacggtcggtatgtataacaccggaccgaatccgaagttaattaaacagcgcagagagtatgccgcgataattaaaagcatctaccgcgttctggttgcaagggatgaagtttatgcgtaaatgaataaaaccggacctcttgaaaaatcgccttctataacgctgagccggaatgatcccggcacccccaaaaagtaaaccccggcgaaccggggtttactttttttcagcttttcagcttcgcgaattcttccgccatcttccacagcgcctgatttaattttatgtcgccgtcgatgccgttaacagggcgcgtggtggtgcgcttccctttttcagttcgccccgacaggccaccttttacaagattctcctgaacgatattaaaggccgtccacaggtcggtgcctttgtcatgccagcggcgggggtgaataatattttcggcggtcaccgggggtgccttgtcttcatatttgtactccagcgccagctggcccagcagcagcctttctgccttatccagctcaatccccttcatcatgccgatattattttcgactttttcaaacacatccagaaccgaaaacgcgccttcgatcacctggctgacaatatcgcctttgtgcggcacgctgatttcgccaaatgttttccagcagaccagcccgttggtgcagacttcgcggaaaataccggggatcattttataactgctggaaccgtcatgactgttcagcagaacaatttcaggcacctccttgccgctgccgttatttccgcgacgcaggcggatcatgtgtttggtaaaatcccggcgatcctgatcgcgcacgcgggactgttttgcatagaaaggttcgaacccttccgagcggagtttgtcgagcagggtaattgtcggaatataagtataacggtctgaacgcgactcatgtttttcaacagaaaacgcactcggtacgtaccgcataagctcatcattggtgagcgggcgattttcgcgaatggatgtttttggagcataacggcttgcaaaactgaccatagtgattacctctcagatacgttgttattacgccggggttgtcccggcatcggatgtttgtcgctcagcgcggcgctgaggaatgcttaccggcgttttccagtgaccaggcgatcatttttcgggtctgcgcgtaattgatggccgtgtagcccaggtcgaattcataaagggcgtatggccagccctcccagacataaattttgcgtggctcaccgtcttctgacgggtcggtgatttctttaaacagcgccagctcctgccaggtcaccccgcccggcccgcagaaggtgccgttgtcgatgatgaaatcgctgagatcctgaaactgatccgctgtcagtccggtgttgacttttgtcccttcaacccgtgtttcggtagattcagaagcggcggtcttgacgttgcgtgtgttcatgctggttctcctctgtcggttgctgttaaccatgtttcggtgagttcatcgcggcgaagggcaaagtggcaccggctggcgaccggaacggaggcgtcaccggaagccgcagcgcaagcgagccgggtttatggcgagtgcgaacgggtgaggaacggcgaagcgtaccggagtgggagggcgacggactgtgctactgtcagccctccgcgctgaaccaccggaacagaacagccgcacggggataaagtgagcatgaacacctccggcacgacggaacggcgtgacggccttacagggcgcggacgcgcccggtgaacgcaccggcgccagccggttgcagccgttgacctcagccatcagaccttagccgggaggcccgaaacgcggccctttgcggttcggcggagacgggcggcagctatatcgccgcctgtcggagttgggctgacgactgcccgccagggcaggagccgaagggggccatgtcccggcagtggcttatgaaaaggcgaaaagggttcatcaggcagcggaagctggccataaactcacccggccatacccgttctggcatgaatactggccagaatggtcacattacttagcagagtggtgaagctgccccgcagagtcacagcacgcggagggagggagccggtgcgtcagcaccgggttttgcccggcccggagggcctgcagggtttgcgccctgcaccgcacggtatcagcctgcggcttcatcccgaaaatgctcaccggcgcggataagcagctcgcagaacggcagatctttagcgctgcacaggtgcataagatttgccagcagatcggtaatggccgtttctgccaggtcatttttactgtccagccccgtgcagcgggcgaaggtgacgactgccgccgcagcgctacaggtcacgtcggttatttcccacggtatcggatgcagcgcgtaatctgccaggtcatcgaggtcggctattttcagtgattccggagacgcaactacagtgggcgttaccacagcggatggggtgtttttcagcatagggaacttctcctgagtgggtgacagcagggccggaaacaaccggccctgtcccgtcagatacgcactttgcggttatagatggcacgccagtcgttgtaatcgctgccttttcgcagcggctccagactgcaaaggttctcggccagcccgttcataaccagaacgcgctcaaccgctttaaaccacgactcatcctctgccaccggaaaccacatattcgcattgtggccactcagcagcggatgaccacagaaatgcacccccctgccccgcttcgtttcgcaacccgttacagttaccgtggctctcacctcctcagaaggcgtgcagcgggcgagctgctcgacaatatcattccagcaccattcatcgtcttccggtacggccagatcgatgcagttgagcgactggcattccgcgcgggccgacagcctggcgatttccttcagggtcggatcatcattcgccccttccgtgctgtgaataaactggccgtggatgtaaaacgcttcgtccccgttgtccagggtaatgacgcagtactggcccagcgcgcgggcaatgtcgtcctcggtgacggttgtaaggtcggcattttctgcctgattctgctggctcatgctctggctcccgtcattgtgttaacggtcgtaatgaactgctgccagagataaaacggcatcgcaggcacatgagcatgctggccgctgcgcagtgcgtttacaaacagcgccgcctgtgcgacgattttcgggtcaaaattcatgttcgtctcctcgactcggattttgatggggc

SEQ ID NO: 16 - DNA, 253747 bp, Pantoea sp. OXWO6B1
gccctcacgcttcacggcttcctgtacgccaggcatgagcatgcgcgccatcagcgactgtacggagtacggcgtaaaatactgcccctgtctgccgtcgcccagctccagctccatgaaaatggcccccagaaagtcatgaaacttcgcttccagggcgctcaccatcaggccgaaaagccggtgaaggtcgctgatgccctccggcctgtagcgctcgcagattttgcggcagcgcgccatgctttccggtgcgcggatcgtggcaaggtcgagttcactcgccgccagcttgataaagtcgctgaacacgtcccagcggcgcaggtgccgggccgtgtgcctgaacacgctcacgaactggttacataagggagttagctcttcctgagtccttcatagagaaacgcaggctcatgtctcttatctaacaaagtatcaatcctatacgctaacttcatataaagggacttatatgaagttagtggcttggctaagccattccgaaatcccgccagactgctcttcctgcgtttcgccgctctactactaaaagcaaaaaccgggcatttcccaccacgctttagacgtgacgaaaacacccggctcttcattcagaaacactccctgcccgcccttcttaactctccattcgaggcttacgaggcttactccttcaccaccgcctcagtctttatctccggctgtgcgcttgccattttgctacggctcaaaaatgcattaagcaaaatcgcgccaaaagttgcggtgccgataccgcccatgctgaagccgccgagcgtcagggtaaaattacccgcgccaagtaccagcgtgaccgccaccataataagattgccgttcagccccagatcgacgtggttttgtacccagatgcgggcgcccgccacggcgattaatccgaacaccacaatcgacgcgccgccaagcaccgggccgggaatagtgtggatcagtgcgccaaatttgggtgagaagcccaggacaatggcgattatcgctgcggtgacaaaaatcagcgtggagtaaatttttgtaacggccattacgccgatgttttcagcgtaagtcgtcacgccggtgccgcccgctgaagccgaaagtaaggtcgccaggccgtcaccgataaacgcgcggcccatataaggatcaaggtttttacccgtcattcccgccacggcttttatatggccaaggttttccgctacaaggattaccgccaccggggcaatcatcagcatcgcgtgagtgctgaagaccggtgtggtaatagtgggtacgccaaaccagggtgcctgggctactgcgctgaaattcaccggtgtacccagcccaaggccgttggtaatcgccatataaatcaggtacgccgccaccagacccagcaacagcaacagccgctgcaccagaccacgggtaaataccgccaccgagccgatacacagcacggtcatcaccgccatccaactgtcaaacgatgaagccgatacgctgttaatcgcaatgggcgcgaggttcagaccaatcgccatcaccaccgccccggtgaccactggtggcatcaggcgttcaatccagcgcgtgccgaccgccatgactacaaaaccgatcagcgtataaatcaggccacaggcaataatgccgcccagcgctacgccgatatttggattcgcgccgtgaccgctgtagccggttaccgcaatcaccagcccgacaaacgccgcactggaaccgaggtaactgggtacgcgcccgccaaccaccagaaaaaacagtagcgtgccgatgcccgacatcaggatcgccatattggcgtcaaaccccatcagcaatggcattaatacggtggcaccaaacatcgccaccgtatgttgcagccccatgatcaccgttgcgcccaacggcagccgttcatccggcgcgatcaccgcaccatccagattgccttctcttttacgccattgcggaaaccaggtatttgccatgcacgacccttactgtgttgagggaggactgagttaacaggctgtctgacgcatcagcggatgatagcgtcgatcgaaatacgccagtccgtggcagtcatcgttgcgttggagtgcaacgacttcacaaaacaaaatatcgtgggtgccgacgcgggtgatctgcgtaatggtgcagtcaaacgacaccagcgcattggtgaggatcggtgaaccggtggcaagacctgtccattcggcggcggcaaagcgctgctccatcggcgttttccccccaaataaaccggacagcgactcatgacaatcggccagtgtgtttacacataacacctgattttgggtaaacgcctgatgcaccgacgcagagcgattcaggcagaccagcaatgtcggcggcgcatcggttacgctgcacacggcggaggcagtgaaccctgcccgtccgccagggccatcggtggtgatgatattgacagcggaaccgaggcacgccatcgcatcacggtattcctgtttttctacagccgcctgttttgcaacttcaggcgcatcaatggagggcagtgtggcgttcagggttgattgcatggtccggtcctcagaattaatcaatgatgcttacaacacgcggcaggcgcggtcgaaatcaaggcgcggcgcgcgtggatacagtttgctgctgtcgccgtaaccgatgttgatcagaaaattggatttccagccttcctgcgccagaaacgtttcatcgactttagcgttgtcgaaaccggacatcggtccggtatccagaccgatcgcgcggcaggccataatcagatacgcagcctgcaaactgctgttgcgaaacgcggtatcctgtgccagctgcgggctggaggtgaaccatgaacgggcatcaccagaaggaaacagctcaggcaataacgcatagaattccgggtcccaggcaataatcgctgtcaccggggcgctcagggttttcttcagattgccgctggaaagtgccggtgccagtttttctttggcttcctgactctgaataaacacgatacgagccgggctgcagttcgccgacgtcggccccatgcgcgccagtgcgtaaatcgttttcagctgttcgcctgtcaccggtttatccagccagccgttatgggtgcgggcttcagtgaataaggtagccagtgcgctggcggttaatgcgtcggtcatgatgtctccgtggaaatgtaaccggacggcgtaacggacgcttgcgatgagtgccgtagtaaccaatccagtaaaatcgggttaaacgtatcggggtcggtcacgctcattgcatgaccgccgtacaacatgtgtcggtgctcgccatgaggaagacgtgaagcaagatcgaccgaacacgaccacggcaccagcaaatcgtctttacaactgaaagccagcgtcggcgcgatcacctctttaagcgacgccgtcagatcagacgccattagtgcctgcaggcggtgcagcaggttttccattccctgaaaatgcgcgacctggtgcgtgtgctcttcctgcaataacgcctcatggccagacagccagtcgcccggatacaggaacagcggctgcgcctggacgtaggcatcgacaccgctgttaagcagcaaattctgccggacttgaaagcagcgacgcgtttgactgttaagcgtcgtccagccgttaatcaccactagactttgcaacagcatcggataacgcagtgcaagatgcaggccaataatgccgcctaaagcatgaccgaccagatggcagcggctgatctccagcacattgagcatactcgccagctcgtcggccatgtcctccatccggtaaccggcaggcacggtgccctgactgtgcccggtgccgtgctggtcatagaccaccacccggaaatgctccgcgagcatcgccaactgcggctgccagaaactgccagaaccccccagcccggatgagagcaccacggtttctgcatcggcatttttcctacccagtaccttgtaatacatgctgtttcctcttcaggaggatggggacactcggacggatcaccgaccaatatgcgcaatggacgcgatttcgatcagtgcatcgggtttcaccaggccgcactgaatacagaaccgggccggtttttcgcccggaaagtattcggcgtacacctgattcaccgcgctgtaatttgcccagtcggtgataaaaatcgagttcatggtgacgtcatccatgctgccgcctgcggtttcaatcacgcttttgatgatctccagcacgtgacgggtttgcgcggcggcatcaccgacatgcacgacgttattgtctttatcaaaaggcaatgtacccgaaacgtacaccacgccatcggcgagagtacctggaacgaaaggcgccagcggaacaccgctgccagccggaataatggcgcttttaggcatcgttaatcgtcctttttataaagcggtcaggccgcattttgttcagttttgtaacctagcgcgtcgcaaaagttacccacgctggagacccagccaaagaacgtttcgatgttataaatggcggctttctgcgcaaattccgggccggcctgatgtgtcgcgtcttccagcacaacaccgaaatattccaggaagaagccgtcacgcagggtcgattcgacgcatacgttggtcgcaatgccggtaaataccagatgatgaatgccgtaactgcgcagcagactgtcgagctgcgtattaaagaaaccgctgtagcgcggtttgggcaatacaatatcgcccggctgcggctgcagttcatcgaccaggtcataatcccagtcgcctttcgccagcagtttacccatcagttccgggcgtttgcgcatcgttttcagcgcattggatttatggtagttcggtgaaccggcaccaccggcttcgacgtactgattgtcccagccgttctggaagaaaatcactttgatgcccgcagcgcgtgcagcggctatcgccactttgatattggcaatcactggcgcagtggcagagacatcaaagcccgccagatcaagataaccgccttgagtcgcgtaggcattttgcatatccaccacaatcagcgccgtttgttgcggcgtgaaggcaatggcttcaggacgggctgtgaggatcgtttcctcgccggtattttggggcgcgcggcggaccactgtctgattctcaacaacgttcatcatgcgacctctttctgctcaatgccgatgtgctggcgggttttcattaatggctggatgtaacgaccaaagttttcgataccgttgacgaaatcgtcgaaggtcagcagcacgccgcctgcgccgggaactgtatcgatttcatcgagcattctggcgacgctggcgtaagaaccgaccagcgtgcccatgttgatattgaccgcggaagtcggatcggccatctggcggacgttggtatccgcaccggatttggtgtctttactgctctgatcggtgagccaggagagcgcctcggcatcggctccggctttgtacaattcccatttggcgcgggcggcatcgtcggtttcgtcggcaatcaccatgaacaaaacgtaagaggagacgtcgcggttttcggcttctgccgccgttttcatgcgcgcggcggtcggcgcaaaagcggtgggtgtgttgacgcctttgccgaaacagaagttgaagtcggcgtgtttggcggagaacgccatgcctgcgtcgctttgcccggcgcagatgactttcatttggctttgcggacgcgggctgacgcggcagtcgtccattttgaagaattcaccgtcgagcgtgcagtggcccgtgccccacaagtcgcgcagcacgctgacatattcggtcaggtaatcatagcggcggctgaaatagtcatcgcctggccacatgcccatttgctcgtattccggtttctgccagccggtgacgacgttcacgccgaaccggccattagagatggaatcgatggtggcagccatacgtgcaacgattgccggtggcatcaccaacgtagcggcagtcgcgtaaagctgaatgcgggaggtcacggcagccagaccggccatcaacgtgaacgattccatgttgtgttcccagaattcagttttaccgccgaagccgcgcagtttgatcatcgaaagcgcaaaatcgaaatgatagtgctcggctttctgcacaatggttttgttcagttcgaaggtaggtttgtactgcggcgcagtttctgaaattagccaaccgttgttgccgatagggataaagacaccgattttcatagctcacctcgattgaaaataataaggaccacaacaagggcttgcgaaaatatctgcgcggcttaagtgcgtcctgcgggttcctgattgcaccgtgctgaaatctcctgacgagagaacaactgcaaagtggatgccatgtttttaaaagtgtttattttcattaggttaaagcggggtttgatttttttatggagcagttggtctgtttcagaccatttgttcaaaaataactgcacataaatcaggcaggattgagcgcaaatggtgcaaatttattaaatagtcggttaagcgggatcttatttcgccgctttcataaatggcgtgcatgacgatagtcgcccctatccctatttgttatgctttccaccttgatatttatgtcatggagacgttgtgaagccattggtaaaaagcccggaatctgccgccggtgaaagcaagtcccctcaggcagcgtcgaaatcattgacgcgccgctcgcgggcggtcgccgccaaacgtagcgctatcatggcggctgcactggaatttttttcgttgtatggcttccacggcacccgactggagcaggttgcggaacgtgctgacgtctcaaaaaccaatctgttttattactttccctcgaaagaagatttatatattgcggtgctgaaagggctgctggatatctggttagcaccgcttaaagcattgcagtccgatcagcatccactggaagccatacgcgaatatatccgtctgaaactgtgcgtatcccgcgaccatcctcaggcgtcgagattgttttgtctggagatggtgcagggcgcgccactgctaaaacaggaactgggtggcagcctgaaaacgctggtggaagataaatcggatgttattcgcggctggattaaagacgagctgatcgcacaggtcgatccgatgcagctgatttttatgctgtgggcaactacgcagcattacgcagattttggcgtgcaggttgaggcgatcaccggtaaaacgctcagcgatccggtgttttttgaacaaacggtgaagagtgttcaggacatcattatcaaaggcattcagcttcgggcttaaaaggaccatgcagcaaagcagaacggtctggtggtaaatgaacgtgggaatgcacacaacacaagttcaccgatcccccggtcatatgttcatttactctcccggccccgcagctgccagaaagacgcagcactgacaacgcgtaataactatttttacgtaatcaggactgctttttctgacgtttacgcattcatcatattcgacacgccggagtccctcagaacccgacgcaagaaatcctgggtgcgtgcttcctgaggacgcagcaagacctgttcggcttgcccctgttccacaatttgcccgctatgcaggaaacaaacgcgatccgcgacctctcgtgcaaattgcatctcgtgtgtgacaacgatcattgtcatgccttgttgtgccagattacgcataacctgcaacacttcaccgaccagttcggggtccagggcggaggtgggttcgtcaaaaagaatcgctttgggctgtagcgccagtgttcgggcaatggccacacgctgctgctgaccacctgaaagttgcgcaggccacgcggaaaccttgtctgccagccctactctttccagcaattctctcgcgcgtttttctgcggcattgcgtgattcgccattaacgtaaatcgggccttccattacgttctcaagcacattgcgatggggaaagagattaaagcgctgaaaaaccatacctatctggcgtcgaagcaaattgatatttttgcttttattatcaacgtgctgaccgagaacgcgaatttgaccgttttcatacgtctcaagcccgtttatacagcgcagcaccgtggacttcccggagcctgaaggtccaaccagacagaccacttcgccctcttcgacgcgaaaactgacccctttaagcacttctactgagccaaagcgcttatgaacatcaataatttcaatcatctcaggctcctcttttctggcgattttcaaggtgtttggtaaaggccagcaatggcatacataacgtcaggtaaagtaacgccaccagggtatataccgttgtgttatcaaaggtcgaggcagcaagaagctgtccctggcgtgtcatttcggttaccgcgatcgttgaagcaagagccgaatctttaagcatcatcaccaaggtgttgctgtaaggcggcagtgcaacatgaaaggcctgaggcaatatgacccgtcgcatcgctttactaaaactcattcccatggagcgtgcagcttccagttgaccgcggtccacggattcaatgccagaacgaaagatctctgcgaggaaggtagaaaaacagaaagcaataccgatcacgctggcctgaaaagaggtaagggtgataccaatgtcgggaaaaacgaaatagatgtaaaacagcaccacaatcatgggcaacgcacgggtgatgttaatgatgacagcgacaggccatgaaatgattttaaaagggcacatttttgcagcagcaaagatcaggccgagcggcgtactgataagtaacgacaacagtgtgatgtagattgtcatttcagcccctttcaagagaaaagggagatatacatgaatgctgctccagtccattatgcgctccagccggtgttaggtggcatgctaaaaattcattttaatgaatattcccccgctaaatactgtcaaacttttcatcttatggcgtcatagcattaacttatttgtacgacaatcttcatttaagatcgcttatagtcgcaaatcaaagggtttgatgctcatttgtgaggggttttttttttagaaaagaaatgattgacagcaggatacttaatttcattatattgaagttaatggtccccgttttaagcaggagtgcgtcatgtcgaaccgatcgtgcgtaagtgtggctttgttgtttgccgcattgggcttcacttgcagtgttaatgcggcgttgttgacggcgggctccccgccatccagtgcgccaacgacctttctggatacaaaaacgggaaaaatcgaaggattcatgcccgatgtcgccgccgaagtggccaggcgtcagcatctggagattaactttagcgccgtgcccttctccacccttatccagtctgttattgcaggcaaaattgacatgatcgtggcgggaatgacaccgacgccagagcgagaaaaacgcatctccttttctcagccggtgactgcatttgggcctggactcgtcgtgcgtgatgacaataaaaaaacctaccattcgcaacaagatcttaaggacgaaatcgtgggtactatgacaggcactgactacacgcaaagccttataaaaagcggcattgctaaagaagtcaaagtctacgatagcccttcagatatgatgcgcgatttgtcactgggtcgtatcgcggcaggcatgaatgattatcctattttgaaagttcaggaaaaaaccggatcttttaaaggtatgcacgttgtagatgattataaacccgagcatatttcgcccatggcgtttggtgtgaaaaaaggcaacgataagctgcttgccgatattaataacgcgctgacagcaatgaaagcagatgggtcactgcaaaaaattaaagctaaatggggaatgccctgatcgcgctttcacacagggacgcgacaaaccttaaggagcatggttatgaaaacagcggtaatgcacgcagaggagctgagtgcagcagaggctaacatcggtatacgtttaaaattaattcgtaagtctcgtaacatgacgatcaaagagctggcgcaacaggctaatgtgtcagcgggcgcaattagccagattgaacgtaatctggctaaccctacgatacgcgttctggagcaactccgagtggtcttagatgtgccactgacagccttccttgaacaagatgaggtaatgcggccgggcgcagagcattacgtacgacgcagacatgagcggccgcactttcatgttggcaaactggggataaccaaagagatgttatcgccctcaggcgaacacgatattcagtttatgtatatcagtattcctccgcgcacacgttcagaagagatgctgacaggcacgggtgaaaaagcaggtgtagtaatggaaggtaaactgacccttgaagtagagggggggaaaaccttaatcgaagcgggtgacagttttcagtttaaaagccatctcccgcataatattttcaacgatagcgacacagaagcccgtgtattgtggattatgcatattccgccgcgacatcatatctgaaacaaggttaacccatgcgaatcaaggtcgatagcgtccatgacagctccgtcttccccaccactgtcgatgttgttgtgataggcggtggcattgttggtacgtcaacggcctatgaactggcgaaacagggcgtttcagtggccctgtttgaaaaaggcgttattgccggtgaacagtctggccggaactggggctgggtgcgccagcagaatcgtgacttgtatgaactgcctatggcgatgcgcagcctacagcgctgggatgaactgagtgccgaaatcggaatggatcttggtttcaggcggagcggcattctctatggcacagtcaacgatgctgatctggcgcgttgggaaacatggggtcagcaagcgaagcaaatgggctttaccagtcatctcttatctgcgcaggaagctcaggcacgtattggcgataaaacggcctggcgaggcggcgtgtggtcacctaccgatggtcgcgcggaaccttcgcaggcagcaccggccatcgctcgcggtgcgcaaaatttgggtgccagcatatttcagcactgcgcggtgcgcgcactggacattagtgcgggccgggtctcaggtgtatggacagaacgcgggcgggtaaacgccagccgggttatctgttgtggtggagcatggagttcacgtttttgcagacaatatggcattgaactccctgcagcgaatattttgggcacggtgttcaaaacaaccgctgcgcctgaagtagtgaaaggatgtctgagcacacctaacctttgccttcgccgccgtgaggatggcagttataccgttgccgtgcccggtcttggacaaattgatttggcaccgcaaaacatccgttatgctgcaaagttctatccaatgtatcgcagtaaagtggctaaaaagctcaaggtccggcttaacagctcgttcttttcgggcccagaagcggctggaagctggcatcatgacagccgttcaccgtttgaaaaaatccgtgtccttgatcccaacccggataacagcatcattcgcaatggtcttgcggagttgacccgtttatttccagaattgaatgggataaaagttgattatgcctgggcgggctggattgacaccacacctgatttagtgcccgtcattgatgaggtaagtgcactaccagggatgtttatcgcttccggcttcagtggacatggcttcgccattggtcctggcgcagggcttttgtgcgcacagttgctgacgaataatcccgtttatacagacatcgcaccttatcgcctttcacgtttcgagaaaggtaatgcgattcgcgaaccgcaaatgatgtaattcagcggcggtgagtggcccattcgtgggttatctgagcggtctttttcaggcaatcagtgagtgtttcaatgattgccttgaagggaagataattcgcacggacccgcaaaatcaccttatcgccgtcgccctatccacttagcgagaaagacggcgtttgacgcttatcttcaccgccatgcctgaaaaaatgagccgtcatcttgtatcgctatgcatcgctcttttggtacatagaaaaaaaacggttgtcgatgctttcgcggaaaaacgcgtcctgatcgacggctgcacagaatccctgataggtatgggccggaacagcaagccagcgtcggcacgtaccgttgcggtactcaagttccagcaccccagacgtcggatcgaatcccgcactgcgaaataatgttgaagagttgatatcgtgtcgtttcataacggatagtccctatcggttgaacccagcgcctgcactactaagagcggcaatatatcacagtcaccgacaatctttcgtcacggtgactatcctgtcatggcaaaagtcatgcgaaacagcgagagacagcacagagtgccgcttacctgtgatgatgacgttcagctgaccgacctgtttgtcgtcagccgcacgcatataggcgacttcggctgttatcgcccctgttcatccctcttactgcgcatgtccttttcttctgtcagcggttgaccacaaaatgccagatcaaaaccagaggatgtgttgcttaccctccccgttttctccgccaaaaaaagaataaaccgggtttattttctaaatatgacagcgcaaaaatggtgcattgaaccctatcgccatttggctataataaaataaccaaatggaggtgatcatgaaacaattcacattacccgcatccgcgacagaacccgatcgcctgtggcagtttgccggtctgagcagtgcggacggcgttgtgctgatggatcaaatcgatgatggccttgacggtacggtcgccagtcgcattgtcacgtgggcgcaaatctctcaggcagagctgcgtcggatgaccggcatcgccggctcgacatttactcgtagcgtaaagagtcgcttcactgcagaacagagcgaacggctggtgcgatttattcgcgtgatggatcgtgccgttgagctgtttgagggcgataaagaaaaagcacgccagtggcttaatgagcctgcacgtgcgttgggcaataaaaaaccggccgatctggtggcgtctgaaaccggggcttatgaagtactaaaactcattacccgactcgaacacggtgtttattcgtgaagctctaccgcatgactaagacgcgttatctgggatcggcctggagtggttttggtgcgcgtgaaggtggcggtcgctggaacagcgtcggtgtgtcgatggtttatgcttctgaaacggcctcgctgaccatgctggagacgctgatccatctgcaaagcgccagcgtgctggactcttttacactcctgagtatagaggttcccgatcgactgattgagtgggttgatatcaatcaactacccgccgactgggctgcaccggaagggcctgctgcattgcgcctgttcggggatgcctgggtacaaagtggtggttccgtggcattacgcgtgcctagcgccctctcgccggtggaatcaaactatctgcttaatcctgaacatcccgcgttcaatgcgattgttaagcaggcccgcgacatccccttccggtttgacgcacgctttttgcggtagcgctgaaccgctgcaggtaaaacgcctgtaaaattaaaaacctctatcccgttacttctgaccgagcgttttaaaataagcgtccagatcaggggaattaatacctgacaggggtcagtttgaatatcgaaaattattgtacgttaaggctttttttaacctttcgactttagctggtctcagccgacgaaatttatcggaagccggtatccggttgctttccagatctaatcgcctgtcagattgatatgctcccaccctgatggtgacagatgcgacagcagttgttcgttgagcttcagccccttacgtttcagggcatcgatcactctttctatatacacggtcccctgctttatcgaggttgccagacgcagcacttcacgccagtgaatttcgatctctttcagattaagtgtggtcgttgatatcagtgactgaagcgtcgggtttttataagtggagatccctgattcgcggacaaaacacacatcccagcagatgcatcagggcaaagacatgatcagtgaaaccagcagtatcggtgcagtgctccctgattttcaggtcgctttcgtgatacagcaagctggttgaatccctgacctgacggattatgcaggtgtaatacgggctgtattgacccgaaataatggtggtgaagagaaggcgggtatccggacgagtaatgtcatttttttatgcgaaaaatgtcgagtaaacgtcgtccatctgttacttcattgaaaatgctgcctcgagcgttgcctgaaagagctgatgaataaacctgtcatcccgatggaaacagaactgcagcatcctgaggcgctgcgggaatatttccgtgagcgcctcgcctgttaccaccagatttccctgactctgccaaagggctccgatccggtttaccagaaagaggaaaaggcagaaggaaactgatgtcagtcccgcagatggcgggtcatgcatacctgacggtcaggttgccagtcatcattctcagcggtatcttcagactcacatcaggaatatagctgcaactgcgattacgggagcaggaagtggatacaactgaggagctgggacagacctatttctatgccgggcgcccgaatctctctgccggtgaactgttctttataattttctgtgaacaggtcgctcttcaactgggtgtgcgtgatttcagtgccattgtggccatactctcaggacgcaatatcatcgccacacgcagaaaacctggcggtacggttaccggaacgtcgtatgcttcaaaagctgcaaggcgcgtatttggtgatgccaaattcccctggggcataaagctcccttcctttgtcggaggttatccgccttcaactctcagaatacggatggtggcgcagattggtacctggaccgggcgcgcggtacctgtcgtgggctgggtcattctggctgctgatgtttcacagattggttatcacagcgttgtggaatacaaccggatagcacggggggatgacaaactatggtaatcgacgaactggatgagaaaatttacgcactggttaagcgtcataacggacgcggcgttttcacagcgcaggaactcaggccagaaaccgatctggatgcggatctccatctcagtaaagacgaggcgcagtcgctgatgaatgaattttttatgcaattcaacgttagcagggagaatttctctattgaaacgtactatccacccgagccgccactgctgacgatactgaatcctttccgccgtcggcgaagcgttcctgaagttcctgactttactattgcaatgttaatcgaatcagcccacgcaggacgctggtgctacgaataagcaggcccgttcgggtacggagaaataggcgtacggcgcgaaaaatgactaattgcagcgtcatgtacagctcgtacggataaattatcctccccggagccataaaccttaacgtcagtacattccattccagacctcattcatcgctgaattaccaaacgccgtctgaatttgcagcaggctggcgaaacgggaaacattaagaaaaaccaaccgacattactaactgaaggttgtatctaatactgggggacaggtcactgcctttgaaaggatcattgagatggtagacaaggaggttaatgctaatgagagataataggcctgccaaattgagcttaggtaaacgcatcatgtatagccttatagaagcgtcaggtgcaatcataggcgggttgcttctcctgctgtgctgctattggttctttcactatgaaacctggcatgaaagactgatagcgattggtttgtctatcgcggttgtctatctgatcggtaaggttttacctgaacggccaaatcagtaagccccttacggtctgaaggatccccagaaacatcatcaatacaccatgatgatgtttcaataggttctcgccatctcggcatataccctgtcggggttaatgcctgacaggctccccggtgactgccggatgacattctcactcaatgtcagatacgacaataccctccgcgacttcacactgttagcctgaaaccatctgtttattcccttactttcagggtaataccctgtcagccacatgatgatgctgtaaagtgtcgcgaccaggcaaagcatcgatatccgcttttctccccagcttttacttgcccgaagtcccaagaccgtagccgctcacttttctcatctctgaagttctgctctgtttgcatagggcggctgtatattttaattatcacccgcggcttatatcccataaggctggtaaaaagcagccacggctcgcgggcgtttttgctgtacatcctgttcgttttaggagaacgctggctgcttttcctgccggttgtccgcttatgaacggtataaaaatgcccgagacaatcacggctgacgttgcgagccagtcggcaaaatcccagatagcatggcttcgctacttatggcatatctcgtgccatctgccactcttcatccccgattatctgaaaatagaggctgcctctgacacgtcagaaaaaatcccatcccagatatactggatttaccaccttaacggtctgggcgtgaagcgcagacgacatcgtaagggcctggcgccttagcggcttccgctgcttcgcccggacctggtcaatggaatttgccatggacgcacttaccagcgaacggaaagttaagtgactgacttttagtaataattttacaaatatgtgtctgacgatcaccgctgctttcggtatttcaggcgttcaggtctcgcgtattctggacagtataacgctcttacgtggctatccggctaagataagaaccgttcagggcccggaattcacctgcctcgcacgggatcaatgggcctttgagcatggcgtggaactgcgtcttatccagccgggcaagccggcccagaacggatttattgagatttttagcagcaagctggaaacatgtaaaaatagaaggtaaacaacccgacatgactaactgatcgttgtatctaatacagtgggaaggtcattccatttattacttttgtaacccttctcttcacagtttgtgcagggctgtcactttaaagtggcagcgttcctactggcctacgcgcagctacggcaattagtagaaatttttactacttctcccaaacctgacgggcataaggcttttgatgaccaaactgccccctgatacagcgctttgttagcctttcgatatgagctgtaaatccatgtaacaaatgtaaggtttcgggctcataaaatattttatgcagtgatgaagacgtcgcacttaataaaagcattaagaaagatgcgataaccctacgtaatctcattgattaattgatgataattttaaggtgacaggcaatttgtattaagtatcaccaggctgtttagcatccgtgcgacagaaatgatgatcaggaacttataaggatgctttataaccttgcgttggagattagctggcctgaattttacttaagttgcgcggcgtgactataacctgttgattaataatcacggtgttttacacgagagaataacggtgtcaggaaatacggcaaatgctgccaccaaataattacaatttgttattctgttaacatatatttaccggcttaacaaaaaattgatagtcgcgtaatgacaataaaccgatttgcaacaaccgttaaaatcagaaaaacacctaattaatgcattgtattttaatcactggtgtcacttcatcaggacaagaatatggcaagcataagcacacttggcgctggtactaacctcgacctcaataccttatatgacaacatacagtcagccgaacaggcgcaactgacacccattaccaatcagcaagcgtcttataatgcgcagctgacggcctggggcgtggtacaaagttcaatgtcgaaattgcagaccgcagcctctgcgctggaaaatgcctccagcattgcgacaacaaaagtgaccagctcgaattcggcctttacggctacgcttgccagcggtgctgcagctggaaattattctgttgaagttgaccagttagcggcgtcgcagtccctgctctccaaatcggcaagcgacgaaacgaccgatctgggcgacagcagcatggcatcacgcacgattacgatcagccagcctggacagaaatcgccgttaaccgtgacgttaaatcagaatcagaccagcttgtctgatatccgtgatgcgattaacaagcaacaaggtagcgtcaatgccagtgtgattatggccaatgacaatacctactatttatccctgacggcgcgcgatagcggcacggcaaatgccatgaccgtaagtacaaatgatgccacattgtcgcaatacattaactatagccagggcgggagtaataacgctatgacacagcaggttgccgctgaggatgctcaattgaaggttaacggattatctatcacgcgcagcagcaacatcgtgacggatgcgccggagggcgtaacgctgaatcttaataaagttaacagcggatcgcctgaaaccttatccattgctacagatacctcgccaatggcgacagccgttcagtcgtatgttgatgcgtataattcgctgcagaaaaccatcgctgaccagacaaactataccccggttcaggcaggacaggcgcagagtacagataatggcgatttgctgggggataatacattaatgaatatccagaccagtctgcgcagtcaattttccgatcctcagggtacaggaaatattcaggtactttctcagctcggaataacgcaggacgataaaggtgatctgacggtagacagtacgaagctgaatgccgctttaaccaaccaacccgcagatgttttaagctttttgacgggggatgggaaaacaacaggtttcgccacgcaggtgaccaataaactgaatgatatgctggcaagtaacggcacagtatcaaatgcgaccacggggattaacacctcgttaaaacagttgtccgatcagtacaataccgtcaacgatcaaatcactgcggtgatggcacagtacaaaacggaatttaccaatctgagtacgctggtctcttcaatgacgcagacgggtgattatctgtctgcccagttcgcgaagatgtaacgcctgcctcacgccgttttgccacaaggctgaacatcctgcctctcatgctgatggtgctcctgcgccatcagcatttatccattataaggccctggttttctctggtatttggttactccctcaatagcacttttttatcgcatccataagccatgaatttagcgtaactctttatccagaacctcgtcgcattgccgcgccaatatccattaggcgagtgctcgcacgctgacaagacacatcgcctttgtcataagccaaaaactaatgcagaatttttatgccgcgcggtatcgtcaacgccactgctttaacctcgcgcctggacaaacctcattaacgtgagtattcattttttatatttcgttaatgatatatcttacccaatgtatttttaaatatttaatgcagtttctctaatgaaagcatcttttagcgaaaaggtcgcagataagcgctttatggaatactgagcaacccccttaatcatctgtgctttttaaagccttacgctgtaacaaaacgtgtttaaccttaaggaaattggttttttggttgggttttgtgtggggttataatcatttctttccggttgattcttatatttacaactgagattttacaacaaaatacttattcaataattaatcttatctggcttctttttattaaagtttagcaggaagggttcgataataataatgcgtaaataatacgttctcataagaaggaatttaccatgtcagtcatcaacactaacgtcctgtcgttaattactcaaaataacctgaataagtctcagtcatctctcggtacggcgattgagcgcctgtcatcgggtctgcgcatcaacagcgccaaagatgatgccgcgggggaagccattgctaaccgctttacgtcaaatatcaacggtctgacggttgcggcgcgtaacgccaatgatgggatttcgttgtctcagacggctgaaggcgcgctggatgaaataaacaacaacctgcagcgcgtccgcgacctgactgttcaggcacagaacagctctaactcagcgtctgatatcgattctatccaggccgaagttaaccagcgcatgcaggaaattgaccgcgacacgaaacagacggatttcaacggcattaaagtgttgaacacgggttctggcagcagcacttataatttccaggtcggttctcaggatggacagactatcggtatcaccattagctcaagtgacagcttcgatttggctgcagcgggtaacgcgtcttcaggtaccgtgcagaacaccagcgtgacaaccgggcagacggttaatggtacagcccgcagcaccgcggctatcggcttcgacgtgctgaaaggtgcagtcactggtggtagtagtggtagcgcttctggtagcaccccgctggcggatatcgataaagcgatcaaggccgtcgacagccaacgtagcctgttgggtgcgtctcaaaaccgctttgaatctacaatcagcaacctgaataataccgtgactaacctgactgctgcacgtagccgtattcaggacgcggattatgcgaccgaggtatcaaatatgtcacgtgcacagatcctgcagcaggcgggttcatctgtactggcacaggccaatcaggttccacagaccatgctgtctttactgcgctaatcctcaatttaaaaaccacgctttttttaagcgtggtttttttcagaccgcctgcggtgaaaccaggctaattaactttgcggataaaatcactgaatgccgctaattgcctggccagatgctcaagcgtgccctgctcaatcaccttacccgcctgttcatcaactttattctgaatgacaccacccataaattccggtttgttcagtaccatggcgtcaagaaacaccagaatttgacgcaggtgatactggcaacgcgcgccaccgatcgcgcccatggagctggtctgaatcgccaccggttttcccgcgagcggctgattaggaacgcgggataaccagtcgatcgcatttttcaatccgcccgggacagaatagttgtactcaggtgtgacgataatcacgccatctgcctgacgaatctgttcggcgatcttttcaacaggggcaggaaacccctcttcttgctgaatatcggcgtcataaagtggaatatcccgaatggatggaagcgcctcaatcagcacgccctgtggagccagttgcggtagcgcctgtgcaatcattgcgttgtacgagccttttctcaggcttcccagcagcgtgacgattttcaacggtttatcagacatcattcttcctctttttgatggctaaaatcatccccgaaaacctggggaagcgtatgcgtattctatgcgattagaagcaggttttttatgagaatgtgttagctggctttatattccgcctccacaggtacatcgtgcaaaatcacatatcgccaatccagcgtgccgccattgcctgctgtcggcagtaaacgtgacatggttaaaatggccgcgggcgacgtgggatacagtagggaacacatcgaagaggtggacgtgataacgcgccaccgcaacacctgttcaggagggagagagcatggtcagttcgggtaaatatgtcatcaggcaagcaacgtcgcaggacctggcaggcatcactgccctgcttcaggaaaactcagcggggaatggcggaacgctgaacggggattttcctggcgaaaaggttgccgggatgttgaatcatccgggggcctttgtggtggtcgcgcaatccgccgctgggatcgacggcgtgttatttagcaccacatcgttccagcaaggtccggagatcgtgaaaacgatgcttcgtgcctggccgcccgcgcagcagtgctggatttacggcccggtctgcatcagcacggccgcccgtggtcagggcttactgacgcgtttgtacgatgaaatgtgccgatattacggtaataaagcccccgttctgtttattcaggctgacaattatcattccattcaggctcaccagcgccttggaatgcgtgaagtgggacggtttagtctgaacggcagcgactttttgatatacagcccggcatgtttttagacgtctgtcctcgcacaaattgaaacctgcaccgggtaaaaacgctaaaattaatctgaatggttaacgggagcgaccgtgatgattaaaatttgcctcacatgcggcacgtcttatcaacagctggatgttcagatcgcgcactgtaaaatttgtgaagatgaacgtcagtatgtccctaaacaggggcaacaatggatttcacctgaggcactgcatgcaggccacagcaataaatggtatcagcatgaaaaagccttgttgagcctgaaaacggtgccaggatttgccatcgatcagcgcgcttttttagtgaaaggcacacagggcaacgtcctctgggactgcatacctaaccttgatgatgcgacgattgatattgttcacgcgcttggcggccttagtgcgattgccatttctcatcctcattactacagcacgatgcaagactgggcggcggcttttgatgcgccgatttatctgcacgccagcgatagcgagtggattatgcgcgacagtccatacctgcggttatgggagggcgaggcaaaagaaatcatgcatgaagtgacactgttacgtttaggagggcatttcgacggtggcacggtgctgcactgggcgaaagacgatggcgtcttactgtcaggcgatgtcgtgcaggtcacggctggcgcgaacgccgtctcctttatgtggagttaccccaatatgctccctttaccggcggctaaaatcagcgatatcgccgcccggcttgagccctatgatttcgaacgactttacagtgcgtttgaaggacgcgacattgcgcccaatgcgaaacaggtcgtgatgcaatctgcacagaaatatatagacagtttacggtgaaacacgccgctattctgccgccacgtttaaggctgttttagccaccaaaatcatcgaccagattcaccagcaagggctttaaggttttcaactcttctatatgcgccagagacagcgcctcaagcaagccttctgcctgaggcgttaattttagggccatcctacgttgatcggcggcatccgcttcgcgggtaatcaaccccgcttcctccagccgactaatcagtcctgatgcgctgtgcggttttaaaatcagccgctcggcaacgtaccccaccgtcgcggttgctgctcctgaaccgcgaatggtcagcagtgcctgatgctgctgtggtgttaacccaacgctgcgagcctgactttcactaaacgcgataaacgtgcgtaacgtcgcgcggaagtttgccagtaaggcgtaatcagcatctttcatcttcggctgtgacatgcaataaccttttgtcatttaatccaggtcgcgatgcgatgtaagttccccgcctttaccttgctcaggaagacattatgcgggagctcgccaggctcaaattagccgaccacactgtaacgaaacgcgtcattatactgactttaaggggattgctgccaggcgcgggtggtgctttcggtgccattgccttgcttaagctcattgcactgatgacgaatgtgttctggtacaagcagttttcatttgcagaaaacccgatgccgggaaatgccagcgcgctgcatattctggccgcaccggttatcggcagtcttatcattggtgccatcgcccgctttgttcatcatatcgtgcaggaatatacgaccaatacgccagaaaccacaaaagcccggccaattatgtcaacgtcgcccgcgacgttggatgcatcgctcacgctgagtgaggtcattgaacggatttcagagcgccatgcacatcatcattacccggtggtcgtgtttttatccgtagtgtcgcgtaaagatatgattcactggcaaaagcagaacaaggcaccggacagtcgtttgcaagatctggtggaggatgaaaaacctgtcagtgcctgccccgatacgttgtgcagccagattgcagattacattttcaatcaggaagtcggtattgtcgtcgtgacgacgccacaatctggcaaggtggttggggtgatcacgcggcacgatattttccgggtacgttatctcgcccgacaggctgagcatgataaggcgcgctatttacgatttaggacaataagtgataagagccgccaggctaattaaccgggcgacattttacgctatccgccttaacgggcggatagcgtgttaacgatggcattgcgaaaagtatgagaaggcgttcataagtattcaacgtgcttgtcggcccgttgcgacgcgttagcctttgagtttgatttgctcaagcccctgtaaaacgtggttgatatcgttatccgtcagatgctggacgttgagttgcagatgcagatgggtcagctcatcttttgtgaaaccaccctgtgacagttgctgattgatggcttgcaaaatttgtccgtctaacaggttaatttgcttcctcaggtctgccagatcctttgcgggcggcacggaatgaggtgcgcccaaccagtcagccagatagcgatactgaatcgctttgctggcatccattaaaccctgaaaaaacaccgtcacggactgcggatcaagcccggcttgtgccgatttctccttggcttctgccagtacatcctgctctcgcgccaggtcttcaatcggcttattgtgggtttttttgaaggctgcgacatccttcattaataacattctctcatgaagcgcacgcgagagttgcgaaacgggttctgacgccgacggggcagcagcagcagagccgcaaaaaattaacgcagcaagaagaaaggtcatatattgcatgtttggttagcctgtttccaaatagttgaaaaagattaatcagattaaacgtccctctcatttatggagtgtcggtgaaatattatttaatctctgtaattaactaatacaaattataaccagaatgctacataacagctaacacatgttaagagaagttaacgtatcttttgtggatgattcggtttcgccagtgattattaagcctttaagctgttaatttactgatggagcgcggatttatatgtatattattgatattaaaataattattagttgagcttccgcttaaaatcatattaaatatttatgcttgcattggccataaatgtaaaagtatgtcagcaaaaatccgccataaattattcgttccctaactatcctggccattactattaacaccaaggcctgaaatagccataaaaatccacataaatgcattgatgtctcaattgtgaatttatatttcaaaatgtctttaaagttttcattgtggcagtcgataagttttattaagcagtgtggtttaaaaacaggctgcaaaataatatttctgtatcggcctatcagggtgaaattatgtctattacgcgtacgttttccgatatgaaaatgggtaaaaagctggggttgagtttttgtgtgctgattgttgccactctggctattgctctcttagcgtttaaaggctttcaaagcatcaaagagaatgcagcaaagcaggatattactgttgatatggtcaatgctctcagcaaggcacgcacgaaccgtctgctgtatcaatatactaaagatgatcaatatgctcaggttaacgccagtgcactcaaccagttaagcacccactttgataagctgaaaaaatttgactggaacagtgaaggcaaagaacaactcagtgtattaggcaccgctatacaaaactatcagacgctgcggcaggcattttacagtgcggcgaaaagctcctcagcggcggctacgttgattcaggataatgatctcctctctcttggacaaagccttgatggactgaatctttccgctcagcccgaagcgatgctacaggtattgcggttggcctcactcctcaaagaaattgcgggtgatgtagaacgctttattgataaacccagtgagtccagcaagaccgaaatttatggcaacattacctctgtcgaacagatacgtgctcagctgttagcgctttctgtccctgaaatccaggcggtgttgaatacgcaaaaaacggatttagcgaaacttaaacagggtttcgtggattacattgccgccatgggtaaggaatcaacggcatcgacggagctcagtgctacagcagaaaagctgaatggatatgtggctggactctttaactatcaggcgtctgaatccgctgacgcattacgtagcgctgaaagccagatcgcaatcgttgcggctatttgtgttctgcttagcttgttagtggcctggcgcatcaccgtctcaattactgttccgctaaaagaaaccctgagcgttgcccagcgtatctctgaaggcgatctcactgctacgctttcaaccacgcgtcgtgatgaactcgggcagttaatgcaggccgtcagtgtgatgaatgagagcctgcaaaacatcatcaccaacgtgcgcgacggtgtgaacagcgtggcacgcgcttcctctgagatcgccgccggtaatatggatttgtcatcgcgcactgaacagcagtctgctgccgtggtgcaaactgcggccagcatggaagagttaacctcaaccgtgaagcaaaatgccgagaacgcccaccacgccagccaactggcaacggaagcgtccgtgaacgctgggcgaggcggtgacatcatccgtaacgttgtcaccaccatgcaaggtattacgaccagttcgggtaaaattggtgaaatcatcagcgtaataaatgggatctccttccagacgaatattctggcactcaacgcggctgttgaagcggcacgagccggtgaacagggccgtggttttgcggtcgtggcaggcgaagtcagaaaccttgctcagcgcagttccgttgcggcgaaggaaatcgaaacactgattcgtgattcgctgaaccgcgttaatgaaggctcaacgctggtcgatcaggcgggaagcacaatggatgagattgtactgtctgtgacccaggtgaaagacatcatgagtgaaatcgctgcagcctccgatgagcaaaaccgcggaatatcgcaaatcgctcaggccatgacggagatggatacgacaacgcagcaaaacgccgcgctggttgaagagtcttcagccgccgccagctcgctggaatctcaggcggaagagctggagaaaaccgtcgctgtcttccgtgtgcctgcgaacagaagtggtatgtccattagccacagcgcaccgaagtctgcacctaagacgctgatctctccacgtcagcccagcacggcagaaggtaactgggagactttctgatccttgctaaaacaaacgccggctttatgccggcgtttaccttcctgacgcatctgcagtcagcatgactgtccagcccgtctgattcccgttgaacaaagaagatcaatcccttctccgtatcattcaggcgaaagcgcccttctccatccgaatatgctgactgcgcggccaaagcgtcgctttactcccgccctctcgctgcccaatgtccagcaaaagcgccctgccattagccaacagcaaggctgatttatctgccgagagacagagcggtactcaggctgtttttccaggtttaacgcacatacagagtaatccggccaatattagaaacacgcccgccatcgcgcctgcatggaatggctcagcgaacagcggaaggctgatagccaggagccataccagtacgtaactgatgcttagcagcggataagcccgactcagcggtagatggcgtaatgctaaaaaccagcacaccattgagcaggcataagccgttaatccgccgcacaataccagcagcggtagccagtgaagggaatagtgcgtcattagcagagacaacgcgggcaactggtgcattgcccagcgcagcatcaactgagcaaccgtcaccagtaaaacgctacacattgccagcagatagcccgtcatgcataactccctattatagcgacgcccgcgacaatcaggacggtgccagcccattgccagcgggtcattttttcatgccagataaagcgtgcagccagcgccactaagatgaagttgatactcagcatcgggtacgccaggcttaccggtaaacgctgcagcactaacaaccagacgatcatccccaggcccaacatcgccaggctggcaatcagccagccggtgagtttagcccggtttgtttgacgcgccgcctgcttttggcagagctgacccgcgcaggtcagcaggctggtcagtaagaccaacaacaggctcatggctactccgccgcgttatattgcagcagaagcatccgaccgttgcgataaacggcatccgctggcggcaaatctgttggtgtggcttctcctcgatccagcatcataataagcgagacattgccctgtttacggtgcgcctgaagccactgggggaaatcttcgctgctgacataggatgatcgtgcgtcagggaagcttaagccatattgcagttcgcctttttcactgtatgcaatgatatcgctgcgtttcattgtccaggcgatcgccgatgacacacccgaattatcacttaagatatagcggctgttagcaaggctgctttcaatactgcgaataaacacctgcggctgcttggtattttcaaccccttcagggatggccgagccgacacacagcgccaacgttaaaggacacagtgccgcggccagccaacgatgttgtggcgatttcaggctgaaaacgcccacgatggcccagccggcaaaggacagtacggccatcgtcaatgccagcagttggtgtgaaccataaagaggtcgatggcttaatccccagggcgcaaagaccactaacaacgccacgacgcagacgctaccaaacaggacattgatccacgcgttgactttaaacacgcgcgtgtgattgcgggccttttgccaggcatactcagccatcagcaaggccagtggcgcaaagcagggcaagatatacgttggcagtttgccttttgcaatactgaaaaacaccagaggaataacaacccaactcagaagataaactgcacccggggactgcttacgttcacgccagcccgaccgcaatgcccccggtagcagcgccagccagggaagcgagccggcaaccagaacaggcaggtaataccagaaaggggctttgtgctgcgcattatcttcggcaaaccgctgaatatgctcaacccaaaagaagtaatgccagaaatcaggctgctgttgctgaatggctatcgcccagggcgcgctgattaacgccgcactgattatggcaagggggccatagataatcagttcgcggaaacgctgattccagacggcccacggcaggatagccagtaccggcacggccagcgccagaaaacctttggtcataaaacccatgccgcaggccagccccaacaacaggtaacgtacgatacgttgccgggtgttttgcgcctcagtggcaaaccagtagctgcacatggcagccaccatccacagcgtcagcatcgggtccagcacagcatagctgccaatgctgtaaaccagcagggacgttaaaaagatgacgctgcccgttaaggcaacgctacgctggacaaaaatacggcatcccagccagtaaattaataccgcgctcatcagcacagaaaagacggaaccaatcctgaccgcaaagttattgtgaccaaaaatggcctgacccacggtattgatccagtaacccgctataggtttttcaaaataacgtagaccaaagaagtggggcgtaatccagttaccgttttgcagcatttcacggctgatctcggcatagcgtgtttcatcaggctgccagagattacggaactccagaggaactaaataatagaggataaaaagtgaaaccagtaaaagggtctttttggtggcagtcatggtgcttaccttgttaaattctcacaacccaaccagccttcccggccagcaatatgaccacgaacaaccttacccacaggtaaagtatcaaggtcttcaggtaagagttcgctcagcgggcaaaactgtattccttgcgcacgggcacgctgcaacaacgtatcaaaagcatcgagctgactgataccttccacttcggcatgaatggtataaaccggcgtgccctgatcagcctggattttttccagaatataatcgttgaaacgctcggcactgagcgtgggtccgaccacttcatcccatgtcggtaacgtgacggggatctggaccgtacccagttcgccgtttcttaactgcggtcgaaagggtgccgtcccgcggcagtcgctgttgtactgaaagccaaaggtttctttagcctgaataacccgaccatctgcccgccagccagccactgctgagcaggtcactggctgaccggttatcgcctccagcgcgtcgcggcccatggcaatctgctgaatgagctgcggctctttccagacgcccgcccaggtttgccaggcaaaatgatcccaggcatgcagaccgacctcatggcgatcggcggttgagcgaatgatatcgctcatccctgccccgatccgctttcctggccaggccgttccggctaacagaatgtcccagccataaagtgatgctgcgcgtgagcgcagcattttccacagaaagcgcggtttcatcagacgccataaatggcgtcccatgttgtcgggtccgacactaaagaaaaacgacgcctgaagatcatgtttattgaacagatccaggagcgcggggacgccaagttttgtcccgcgccaggtatctacatcaacacgcagaccaactttcttcattccttgtcgtcctgaagctcaacggtacgcaggaagaagtcgagtgtgttatcaatcgtggtgttcatttccacagttggcgtccagccgagcaggcgttttgcattacggatggatggcttacggtgttcaacatcctgatagcccttaccgtaatagctgctgctttccacttcgcggaaaccggcaaacggtgggaagctggcacgcagaggatgacgttcaaagctttccagcaggcgttcggccagctctttgatactcgcttcgttatccggattgccgatgttaatgatttgtccgtcgcaattattgtttttgttctcaataattttaaacagcgcttctacaccgtcgctgatatcggtaaagcaacgtttctgacggccaccatcaaacagcttgatcggcgatccttccaccaggtttaaaatcagttgtgtgatggcacgtgaactgccgatgcgcgccgcattcaggttgtccaggcgcgggcccatccagttgaaaggacggaacagggtaaagcgtagcccttgtttttcaccataagcccagatgacgcggtccagcagctgcttggaaacggagtaaatccagcgctgtttattaatcggacccacaaccagattggagtgatcctcatcgaagtttgcatcggtacacatgccgtacacttcagacgtcgatgggaaaatgatgcgtttgccgtacttgacacagtcacgcacgattttgaggttttcttcaaaatccagctcgaaaacgcgcagcgggttacgggtatattcgatcggtgtcgcgatggccactaatggcaggatgacatcacattttttgatgtgatattcgatccattcagagtgaatactgatatcgccttcaacgaactggaagcgcggatgaccgacaaagcggctaatcgcgtctgaaccgatatccaggccaaacacttcaaagttgtcgtcctgcaacagacgctcggtcaggtgattaccgataaagccgtttacgcccagaatcaatacacgcgtacgacgtttaacggctgcaacggcctgggaatacagcagcgcgccattcaccatgccaagatgctgagccagctggataccgttcatgtagacactgttggcggtctgtccggtctgaatctccagtgcgccctcgccgcaagcgacgacgaaaggctccgcagacagcacggtgccaggacggacattatgcgcagtagataatacttttgctttccagaccacgaatttggtggtgccagcaaaagcaaaggcgcccggccatggatcagttaccgcacgcaccagattattgatttggctggctggcaatgcccagttaatgcgaccatcttcaggcgtgcggcgacccactacggtggcttccgcttcattttgcgcggtgccgacgatattgccctgcttcatggcaggcaacgcgctttccagcagctcagtggcgcagtcgaccagtttgcggtgcagcgttagtgcgttatcttcatcggcgatggcgacacgctgctgagcaatgatctcgcccgcgtccgcttttttaaccatgcggtgtaaggtgacaccggtttcggtttctccgttaaccagcgcccagtttaacggtgcgcgtccgcgatattttggcagcagtgaaccgtgaaggttaaaggcaccctgcttcgcactgttcagaatctgatcgcacagcaggttacggtaatagaaagagaaaatcacatcgggttcagacgatttgatgcgatcgatccacagaggatggttaacttcatccggagcataaaccgggatagaattttcagccgcgattcgcgccactgagccaaaaaagtgattttctgacgccgtgtcggcatgggtatagatggcgctgatggtgtaacctgctttcaacagcgcattgatgcccgcacaacccatgtcgtgataagcgaagacgatagttttcattactcggtttcctgtacagaacggtctttctgaggattgataacacgttgaataaaatagcgaggtctggcacggacatcgttgtagatacggccgatatattcgccaagcagccccatgccaataaattgtgcacctatgaagatgaacagcacggcaaacagcataaagacgccatcaccagcccaggctgcgccaaagcacagacgaagcagaatcaacaccagggaaaaggcaaaccccgtcagtgcgatcaggctgccgaggacgctcagcatgcgcagtggtgtggtggtgaggcaggtcaccaggtcatacatcaggttaattaagcgcataaagctgtattttgaatcgccatgctcacgctcagcgtgcgtcacgggtaattcaatggtgcgccgtgcaaaggtgttagccagaatcggaatgaacgtactgcgttcgtggcaattcaacatggcatcgataatgtggcggcggtaagcccgcagcatgcagccataatcgcccatcgatttgccggtcacgcgctgaatcatctgattgatagtgcgtgaggcctgacgacggaaccagctgtcctggcggttctggcgcacggttcccacaacgtcatagccttcctgagcggcagcaaccagacgcgggatctcttcagggggattctgtaaatccgcatccagcgtgataatcaaatcaccgctgacatggctgaagcccgccataatggcagagtgctgaccgtaatttcggttaagcaacacagccacaatatggctgtccggcagtgaagctgcatccgtaatcatcacggcggaggcgtcctggctaccgtcatcgaccagcaggatttcatagtccagattaagggttttacaggcgtcattggtacgctgaatcaacgccggtaaactctcctgctcgttatagaccgggataaccaccgatactttttcaatttctttatcgtcgaacatttaaaccccagtcagtccacgtagtgcgctgataacgcgttcaacgtcatcgtcggtcatgtcgggaaacaacggaatcgaacatatacgctcgctgttccactcggtggcgggcagtgataagtgcggatagtgttcacggtaatatttgtgagtatgcgccgcccggaaatggagaccggttccaatgtcctgctctttaagcttctgcatcagcgcatcacgggagaaaccgcatgcctgctcatcaacacgaatgatgaacagatgccaggcatgttgatgctgccaggctggcggaaccagcggtttgaacggcgtgtctttgagcgcctccagatagcgttgcgcaatggccgcccggcgctggttaatttcaggcaacttttcgagctgaaccagcgcaatagctgcgctgatatcaggcaggttgtatttgaaaccaggcatgatgacttcagcctgtggctgacggccgtgggtttgtctgtcaaaggcatcaacgccaagaccatgaaacttcaggctgcgaattcgatcggcaagcgcggcatcatccgtgacgaccagcccaccctcagcacaggtcatattcttgattgcatggaaagaaaaaatcgcattgccatgtccaccaacatgctggcctttgtagtaagtgcctgcggcatgtgcggcgtcttcgatgaccggaatcccgtggcgtttaccgatggcataaatggcatcgatgtcggcaggcgcgccggcgtaatggacagggatgatggctttggtcttaggggttatcgccgcttcaatggcctcgggcgttaccatcagattatcaacgtcgatatcaatcattaccggggttgcgcccagcaaggtaataatgttcagagtagaaacccaggtcagcgaaggggtaatgacctcatcacctgccttgatgcccagtgccattaacatcacatgcataccggctgttgcagacgtcacggcaatagcatgttgattcccggtcagctggcagaatgcacgttccagttcggcacattttggcccggtagtaatccatccagatgcaaacacatcacgcactgcagacagttcagcttcacccaaagaaggtcgtgaaaacggaagaaatgccattaagtaatatccttaaactgttttgcaatttttccagaaaattgagcgcaattttgaaaaaaaataatgaacaaaatgtcgtttaacgttcatcaaaaatcgccaaaatccgcgaaaaacatgcaaaatcattaaaatctgcctggtgaaataaattattagcaaaacctttatttcataccggtatcaaatcatacgcccgcaaccttaaccgaacattaaacaccttatgtaattaacaaattgacatgatatttatcacttttaccagactaatcactttaaataaacagatatgtttgacagttgcgtgaaggtactaaaaagagggttttgaggggtggtttcagtaagagcggtgcttgacagaggccttgatatcgttgaaagttggacggcagaatcctgttgttatttaaacggatagcgttgtgacaagtgctgaaaaaaaacgcaagtcgcattattttatttatttacataaagttacccgtaaccatgtgcgccgaaaacgcagctgatactctctactggaaccctatggttcccgagctgaccgtcgctgactttgccacgtcttatgctttttatgttgacgttatcggctggaaagtcaggataagacgtgctcagccagacttcgcctatttgtgttatggtgaagcacagttaatgattgagcagatgcatgaagaaggctggcagactgcaaaattgacccgccctctgggacgggggatcaattttcagattgaagtagcggatatcgacacgctctacaatcgactgcttacacacggaacgcccctctttcgtcccctgcgcgaaaattgttatcacaccggcgctcaatatgaatgtcagaaagaattcctggttcaggaccccgacggctatcttctgcgattttgtcagcctggcggtggatcaccttagccgttaaacgcacggactttcagcagacgcagcactgaaattcgaggttagcgcaaacgtcatatcatcacgcaggtcactgcgacgttgtcgttctcagccgcaaaatttttcaccgcagttaaatcctcccagtacgtcgccagaaagaagtgttgccactctccctgtgtttccggctgcttaatttcacgacgtcgcgctggcgcgttcctacgtctggatgtgtccaaacagggtggtgcatatcgttttatccgataacagtgggtgctgatggttgaagtgcgttaccaggcgatcacctggaaatatatggaaggaaatgattcatggaacgaccattattttgcctgataagaaggcatcagacggggcgaatgccttctctgacattaatcaggatataaaatattcggctgaatcacaggcaaaggttatgtctgccgctttcctctgactgaacatggtgatgctcagttattgcaaggctgttgtgactattattatggctgtattgatgccatcaaatgggtaatgaccagcgtttcaacagtccagttgggctccatttgcctgcatttcgttttacaaaataaatgtgaaggactggcacaaggcatcgctgatggcgttattgatatgccattttgatccaggattcagaaggaaaatccagctagccgtggaaaggtctgtcgcataaacaggatgataatgggcccatcaagttaaggattttataatatcaaagggccagtattcgcccctgacaaacacatttcctcttcatgaatagagcccattttaagcatctacagcggcacgatctcgtccacctgatgctgaaaaacgtaaggatcagagattaacccaaactgttcatcatccggccaggtcactgcgacgtggtagttctcaccggcaaaatttttcaccgcagttaaatcctcccagtacgtcgccagaaagaagtgttgccactctccctgtgtttcctgatagacgaatgcggctttgtttcccgatgtcgcgctggcgtgttcaacgccggtcctttgaagatgtctggcaaacccttctgcatgttttaacggaacgcatccgtgccacgttcttacaatcatcgtcttctccttaaaagccgtcttcatttgaggataatgcgttgattttatacaacagaatgggatgtcagggaaaaaatttgtccggcggtggcacaaatcctaatttgttctacagttactggcccgaccagggataacgacattaatcatagtaataacagaacggtaacaaatatggaattgagtaagtttgaggtcagaacaggcctgtggccacacatgcatttcaccgatattgagtacgatcagcgcggcagtagctatgaaatttacgccaccgatgtgacccatcaaaccaagagcaagctgtttatttgccgtacggttgatgaacaacaggcgagactgctggctgaacagttcaaaatctggctgcctaaaatcaatagcagaaagcgcaaagccgcttcaaaaacatcgccgacaggctatgaacgtgtggcatgccataaaggctgatgctgttactctcctgtttcaacggtttagttaatcgtcacaggatatgatggaccagtagcagtcaggtttatgctgttggtccaaacgctatcagaaaaaataggatatcgccgccgtcagagaggcatcattgtgatggaatatcacaggactgtccgcagcatttttatccagccagcgatagtcgccgattaaactggtcccccatcccgacgcaaactggtgactccattttacgctggtatccgtaccgtaaccccccttggcactgtactgactgtatccgctacgggcatgttgatccatattagggattgtaagcgggaagccgccaaaattttgcgggcttgccatacggcatttgcgggtcagggcaccctgagtaatttctttcatccccagcgtggagacaacctggtccagatgaagtttctcatcgatgataacgttctgatttatctggcctaaaggctggataagacatcttttataacgttctggatcatccgcgcagaagagtgagttcagtgcactttgtgtttctgtatcgcggaaaggcgctaacgttccgttgacagcgctttactgatgattttctgaagcgttgaatatcctggccggacagttttctcattcagccagcagataagttcggtggcaacaaatccaggagtgatatcacgacgcacaatctgcgctgcacgggcatctaactgtagaccaacagagcctgaccactgatggtacccaaagaagtcggtagtaagcttacgctgggcgtaatattgatgaccggtaatgattttgtcggtgagtgatacctaacgaaattaacgctgaatcacaaaatcgaaatcacttttcacatccttcggtaaaaaatgaaagaaagcatgtttggccttaaaataactcgtctgcaggatacaataaatttgcgccagtattccggggcggctggttgcgagcgccagctcatctgacgtaagcgaccaaatactccagttgctggccttcatcaaaatcaggccatacagtgcgcatttttctgcacgcgaaggtatggccatcgccagggcaaaagggaaacggcgaggaaaacagccaaagttgtcagataaacagcaaaaagaactttgcaggatgcacggaagcggtgagtactcaataagcgatctggccgaattattttccgtttcgctgccgactgtttatcggacgctttcccctggacaaaaatgagcaagaggatttaatgaaataagcaaggagcagttatgtactacagcaatgaagttatcagctattttcaggctaataaaattcttgctttaaaactcgaccatgcattagcgggtgcaggaaaagccgtatcaaatcagattgagacgatcgctgcaggtgcaacgcgagcactgtattacacatcctgttttactgatgaatatcaggatgtctgccagaaacaaaagaccgaagacattcgattcaaaaacagcgttatttatcttttgcaacatggcaatgttgcgtatgacatgtttaaaatatatttcgaagaaatatttaaatataaaacccccgatcaactggagcgcatcaaacaaatgcttatggctgttaatatccatattgccgccagttcactcacaaacgctgggtttgctctggcaacagcatcatttgtcgcagcaggcatgaatctaagtcttgaactcagtgcactggcagggcgaagagcgggcgaggttgtaggggctattgggatatacggcgtggtacagaaagcggcagatagtgcccatcgcctacacgtccaatacccagcctattactctgcactctacatgcaacaactagaaatgatgtacttcctcatagagccattgtttgagcgggctgaggcgtttaaagcacaatgggcatcggatgatggtattgcagctatcatcaccaggatgattcgataatcatgatgaatcttattaaaaggtttttcagacgggtattcagatcattgatctcgtattatggcccggcagtgctgacaataattttcgctttagttcagggtttgttttttcctgacagcccaatctggcttatccccgtattttttgtatttgtgatggttgttttatcaatatgtgagattgtaaagttcaaacgttagcatcatcgtaaatttatttataaggaaataatatgtctacacccgcacatttatggcttgaagatgagaacggatctccgatagtcggtagttgcatgatgccactccgtctgggttctatcgagttaaaatcattttctcacggtgtcactattccagttgacccaagctggggaaaacttaccggaacgcgcgttcatagtccgatcacgatagtgaaagaatttgaccaaacgacacctattttgtatcgcgccgtctgtgaaggccgcacattgaaaaaagcaacgatcaagatgtaccgaatactggaatcgggcattgagtctgaatatttcaatatcatcctggaaaacgtcaaaatcacgacagtttccccttaccttgcccctacaggtatgagcagcacccatctggaaacactcgaattacgttatgaggcaattacctggaagtatacggagggtaatattatctatagagactcatggaacgatcgttgtcgtgcctgatgacgaggggcgccaaaggaggcaattgcctcctttggttctagccagaacacttaacgtcagcattaaactgaccatgtgaagcgcatgttttccggttattatcactttgcttgatctcatcaggttgtgtcactaaggcgacgatgtcgcgaccaggctggagtataaaaacaacgtgtcaacgtaagcccaggaaacgatggagaaacggtcaaggtggcccaaatgaaaacgaaacgcgtgctgattattgaagacgacgctgatgcagcgggcgtacttgaagcctatctgaaacgagatggctatgacgtggcgatcgccagcaacggcatgaccggtctggaacaggcccagcgctggcaacccgatctgattctgctggatgttatgctgccggtgatgaatggcaccgaagttttgtctgccatccggcgcagcggtgatacgcctgtcatcatggtaaccgcgatgggggaagcgcccgacaggattggcgcattgcgttatggcgctgacgactatgtcgtcaaaccctataatcccggagaggtcgtcgcacgtgttcaggctgtactgcgtcgcacacagcaggcgaaagtgccagatgaaaagctctgctgggcgggactggaggttgatcctgaatcacttaccgccgtggttaatggcgtccacaggctcgatctgacgccaacggaattttccattctggttaccctgatgcgcgcgcccacgcgtcctttcagccgtttgtttttacttgagaactgccttccagaaagtgatgcccttgagcgggtggttgatacgcatgtgtataatctgcgtcgcaaacttgaagctgcagggatgtcggaaattttacccgccgttcgcagcgtgggttacaggttcagacaaccatgaagcagaaaacccatgactcaatgtggcgctggatttgcattcgtatactcattctcggcttaggcagcgtcattcttattgcgttctgtatgtggctgaggtttgccctgcaaacgctctgggtttactaccggatgccaaccgcgctgtgggaagagttttctcgactgcgcgtgcatccggagcgcgatacggctcgcttccatcagattgtcgatcagtggtggggcgtcggcttctccgatccctctatcgcgtctgcggactggattaccgtagcggtgctggtcgcggtgattattcccttttttgtcgtgatgggattgcgctttgccctgccactggcgaaacaatttagtcaactggcacacgcggcacgggatgtggcacagggtaaattcggcacctcggtcggtcaggttgatggcgcgccgcaagagttagtgcgttttacagaagacttcaacctgatgacacagcaactggtgcgttacgaacgtgaacttaaagcgtcgcatgtcgcgattgctcatgaactgcgttctcccttgaccgccgcaatgggacgtctgcaaggcattgtggacggggtatttgcacccgaaccccagcagttttccatgatcatgaaacagctgacgcagttgagtcgtctgacggatgagcttcatttactgtcgttagcagaggcaggtcagctcagcctgagtctgacccggtttaaccttgctgagttattgcgtgagagaaccgcctggctggcgcttcaggccgaggccgggcaggtagcaatagaagttcagtcgcccgcatcgctgccttacacgggagatgcttctcgcttaggtcaggtcgtgacgattttgatggagaatgcgttgcgctatgctgcagaaggcaaacgaatttccgtttatgctcaggcgtccgccacggcaatcaccctgcagtttcgtgactatggaccgggcgtcgaacctcagtttttagccgttatttttgaccgttttacccgggcagagtcttcacgcgcccgccattccggcggcagcggtctgggactgtccattgcgaaagctatcattgaggctcatggcggtcgtatccaggcacggctgccatcagagggcggactgcacattaccattaccctgcccttacatgacgccatgcagactgcgtaaaataccgcgcgagtctgcctgtcagccaacctggtcaggccttttttgctcaccttgaccatttcttgatgatccatagaaggtttctggacataacccacgttaaatgagcctgtctcatttaaggaatccggttatgacagatttttttccttcttttgctcgtcaggcactgcgtcaccttgccatctttaattatgttgtaccgtcactgttcgtgatggtgggcatgctggtgcttgcaggctgtaaagacgaaaagcctgctcagggcgaaacactacgacctgttcggaccgtaacggtgccgccgttttcctcggggggcctgatgacgcagacgggcgaaatccgggcgcatgaggagatagccttagccttccggctggatggccgcgtgattgcccgagccgccgatattggtcagcacgttaacgcaggccaggtacttgccacgttagagaataatgccgcccaaaatcagctcagcagtgccactgccgacctcaacagcgcacgcgcatcagaacacgttgccgctctcacactccgccgtatgcaactgcttatgccgggcggggccatttctcgtgcgcagttagatagcgcacaaggcgactggcaggccgcagtcgcccgtcgccagagcagtgaggccgcacttaaaaacgcgcgcgataatcttgcctggacacagcttactgcgccaggggccggcgtgattacggcggtgaatgttcaacccgggcaggtcgtcagtgccgcccagacggtgatgacgctggccgctgacggcgatcgcgatgccgtttttgaccttgccgaacctgcactctctgaaagtgcaacgagcacgccagttaagattgcgctgttatcaaaccccgccgtaacggcggagggccgttttcgcgatatcagcccgcaggccgattcgcaaacacgcacctggcggctccgcgttatgctgaccgatccgcccgccgcgatggcactgggttcgaccgttttaggcgttttctctggaaaagccgaccaggtgattgccctgccagccagtgcactgacgcgggccggggatcgccccgccgtactcgtggtgaacacgcaaaaccaacagattcaggtcaggcccgttacgctggcacgctttgacgcacagcagatctatctcagtgccggggttcaacccggtgagcgcgtggttaccgcaggtgtaaaaacgctgttgccgggtgaacgcgttcagcttgaggagagtgaaaaatgaggtcggacagtaatcggaacggctttaatctgtccgcctgggcattagctcaccagcagttggtcattttctttatgctgttggtgatgacgaccggcgtactcagttacatcgatctgccccgtaatgaagatccggcctttaccattaaaaccgcagtggtgtccgcccaatggcctggcgcttcggtcgaggacaccatgcaactggtcaccgatacgctggaaaagaaacttcaggaaacaccttcgctggattttattgaaagtgaaacgcgcgccgggaagtcggtgatatttgtcaatctgcgcgatgatacgccaccggcacaggtgccgactatctggtatcaaatccgtaaaaaaatgcaggatattgccccgtcccttccgcaaggggttcagggccccagtgttaatgatgaatttggtgatacgtttggcacgatttatggttttaccgccgacggatttagcccgcgtgaactgcgtgataaggtcgatgagattcgtcgtagcctgatggatgtgcccgatacgggcaaaatcaccctactgggtgaacaggaagaacagatcgttgtcgccttttcgcccaggcaactggacggcatgggccttaatcttcagcaggtgagcgatgccttaaccgctcagaacgcagtggcacctgctggggaaatacgcaccgataaagagaatatcgcgcttcgcgtcagtggtgcgctgacaacggtggaaagccttaaggccgttaccctgcgtattgggcagcgttttatcccgctgtcgagtatcgcgacaatcacactccagcctgcgcagccgccgtctgccaccttccgtgttaacggcgaaccggcgattggccttgccgtctccatgtcccctgcgggcaatatgctcaggtttggtcaggcgctcaatcaacggatgacggttattgccggccagctacctcatggcatcaatatgataaagatcgccgatcaatccacggtggtgaaaacggctgtcagtgggtttgtccgggtgctggcggaagcggtcattattgtgctggcgatatcattcttctcgctgggttttcgtgccgggctggtggttgcggccgcgattccgctggtgctggccatgacgtttgtcgggatgacatttgcagggattggcttacaacgtatttcgctgggcgcgttgattattgcgctcgggttgctggtggatgatgccatgatcacggtggaaaccatggtttcgcgcgttgaagccggagacagcaaatggcaggcggcaacctatgcatttaaaaccactgcctttcctatgctaacaggcacactggtgatgattgccggatttattcctgtgggatttgcggcgtccagtgcgggtgaatattgttactcactctttgcggtcgtcctcatttccctgctctgttcctgggtggtcgctatcctgttttcgcccgttacgggaacctggctgctgaccgaaggtgccggtgcaaggcataaacaaccgggatggatggcacggctttatcatcgcctgcttgatcaggcgttacgttatcgctgggcaaccgtaataagcgccctgctgctgctgggaatgggtgtgttcgggacgacgctgatgcagggcgaattcttccccgcgtccgaccgtccagagctactggtgaacctgacgctgccggctaatgcctctcagaccgaaacggcgcggcgcaccgggcagctagaaagcgtgatgcgccgcgatagcgatatcgatcatttctccagctatatcggttctggtgccgtgcgcttttatttgccgatggaagtcttgctggataatgaaaacacggcacagctggtagtggtggcgaagaaccttgaagcgcgagacagagtgcggcgtaagctcgaacgcattctggcgcgtgattttagtgatgtgacgtcgcgcgtctcgccccttgagctgggcccgccagttggctggccgctcaagtaccgtgtcaccggtcccgattacagtaacgttcgtcacatcgcggaaacgctggccgcccagatctcacgctcgccggatacacgtgaagtgaacatgaccgcaggcgagccagaacgggtcatcaaggttgatgtgaaccaaacggcagcgcgtgcggtcggtgtctcttcggaaagcatagcttcgatgctcaatactgtgatgtctggcagtacagtaaccaccatccgcgaccataaccggctcattgatgtggtgttaaggggagacgatcgcgagcggcaaaataccgacattttgaacggcctgatgctgaatacggcttccgggcagaaaattccccttgggcaagtcgcgacattaaaatggcagcttgacgatccggttatctggcggcgtcagcgcttgccttacattacggtgcaaaccgatattgcccccacgcaacgcgctgaaacggtatcagaccagttaaggcccgccctggatgcatttcgtgcatccttacctgctggctataacattgaagaaggcggtaccgttgcagaatcgaacaagggaaacagctccgtctttgctgtattgcctgtgacgctgtgttttatgcttatcctgttgatgttgcagttaaaacgcttttccagaatgctgctggcgctgttgatggccccttttggcttacccggcattgttattgccatgctgccgagcggaacgccaatgggattcgttgcgctgctggggatcattgcgctggccggcatgattatccgtaacgcggtgataatgatcagtgaggtggacagtaacacccaggcaggcatggcacataatgaggctatccgcagtgccgctatccatcgcgcccgtcccatattgctgacggcctgtgcggcgatattcggtatgttgcccatttctcagcaggtgttctgggggccgatggcgtacgccattattggcggtctggttaccggaacgctggtcaccttaacgctgctgcctgccacactcagtctggtgatggaacgggaaaaaacgcggttctgaatgcgtcccgtcagcgggaagaaagaggatcgataaacgggtgatgttcatctgtcacccgccaggcgcaacagagatgctgtctgtaactaagtaaccgataaccggcattcagcagacgatctgactgttatgcggctggccggtttagtcacgtcgaaatagcgcccgacagcaccctccgctgacgactgggttaataaaaaaagcgctgtagtaatacagcgctttctctaatcaacaagatcctgaacgggtcagatttttacataacgccttaaaaactttcccagttgaccttatctacgtttactgcttttaaatctggccttttcaaggcgagtgacggctggctcaccggtgcgctgatcgatgcaggggcatgcgcgacactgtcattcactttaaaagtagaaaccagtctcgacagggtttctgcctgctcctgcaacgatttagacgctgaggatgcttcttcgaccaaagaggcgttttgctgcgtcacttcatccatctgcccgatagccagatggacctgttcaatgcctttactctgttcggccgtagcggcagcaatttcattcactaagtcggcaacctgctgaatagcattgctgacattatctgagttactgcccacgctcgttgcctgctccagcccctgctctacctgtgaaacggatgcggtaataagctctttgatttcgcgagccgcagaggaagaacgttgtgccagattacgaacttctgaggcgacaaccgcaaacccgcgaccatgctcaccggcgcgtgcagcttccacggcggcgttaagtgccagaatattggtctggaaagcaatgccttcgatcaggccggtaatttccgagatttttgcagaactgccacgaatttcgcccatggttgtcagcatctgactgactgcgccaccattttgtttagacatggtgttagcattattcgccaggttgctggcctgtacggcaccttccgcattttgacgcacggtatcgctcagcgtcgccatgctcaccgacgtttcttccagcgatgccgcctgttgctcggtgcgcgatgacaaatcttcattgcctgcggcgatttgtgtggaacccgtactgacggactgcgcagcatgattgactgacaacagcgtggtggaaacacgtttaagcagatcgttaaacgctatcgctgtctgcccaatttcatcattccttagtaccggtgctaaatttgtcagatcaagattactgctgaccgttgtcatcgtatctttcatgctggtcaggcttcttttaatacccagaataatgctgactgaaaatataccgagtaataaaataaccagtacagatgcgctggtcatcgcccagatggtctgagaataaacatgattattttcagcccttaacgtatcaccaatttgaatgttcagatcgatttgtttagtgaagtcagattccattttgcgcgctgcggcaccaatgccgttgtcgctctgaagcagttcaagagaaagcgcattattatggctacgtgaagccgcgagaaatgcgggtaaagcgctacgaacggcatcaagattacgcagtgcctgaaccgtcatggccttatcttcatcgctggaaatatcattcgccatataataatcagttaacgatttgatattatcaagaacgccgtttattttttcttcggctgccacctgttttgtactgtcggccattgactggtggcgatataatgcgagacccagttggttagttgcgctaatggatttattcagatctttaatgctgggtatcgcattaacctgaacatattcaaaacgagactggaagccagatattaccgataatgaaacagcaacaagcgcacatagtgataatgccagcaacgaaaatgccagcactaaacgctgtgtaatagtcataaaaaaacccctggatgtttaataaaagattcgttatcgcaatacagtcttatcggcacagcgcaaagcagctttacctgttaatttcagatatatttcggttccgaaacttgaaaaataccaaataagcgctatgcgttaaattgtggttaaaataattagggctggtttgttaaacttttgggtttgattcgcgctttttgttctgttgcccctgagcgttcagccgtgaagtgttttatgacgctccgggctggcttatcagtgagaataagcaggcgcggagccagcagtttatccataatgacagggacatccggtcagagtaaagtgactcttttttgtgacagagatgactatggaaacgttgtttgtttacggcaccttatgtccgggccgcagtaatgcgcatatcctggagggcattggcggtatatggcagactggttttgtcagcggtttttactttcctgtaggacgaggcgccgctacgggctttcccggtatcgtcgtggatgatcaggctccgcgggttaatgggtttcttttctcttctgacaacttgagcttgcactggccaatgctggatgagtttgaggcaggttatgatcgcatcagggttgaaacgttccgtgaaaacggtgacagcgtcaccgcatggatttaccagcttcaaccgcagagcgttccgtcaagcgctcaataagcgatctgtctgaggccaggctaaaccgtatccgtcacggttctcggtttcagccagtgcaacgggcgggcaaacatcaccaggttaccacctaaaataagcagcaatccggccacgttgtgactttgccactggtaaccttcatacattgttgacaaggtgagtgccaccagcggaaacatcagcgttgtgtaggctgcttttgcggcacccgtgcgtctgaccagggtaaaataagcccaaaacgcaatgaccgatccgcatacagacagataaagcagcgcactcagataatgtaatgtccacagcggcgagaaattcacgccacgcgcccaggcgatgccgcccatcacgatggcaccgtacagcatggcccaggcattggtggtcatcgtttccagttgcctgcgctggtgccgcaggctaatcatattccccaaagaaaaaccaaaggtgccaagcgccgacaggccgattcctgtccacaatcctttgttccagccgctgacgtccagatcttgccaaaacaatacgatcatgccggttaatcccagggtgacggcaaaccagaaacgcggttgggggcgctgcccgaaaaagaggtaactattgactgcgttatagagcaccgccatggaaaaaatcacggattctaaaccggtattgatatagcgcgctgccgtgtagaagcaccaaaaattaaagcaaaacacacagcatccctgtagaaggcagaacagatgatcgcgaagtgacaaggcacgtagacgacccactaccttcagcagtgacaggagtaagaggctggcgatagcaaaacgccagaacacagaaacggtgacatccaccggcccctgctgcataaaaatagcgatccaggtggttccccagatagccaccaccaccgcgtaaagtaatgcgttcatgcgttttcctttgagcgagagaggaaacagtgtgtcggattttccgggcggaggctttcatggccttgcgggtgacttgcaaaatcttgcgcatttaatggaacaaatctggctaccggcctgaactcgccttagactgagcctctgttcatctggcggaaaagagttatgtctcgcgtttacgacacgtttgaaacgctgcgtcaaaaaaaggccgtgctgcgcgaatcggtcatgctcaattccggcatcagattggcggcatggcacaacaagcaagaccgggtcaccgtaaacagcaatcatcacacgttaagcctttatgtggcggatggttacgagagctatcacaaaacggcgagcggatggcgcaacggtggcgggcctgataaattctgtctgatgccccagcagagtgaatccagctgggatgtgcgtaatgacctcacctttgtgcatctttattgcaccgatgaacacttacgcgaggtcggcgagaaagtgtgggatcgcaatccgttgtcgattacgctggatgagaaaatattttccagcgatcctaaaatcaccgccttgtatcgtcagttcttactcagctgtgactggcaacagcctgcgaatcagttaatgctgagcacggccagcaccctgctgttaacccacctcatccagcattattccagcgtgcagtggcggctcccggcagtaaccggcggactggcgccctatgtcttgcgcaatacgttggcatttattgatgagcatctggcgttgccgctgacgcttgatacgttggccacgcaggcaaacctgagtgaataccattttgcccgcatgtttcgtcagtcgctgggcgttgcgccgcatcagtacgttatgcaacgccgcatggaaaacgcacaacagatggtgcgatcaacctcgctgccgttaacccagatagcgctggataatggtttcagttccttaagccacttcagtaatcgttttaagcaggtcacgggcttcacaccttcgcaagtgcgcatggacaatggcgggagtaggtcctgaatcacgcgatgcggcaaaagacgttgggaaataacaggctgctgattcgctaacattacaactgagtaacctaaaccaatcctcactcacccgccgttcctgcctttactcaacctgcatcctgattatactgagcgcggattcattcaggcatcgtggcatctgtatgattatcccgatgagctaacgctttcatggcggtgttgcttaccggaaacgccggcatcagttcagctggcgataattgcccttcgggtcagtcagccatccataagacgatgaggaccagggtcatgttactgttcaaaaacgcgctattccctccccccaactggcacgtgccatcgctgtaaaacgcctgctttctgtcgcagcaatgcttgcgtcagtaacaaggctaaaccggctactgtcgcagatttttagcggaaagcgtgctggtaagcctcaggccaaaccttgcacacgaaggtgatttacagcaaatcgtcagccagacatgctcatcctttgatggaacattgataaagagccgttcagacgcgcgcatgataaagattatcctgcctgccgttgaaatatgaggttaagggtagctgcatttcgctatggattagcgggacaagacctcaccgcgtgatatcagttttccacattgaatgctgtgattaatcgtcatcctgatgacaaggaagccccttatgaatcgttcacctgaaaacgcgattgcgttaatttttcttttaatcggcctcaccgtcatggtgctgggtatttggcaaattctgacgcagtgaggtgccgctatgcgtaaatttacgctcgaccagatttttattcaggtagttgctatcgcggtcgtcattatcctgcttaccatcgtgattcgttaattcatgtgcggccagaaaataccccctatctggccatttccacatcacacagtaaccgccgcccaaaaacacctgcttttataatctcgctcaactcatccttgccatttctgcattaccgtctgacggctgataatgacagcgtcaacagccttttatatttcgcaacacctggcttttctcttaacttaaccgggaataattatgaatctatgccacaattttttaatgggtggactggcagcgataatgacgatgggaggtgcaatggcgacagaacatcatgatctgacgggttaccgtgagggcgcaaaggtgattcaggtaaaacccgtacgtaaccagatcgattccctcaacggcgtcgtctattcacaagtcaccactctgcgatcggtcaggcagctgcatatgtcgcttctggtgccacggacgcaggcgttaaagcccgctatcatttattttccgggcggcggttttaccagtgccgatcacgataagtttattcagatgcgtatggcgctggcagagtccggttttgttgtggcggccgcagagtatcgggtcgtacctgataccttcccggcgccggtggtggatggtaaagcggcggtccgctacctgcgacagcatgccgaggattacggcattgaccctgaacgcattggtgttttaggcgattcggcaggcggttggctggcacagatgcttggcaccacccagggggaaacgtcattcgatcgcggcgatttcaccgataaatcctctgatgtccaggcggtcgcaaccttatacggtatatccgatctcctgaatattggcgaagggtacgccgatgacattcaaaaggttcatcagtctcccgccgtgaccgaggcgctgctggtgcatggcgcggctttccgtgactttgctggcgcaagtatcatggacgatacgactaaagcacgtcacgccagcccgatggggcatttaattaaccctaaaccgcccttcctgattatgcacggcgataacgattcgctggtatcgccccatcaaagtgcacagttatttgatgcccttaaaaaggcgggcgagaaggtagactacgtcgtcgtaaaaggtgcagagcatggtgacctggtttggtatcagcctgccgtgatcgatgaggttgtgaactggtttacccgtgaactcaagccagaaactggcgcagtaactgatacatctaccgatccgaacagcacgctttgacgcacaggcaagccactcaacgtggcctgcctggcagaggggcaatttagcctgaacaacgctgcgtaaccgacatggctaccgcccctttcgcccctttatccagcagaagcagataggcagcggttatctgcttcacaaagtacgcattatttggcagcgcctcaccaaaaatggcgtccagatttaacaacgctttgactctcgcctccccttcggcactggattctacggccgcttttaaaaccggcaggagcggatcgctcacgtcaatggcttttccctgctcatcgacacctgagacatagcgtatccaaccagcaattcccagggcaagcaggtcaaaatcactttcgttcctgagatgccagcgaacggagtcaagccagcgctgaggcagtttttggctaccgtccatggcaatctgccaggtgcggtgcttcagggcgtgattatcatagcgctcaatcagcaggtcagcgtaacgggcaagatcaacgccctgcacgtttagcgtgggtgcctgttcttccagcatcaatgtccgggccgcaagacgaaaatgttgatcttgcatacagtcacaaatatgttcatagcctgccagataacccaaatacgccagaaatgaatgactgccgttcagcatacgtaacttcatttcttcataaggcacaacgtccttaactaattctgccccggccttttcccacgccggccgtcctgcgacaaagttatcctctattacccactgcctgaagggctcacaggctaccgccaccggatcctcaacgccgatcacctgcgcgattttttgcaaactttcctgtgtcaccgcgggcacaatacgatccaccatagtggaaggaaacgtgacgtgctgttcgatccagcttgccagttcgggcgctctttttcgggcataggcgcaaaccacgttgttgatcacccgaccattttcaggaatgttatcgcaggacattacgctgaatgcaggcagtcccgccgctctgcgacgggccaacgcctcgacgatgatgccgggtgcggaaagcggttgatggggctgctgtaaatcagacaggatgaggggatgatcaaacatcaattcaccgctagctggcgaatggcagtagcctttttcggtgatggttaacgacacaatggcgatctgtggctgacacatcgcgtcaagtacggcttcaatgccatcaacctgcgcgtgcagtgcttgcctgacgacgcccacaacccttcctgtccatgcattcgtggacatctccgccacggtataaagaaagtcctgacgcttaaggtcggcaatctgctgttctcccccaatcaaattgacttcgatatagccccagtcgctaccctgttcgtcagcaaggatatccgcataaacggcctggtgagcacggtggaaggcaccacatccgagatgcacgattcgcggaaccagtttatgacgatcccattggggaacggtggcgttagcccggcgtaatttatttggcattgtaatctctctgttaattaataatttggactcgattaattgctggttattttgctgttgaatagatgtgtaattttctgacttagcaacatagttaacattcgttattattaaagttaatgggatgtattaaataagtcattcaggagtggcatgagaagtgcgttgatatgatcccagccataacctggatcataataattaccgcctcaacacatgcgcccactaccataccagatgcaacgaataaatggtgatatgcgccgaacaaattgaggtcacacctttcgcatcgatcttatctaccaggataagttaactgggctaaatgatgggttaagctggccctattcaggcgattacattaatatttattttttagcaggaggcgcttttcgatcaccctttttcggtcgggtaaatcctttcagagtaagacgcattctgcccagggaagttaacagatgataaagtacagccacaattggcgaagaggacacattaaattaacattgcgtctgagaacgctgattcagtgacaagccgtgcattagaatgttaattacttactacgctaaattattaacttcatattgttaaatttttatggcatggatgtatgtcacattttttaattttattgtttttttgagacatcaatagcatcaggtagcactgattccttaatgcgtcgtcgggttacgacgcataattttacctgcgttcatgacatccatgaacccaggaggacatcatgtggaaattgaattcagtgattgatatgcaagggacaaacccttacctcgtatttgtcaataacgcgggggatacccggctcctaccctgtaaagatattagtcccacttccttaagaaccatgaatttttatgaactcgaaaatttcctttacgctgaacaggtaaaaaataacaataaggcagcgaaactattgacattatcctgaccttttctggccctcggattgctctgtctgagggcattttttgttacagcccctggttcatacgactctgacatggcatgtcgatgcggtggtgaagagatgagtttctggagattcaggcaagattccgtgcaacgtcgtttatacagccgcaaagtgtcacgcactcaccctgctatctgttatcgcaattctgtcgatgacgctgtttacgctttagccgccgacgcagtctgagctttctcagcatcctcaccctgagcttacgccaaacggtaactgagatgagtggtcgctgaagactgagcagtgtcaaaaacatcgcgttaacgtcctctcgttgcagtttgtcacccctcatccggcaaagggcagcagattaaacggaccgcgttcgcggtacaggatgacaataagatcccccgcacgcctgttcgacatccatgatcggctaaggctttgcccggccaggcgcctgtttcccgcacgtcttacttagccaaacgaaggtagccatcgcaagacatcaaggatgaccgtcaggtagacgaggctgcctgcggctatcaccagattaagaaccaggttattacagggcgctgtataggctgcggttggaaaacgcttgcgggccgctttgaccaggaaagggggaaggatgacactccagatggtaaatgccagcccggcatagccaattgcgcgtataaagccatcaggcaggaagaaacaaacggccgcaggaggcaagtaagtgaccagtgcggtctttaacctgcctggacggtcgtcagagaaacgaaacagatcggcaatataatcgaaaagtccaagcgtcgcggctaacaatgaactggctacggcaaagttaccaaagaaggtgagaataatatccatatactgatgggtaaataacccactcagggcgtccacgaagacgtcaatatttccccctttggcaataatgggtggaaagtcggcgcgacggatatttcccattgtgacggctaaccagaacagataaagcagcagtgcgaaagcggagccgataaaaatcgaacgcgtgatattcttaacgccttgtgtgccatataacttcaccaggctaggtacgttaccgtggaaaccgtaagaaataatacagaaaggcagggtcattaagacataaggcaggtattgcgtatcaggcagcgccagcgcgggactgtcgatcagtttggccccgtcgacatgccataccagaccggaaaaagtagcaaaaaacgccagaaacttaccgataatgagcaccgttgtgatacgaccgactaaaagcgaactgtaccaggcgatgcccccgaccagcagactaacgataaccaccgataaccgggccggaagatgaaaatcgctatatttttccactgtctgggacaggacggcagaggagccagaaatataagcataagttaaaatatataatacaaacccgaatgcaataccgacgaccccattccatttatgacctaacaggtccttggtgaaggtgttaaaactcgcgccaccaccataatggaggttaacctcgaccagcattaaaccggttaacagcatcattaccgccacaacaattaaaataaccgatgctcccggaaaccatacgccagccatagcaacaggaagagagaacattcctccaccgataacggtggcaatgataagcattgttccactgagcaaaccgggtgttgttttattaatatccatgaaaaaatgctcctgttgactctttattatcattttggcgtcattcttgatgatgtggatactaaactgttaacagctgacctgtcattaaggcaggtccgaaataaaatcctgtttataaaaaacaggcccctgtcaggggacctgaatcgtattaaatataatcaaatcgggcagtaaagaaacggagctgtttgggttcataaacaaacctcagaccgcgaatatcgtctttgtgttgatacagtttaatgatgccatcagcaacaacatccatgtgtgcgtaggtgtaaacacgacgtggaatagccaggcgtactgtctccagtttggggcggtggttttcccccgtttctttactgcgcccggcggaaacgatgccacgttccatgctacgcacgccggtttccatataaatgctggctgccagactctgtgccggaaactgatcctgcgccagatgggggcaaaaacgacgggcatcaagaaatacagcatgtccacccgtcggttcgacaataggtacaccggcattacggagcttatctcccagatagcgcacctgtttcacacgatgttcaatgtattcatactgcatggcttcacgcaacccgatagccatggcttccatatcacgaccggccaatccgccatatgacggcatcccctcataaaccacaaccagctctttcgcggcctggaacatctcgtcatcgttcatgcacaggaagccgccgatattcaccagacagtcttttttgccactcatggtgcagccatcggcatagctgaacatttcatgaacgatatctttgatgctggtgttctcgtatcctgcttcctgctctttaatgaaataggcattttcaacacagcgtgtcgcatcgtagaaaatcttaatgccatattgacgggtcatttcatgtaccgcacgcatatttgccattgaaacgggctgaccgcctgccaggttcacggtgaccgccaggcagatataggcaatgttatccgcgcccttttcttcaatgagcctggctaatttattgaggtcaatatcgcctttgaaaggcatcttcaggccagcgtcgtgcgcttcgtcacgaacaatatccacaaaggttgcgccgtttttttcctgatggaatcgggtcgttgtaaaatacatattccccgcaacatattgaccgggcttaatggccagttgcgagagcaggttctctgctccgcgcccttgatgcgtgggaacaatatgtttggggtcaatttgggtattggaaattattgtacgttaaggcttaaacttgacctccaagtcccaaaggatcttgggaagatcccccagggctcaatagcaagcttaccagctaccataaggatactttttccctttgataaactcctcggtatcttttccgtactcatagccgttagaaaaccgcgttattcctttgcacatatctaatttgtcccctgaaacggttttaaggactgacggtttgacgcgataatttggctcagaactaatcccctgcaaccagacggcgacttttccctccggagccagaccaatttgcactctgtcgtaatacgcagttcttccccgataattcctgtaatcactcggcctgagcattttctccagtatgggtttagggattgtcagtgcggtctcatacacttttttatcgataatagagtcccagcaaaaaataatatgtctgggaggtcgtttaacgtgattccagtagccaccagacacacggtctttgtcgttccactcaccgataacgtcgggtagaacagatgtacggttcagggtattaaattcataaactttgccatcggcatcctgaacaacggcgtacgtcaccagtgcgggcagcgccttaggtgtgaaaaaatcaaaggtccactctactggctcatcgttttgagggtcacttccgggcaacgactgcccctgacaggccgtcagaatgagcaacggaaacagccaggccacacgaattatttccatattttattcccatccatattataaactgtccgctgccagcgctcgtctggccggttggtaaatgttaccagcttcgctggtctgactgcaccgctgatacttccccgaccgtctctcaccacgctgttccagttggctgagcaatggatatatttttcggccagcatcagaatttccggcgtggtaaagccgggggctgacttaccactccttatggcacggcccatcacgattgctttttcacacaggctgttcagttctggccggagtgacaggttgtcgtctttaggtaaaataggggaaaattccaccccggcatcctgcgccgcatcgagcatcactcgcaacaccaccttcgaccagtcgttacgcgtcgggcgatcgataaccagcgcagcgccgctgcgtttctgtagcgatccgtaacgatctgctggcagtctgtcgtcatgccaggtatcgacattcacttccaccgcattcagcagtggcgctatcgcggggtaaccgtccatcgctgtaagctccccgcaggtctgttgataaatccgcgtttctgtgtctggtgtagaaaggggaacggtttcaaaatcgggtcgggtaagaaaacataattcatgctcatcgggattgtagccgccgcctatgtcagaatgcaccccgggaagggccagctccggccacgccggtttcacgctattcagcgcgaaattgaagcggcattcgtgctgcgcagtgatatggaatactttatcagcaacgcccggacgcagcgccagattgacatccccggtatcggcgctgtgcgggttgaggccgttaaccggtgtcccgatggcggctacggtatcaaatatccccagaaagcgggttttgcccccggacgtaccggaaaaatcaataccattcagaccggctttaatcgccgatacaatggctctgtcctgactgaatatccggttggcaaagtggcgcgccgccgccgctccccggctgaagccgaaaatatcaaattgcaactctttgatggtgcagaaccgggcatctgtgtgtctgtctaaatagccctgaataccggcagccaatgctgcgactgctttatcggttttactcactacgccggtatcgccccggccagtgcccattccgtaagtgctgtcgccagccccgtcttccgtaccgataccttcaatataaatggcgtactgtcctgcccctgtatcagtttttatttccgggttataaagcgtatagagccagtgcacgttactgtagtagccgatatagcttccggcggcagtaccgctgactccgcgattcagctggacacactgctctagcgcagacatagattctgcatcattcattccgtaatgttcaccggaacaggcggcctgacgggcaccgctgttattcgcattgttgccagtgccatcaaagaatacgccgatggtcagcgtgatatcccgtttcttcttcgcgacctgcgctcgctgttcaggctctgactgctgggcttgttttttcgccttctcagaccgttcggccagccgtccggcgttgcagtcgctctcgtaggtgtgcgtctgaactgacggaataaatcgggcgcggcaagggcaggaactatagctgtccagtgaacctgcccactctttcagttcatcgcccacttcataggaatcccccatgccgccgcacacccggaagcgcccctcgtgcttaccgcaagtcaccgggtcgccctccctgacctgctgccgctctatgccaccgatttcgtaggtgtcgtcagacgcaccggaaaggatccgtcccccgcaggtggttttatccaggtgatacagataaaatcccgtagtcataatccctcatgaatgtaatggttataaaatcagcgcatcataccttaatcatgtcttaaccaaaatcttcggcttatgattaccggtaccatgcctggatacggcagatttgcgaaggaccgtactccgtgcatccgctgtttcccggatactgagtttcttgacctgccggtagtacaggactttatgatgacgctcctgttcggcctgtttcccctatatttacccaacgtatttacgcgttcaatttcctgtttttgccgctggcggcggctcagccagtccttatgcgagattacggccatcagatcgaaaagcatattatttatagcggttatcacggcgccggtaatcgggtcggcctgcgaagagtctttatctgacagtgcctgccaaagcactgagggaaactggccgtattgaacgaacgctgtttatgctcgactggttccgcgatccggcactgcgtcggcgggtacgggctggtctaactaaaggaggagccgtaacgcgcttgcgcgtacgatatttatggaaagagcggtcgatgccctgaagcgtaaagctttaaatatcaacgagctactgctgccgcatttaaggctatcagtgtcacctgttgagataacagttttgtggcaatactggctacagcaatcactaatatgatcactaaagaaaaggcgatgtatgaccatcgcctgagtgatcagaacgtattaacacccgatgcgttatttattctcgggtaattttcatcgccatatcgattgatatcgccatgctctcgggattcgccttgcctgtccaggcaatattgaatgcggtgccgtgatcggctgaggtgcgcaggaaaggcaatcctgccgtgatattcacaccgtcgtaaaaaccgaggagcttaagtgggatatgtccctgatcgtgatacatcgcgacaacgatgtcatacataccttcattacactgcataaatacggtgtccggcggacaagggccataaacatcaatgccctgcgctttcattgcgtctatagccggcgtcaggattcgaatctcttcatcaccaaacagaccattttcgccagcgtgtgggtttacgcctgcaaccgcaatacgcggctgggtgaagccaacccggcgtaaaaaggtatcggcgattctgatgaccgtttccacccgttcctgactgagcgtatccaggaacttacgcagcgaaatatgcgtggtgacgtggataaccttcagcttatcggtgtacagcaccatcgaataatctttggtgtccgtcaacatcgcgagtaactcggtgtggccgggataatgatgtcctgcaaggtgcagcgcttccttattcagtggcgcggtagcaatcgctttgacctggccacgcatcgccatttcggttgctcgcttgatgcaccgataggccacatcaccggcttcgggctgaaccacaccacactgcaacgcctccggatgggcaactttctcatcaataatgtgaatgatgcccggcgcgaactgtgcctgatccacctgctcaataacgctgagttcaacctgaggtgtgatgttcattgccagtatacggcggaaagtctgtgcgcagccgataaccaccgcgggtgagccattcaatggcccttcggctaaagccttgataatgatttcaggaccgatccctgcaggatcgcccattgttatagcaacagtattagtcacctgttttctcctcaacgaaactcaaaatttttaagagggtggtttcatcaccgaaagcaccggctttagtaaatacagtctgattccagtcacagccaagtaagcgcccgtagggaacacaacctgcagccctgccccgaattctgaatcctgttgcgcccaatgcggttgcggttgcagtcgcgacatcaccaccggagagatacagtgcttttggtggcgtgatgcgcatgaccgaatggaccagttctccaagcagaaaactgattttttcacccagttgcttacgggtaatgccacgttgttcacacagcctctgtatatgttgcctgtcgccactgtcacagcaggtatgaaccagacaatgtgagccatgacgaagaatgcaggtaatggcctctctgaaacgatcgctacctttctccagcagttcagcggtatcgatatagacgtgttcaactcgcggatgttctgcggctagcaccagttgtctttgagcgacttcactcattgaacccaccacagcgaacaggcctgggtactttttggctgacgtaaaatagcgagcaaaagcatcacacagcccagctgagcctaccagcaacggctttggccgtaacgatgcacatatttctacgatgtgatccaactcagcatcagtttttgcatcaacgatgagggcggtcattccttcgcgcacctcttgcgcgtgccgggcaagatcgctgcacctgacgttaatgcagctaatgccactctgtttttgcacaatgtcactgatatctgcactcacgatcggggtttttggatcgctggcaaattccgtcgcggtgagcaacttgccggaaaccagacattcaccgttttgcgttgttcgtcctgctgccggaaacgcaggcgcaatgaccgcaagattgatgccggttgcctgcaacactgcctctgtttcggctccgggattacctcgcatcgtcgaatcgatctttttgataaaccactccacggtcataccgggttggtctgccaaaagtgcagtcatttggtttgtgacttgctgtgcggcatcgctcgctgaatacgccctgctgtcgctgttcagcacaatcgcctgagccttactcagatagggctgttggaaaatgacatccacgaccatgcccgcttcagccagcgaaacaccggcatcattcgcgccggtgaaatcatcggccagcacaatgcatttttttgattacccgcctgcaccgtcattggatctccaatgctactcatctgtcgtttgattatattcaatcacaatcgattatatgtgagcaagatcaatttaataaagcctcattttatttataaatttagtcactgagtgaatgcgctacagcagcatgaagaatttcagtcaaaaacggggagaaaaacgtggcattaattaacagtacaatcttaagcggttccaacgcgataaacgccctcacgccagtcgtggtgggccgtaaccgactgctggttttgacagacaagaacattgtgaatttgtccgcgactcagcaaattctggcactactgggccaggatgaccgtcatgttgaactcattgatgatgttcccgctgagccaacgcataccgatgttgaggccgtgctgacgcgcgcgacaggcaaaacctatgatttggtggtgggcattggcggcggaagcgttttagatgtggcgaagctcctctctgttttatgccatgcttccagcccgtcgcttaaggcgctgctggacggtcagaaaatcgaagcccgtttgtcctcgctgctcattccttctactgcgggcaccggatcggaatcgacacccaatgccattctggccattccagagaaaaataccaaagtgggcattatttctcctgtgatgctgcccgattatgttgccctgctacccgaactgacaaccagcatgccggcgcacatcgcctcttcaacgggcattgatgcgttgtgccatttacttgaatgctacaccgccaccatttctaaccctgtgggcgacaacgtggcgttaatgggtctgcataaattattccgtaatctcgaaacatccgttaatgagccgcataacctgaacgccaggctggagatgctgtgggcttcttattatggcggcgcggcgattgcccatgccggcactcaccttgtgcatgcgctttcttatccgctgggcgggacctggcatctgcctcacggtgtcgccaacgccattctgctggcaccctgcatgaaagtcgtgcgcccgtttgccgtggaaaaatttgccaacgtttgggacctgattccggatgccgataccacgctaagccaggaagagaaatcccatgcgctggtcgactatctcgccaaattagtcaaacgactcaacctgccggataacctggaagccttaggtgtgccttcagatgacattgattcccttagcgaagcggctctgaatgtgaagcggttgatgaacaatgcgccttgcgtggtcagccatcaggacgtggctgcgatttaccggacgcttttcccaacggtttaatttaaaaaggagtgggcaatgagtaaaaaaattgaaggtgtgctaacagcgattgttaccccttttgacaaagaaggtgagcttaatcttgatgagcttaaacgtcaggtgattcgtcaactgaatgcgggcaatgggattttctgcggcggcaccaacggtgagttttttgttctgaatgaaaaagagaaactcactgtgactgaaacctgtgtcgatgaagtatcaggacgcggaaacgtcgttgcacatattggtgagatctctacccgtgaaaccattcgcttaggtaaacaaattgagaaactgggcgtagacgcggtttcggttattacgccttactttgttcccctcaatcaacgcgaactgattaaccattatacggctatcgctgatgccctttccgtgccggtttttttgtacaacattccggccagaacgggcaataccattgcgccagaaacggcccgcatactggctgagcaccccaatattattggcgtaaaagacagtgcgggaagctacgaaagcttgagtggatatctggatgcggtgaaggatagcaaagactttgctgtcctgaacgggccggattcgcttatccatcagggttatgtagacggctgttcagcctgcatttcaggtctggctaacgttgcgccccgtcaaataaatgatatctggtcccggttccacgctggagatatcgacggatcgcgattggcacaagagcaggtaacgggtttacgcaccgacctttataaagtggccttttcacctgcagcggtaaaaaaagcgttgcagattctggggcataacgtgggcgaaagtcgttatgcgattcattttgatgccgctcaggaagatgaaatccgcagaatcatcaacctctacctgaagtgataataagaagtaataaatcgtaaatacagggagtacaccctgctccccgaatttatcttgttatatctgaggctataatgaaaactttcaacgctcaggacaccctgataattattggcattgtggtggcttatattgtctttaccacctggctgacattccgattgcgcagtaaaaactctggcgattttatggaaggctccagagccatgccagcctttatcgttggtattctgctgatgtcagaatatataggcgcaaaatccactattgggactgctcaggccgctttcgaaggcggtatcgcggcgtcatggtctgttattggtgccgcaattggtttcccgttatttggtatgctcctggtaaaacgtatttataataccggcaagattaccatttcaggtgctatcgctgaaaaatacggtaacagtactaaaaatattatttcactgatcatgatttatgccctgctcctggtcaatgtgggaaattatgtgagtggtgccgctgctatcgcgacggtattacacgtcaccttaccagttgccgcatttattacggccgtggtcagtaccttctattttgcgtttggtggtttgaaagggattgcctgggtcaccatgctgcacagcgggttaaagtattttggtgtgctggccattttatggtttgccctgtcgcaaacgggcggcctcaagccaatgatcgacgaaatgcccgcttattactggacctgggacgggaatattggtgcgtcaacaatctttgcctggctcatcggtaccattggttcgattttctgcacgcagtttgtgattcaggccatctcctcaaccaaagatgttaagtctgcgcagcgttcaacctggattgctttcctgttctgtatgccgattgccctggcgattgcggtgatcggcgtggccgctaagtatctgcatcccgacattaacagcctgtatgcaatgcccgtgttcctgcaggacatgaacccgtggctggccggtctggtgacgacctcgctggttgcctccatctttgtcagcgtcagtactgtagccctggcgattgcctcactggtggtgaaagatttttatgtgccttacttcaagccgtcacctgagcaggaatttaaaactacccgctggttatcgctgttaattggcttcctgccgctgatttttgttctgttcgtaccggaagtcctgaagctctctttctttacacgtgctattcgtctgtctattaccgttgtcgcggtgattgctttctacgcgccattttacagaagtacccgtggcgcaaacgcgggactgattggcgcctgtgttgtcacctccatctggtatctcttaggggatccgtttggtattaacaacatgtatatcgcgctcctgacgcctgcgttaatcatggctatcgatcatatgatcccaagtaaagccagaacccaagccgctgaagacgcaaaaactgcagcaagcaaaggagaataaaatgactgtaaccgtaattcgtgatggccatgtgaagccatgggaaaaagatggccgagtgctgacggcaatgttgccttcgtcgtgcccgcaaaaccacgcggcaaatattttgccgcttcacgatggttccctgctctgtgtctggttcggcggcacgcaggaagggattgctgatatctccgtctggtgctcgcgcttgccggcgggaggtgagacctggagcgaggcggtaaaactgtctgacgatccaacacgttctgagcagaaccctgtgctgtttctcgcgcccgataatgtgctgtggctgttatggacagcgcaggtatccggcaatcaggataccgcgattgtcagataccgccagtcccgcgatctgggtaaaacctgggggccgattgacaccctgttagataagccaggaacgttcatccgtcagcctatcaccgtgcttgagaatggtaactggttactgcccgtcttctactgccgcactcagccgggcgaaaagtgggttggtaatgatgatatcagcgcggtgaaagtttcgtccgatcagggcaaaagctggcgggatgtggtggtgccggacagcctgggttgcgtgcacatgaacatcaccgccttacaggacggctcgcttgttgccctttatcgcagtcgctgggcagataatatctatctcagccgctcaaccgacggcggtgaaacctggtcagcgcctgaagccaccgttctgcctaacaacaactcctcaattcaggtgacaacgcttcaaagcggcgaactggccctggtgtttaacaatatgagcgcggccggagccacggaacgtcgtgcctctttgtatgatgagatcgatgatggtgatggcagaaaagagccagaaactaccggccgtgccgcattttggggggcaccacgcgcgcccatgaccctggctatttcggctgatggcggcaagagctggccatggcagaaaaatctggatgagggcgatggttactgcatgaccaataactcgcaggaaaagcttaaccgtgagttttcctatccaagtatcaaacaggatgccgaaggcacattgcatatcgcttatacgtatttccgtcaggcgatcaaatatgctcgcgtcacgccagactgggtgaaggaatagtcagatgatgattggaaacctgaacgccctgccaatggcagggttaccggataaactgttagccctactccagttacccgaatgctcacttgaggcattagcagcaaaagacatcggtaagtggcaaccggaaaaggctgagtggttttgtaatattcagcaggccagcactcaggatgcggcattacgacatacggaatatcaccatctttgggctgatattcaggtgatgctggaaggggaagagatgatcaacgcgggaatgcagtcggtggccgataccggggatgaagagaaaaaacccgatctgtttatcaccaaccgaagcgatttgccggtgagcattgtgctaaaaaaaggagattttgcggtatttctgcccggtgaaccgcatcaggcactgtgtgcggtaaacgaaccgatgacggtccgcaaagcggtatttaaagtaccaaaatctatgttgggaggctgagatgcgtcacgctatcgtcactggatacagctccggaatcggcaaagccatcacacagcatctgctgagtcacggctggaaagtgaccggcctgagcagaacgcaaggtgagatgacatcaccgaaccttgactggattgccgttgatttaacggacgccgaccagcttaaatcggctatcagccatcttgatacgccggatgcgctgatacatgccgcagggatgatagtggccgcacccttgggtgagctggatggcgcggccagcgcgcgcctgtggtcgttgcacgttcacgcggcggaagtcctggtcaatcactttgcgccaacgatgcagtctggcagccggatcgtcattataggtagccgtacctcccggggtgccgctaaccgttcgcaatatgccgcaaccaaagcggcgctggtcggtatggtccgctcctggggaatggagctggcaccgcgtaacattaccgttaacgtcgtcgcgcctggcgcaacagaaacgccgatgctcaccaaacctgagcgcgccgcttcggcacctatagtgcccccgattggtcgcttaatccggccagaagaagtggcctcgctggtgggttatttactcagcgaacttgccgcgcctgttaccggtcaggaactggttatctgtgggggcgcatcgctgaaagcctgaagtgtgtcgcataacaacataaaccagcctttatcggctggtttttttatccgtcattaccctgaatgacgtcatcgacatagcctgctccccgaaggatttcacggccttgctcccttatggttgggcggcaccgcgctgccagtgctcaccgacaacggcatacctcttcccgttaaaattcttcaggttcgccgggaagcgggtcggtcagctccatccctttcacccccgcataggtaatcaccagctcggcaggcgtgttcagcgtaaagccgcgatgtgcgctgtttaccgtttcatttaacgcttcgccagcctgaaaggtttgttgttcaccggtttctttatcctcaaccacaagcgtgcctgacaagataaagcacgcattcggcatgggatgagtatgccacggcaatgaggtatgggccggaagggtcaggcgcatcaccgtcagttcgggctccccttgcggataagcttcaatacgctgaccgttccacgcctgactgctttttaatacctgcacggcgacgatttctgaatctgatgatttatcgggatgattccctgacatgtttgctcctgacagcgagtcggcgatgccgaaatgagtgacgtgtttaaacgtagctgattattcagcgtggtgtggcctgacttcataatggattttttcatgcagaggtcgttgagtcatggattatcctgtggtgattttttaaacaaatcaggcgttaatggttatatcttatatcgccacgtcagtacgcaaggctgagaatttgtattaggcttttgacatcttttactgatgggaatagctactaatgaaaggtttatttacggcgctaatcgccagttccgtattattattgtccgcctgttcacctgataatgatcataaagttaaagtcgcgataaacaccggtcccgatgaagcgatctggcaggaagtgcaaaaaattgctaaagacaagtatcagctggatgttgaagtccttaacttcaacgattacgtgctgccaaacgaagcgctcaataataaagaagtggatgccaacgcgtttcagagtcttccttaccttgaagaacaatccaaagagcgtggctacaaatttgccttcgtaggtaaaacctttgtcttccctatcgctgcttattctcacaaaattaaaaacatcagtgaacttaaagatggcgataccattaccctttctaatgaagccacgacgctgggccgcagtctgctgctgttgcaggcgcagggcttgattaagctcaaagagggcgttggttacttgcccacctcgctggatattaccgagaaccctaagcacctgaagctggttgaagttgatacgccgcagttaacccgtactctcgacgacccgaacgtcacactttcaattattaataccaacttctctgctcaggcgggcctgtcagcccatcgcgacggattgtttatggagagcgcctcatcgccttacgtcaatgcgctggtatcacgccaggacaataaagacagcgataagattcaaaagctgaagtctgctttacagtctccagaagtcgcggctaaggctgaagaagtctacaaaggtgatgctattaagggctggtaaacagcctgtcggagcaggccgcttagttggcggcctgtaccggcaagtgctaagccgccgcacctttggtttgtgtcgacagatgcccggcccacaggtgggcaatccatctgacgcctttagcagtaaaacgcgcctgagagaaagcatgctgattatccgccgtgcctgaatgcagcgtaaagtaacccgcctgaagatgataatgttgaggcgtcagggttcccttgtcacggaacatgatattacgctccagcaggaactgacggaaatcagcctctttggctttcagcattttacacagctggcgaaaacccagagaggtttcgacgttaacaaagtcgtcaaaaaaagcggctttaggtgctgactccgccaactgcttctctgcggcccgccgctgttcaaactgttcagcccaggcacgcgccgcttcagcgggattggtgaagtcaggcagatgaatgcgttcttccagggcttgccaacggtcaagcgcatcggcagtaaaaccgggcgaaagccgggcgacggcaagcagggagtcgcgtttattcaggcagaactcctgacgcatctcaccctgccgctcatagagattgactaaaagcggctgggacaggcgctgcgccgtttcaaggcttttgattaaacgtttgacttcaccgtgcgtgttcccggtcatttgggcaatttcacggctggtcatggtaatggcatgatccgttgctttgaagatttctgtcgacatcatcatgggctttaccccctaatcattccagacaacacccaacgggcagtggaataattatacaattacctgtttaaatatccagtagtatttttaagcagacacataagtggaaagcgttacgcaaaaagggcgttacgacatcgctgttaaggctcctgcaaaagcaccccttgctgcactaagcccctggctattgcaacagtggatggctgtaaaagctcattaaaggtaagcagggtttattgacatcagcttataatgtcgcccttacgttagtgacttcacctgcattccgccctcaggcggccaggtttattaagaagtgctgagcgaatctgtcgtgctgcgcatcagacagctttattttttatttggtagaaggcgatcgttttgcgatttcacgggagccggatgtcacgtttactggagtaagttatgcaaccgttaagagtcgcctttatcaaggcaaactggcacagcgacattgtttctcaaaccctggttggctttaatcaggaaatggagaacagtggcacgccttacgcgatcaaaacctgggatgtgcctggtgcctttgaaatgccgttactggcacagcgcctggcgcaaacagggcaatttgacgccatcgtctgtgcggcattggtggtagatggtggaatttaccgccacgactttgttgctcaggccgtggtcagtggcttaatgcaggcacagcttgcaacgaatgtgccggtattttctgtctcactgacgccccataattttcagccttccgacgacttcattgatttctacacggcgcatttcgtgaaaaaagggaaagaagcggcacgcgcggtctgtcaggttcacgccatttcactttaaaacaggcgctatttcgtcacgccccgctctttgatgctattcagccgacaccctgcttttgtggtgccgctgagtctgtcaggatttcaggagacacaatggaagcacaacgtcagccgttaccgccgtttaccgatgtacaggatgcgataaagaaagttcgcctggcagaagacgcctggaacagccgcgatccggaacgcgtttctctggcctattcacccgacagcgcatggcgcaaccgagataccttcatcacgggccgggccgaaatcgtgacatttttacaagacaaatggcaacgcgaagccgagtatcggttgattaaagagttatggagctttcacgcgaatcgtattgccgtgcgttttgcctatgagtggcacgacagccaggccaactggttccgctcctacggcaatgagaactgggaatttgatgagaatggtttcatggtgaaacgttatgccagcattaacgatgtagctattaccgacagccagcgactgtttcactggcctcagggccgtcggccggacgatcatccttcactcagcgatttggggctttagccacgcatccctgatgctgtttctgttatccggaacgccacatgagcagattattctctttaaaaagagaacaatcgtcatcacagggcggtctgatacagatgataagaacggttacagaatgaggtggccagaagcgctggaagcggttgctgagcgatcagcatgatgacgacagcaacctgaaattatctgtcttcatgcaaacatcaggcttcagctgggtgccctaagctctctctgcccctcaagattgaatcagccctgttcctgctcttgtggctgtggttgcggctgttcagtctgttttggctgttcaacaaacgtcgccttattacgggtcaccgtgtaagccacctttttgacatcatcaggtgacgttgtcacctcaagtggatcgatagtcacacgtcccaggccaaacagcgtgcgcacatagccaccgacttcgtgtttacccgcagcaacatgaacaatcttgctttcaccatttggcagttcgcctgcatctttgccatctaccgtcagataaatatgcgatccgtcatcagcacgcgtaatgacgtgtgaaacatcaatctgcgttggaccggttgtaaaatcatcggcagcaacggcagcatcagcagtggtattggcggcaggatgtttagcacatccggctaatgtggtggcgaccgcgagtgcggcaaaaagattacgataacgcattatgactgtctgactccgtggcaaatgagcgcatcattttagcggtttcagcgcatgatggaagcccgcaaacgctcggtatgctcttaaaattgtcagtaaactatgggaaaggtaaccagagtggtcatggcaggataaatcacggcagcaatgcgcgtttcgggctgaggttcgcgtggaatacgggcagtctggcgcactggcgccagacttttatccgatcagctaaacaccatgccaccgtctaccagtaacgactgtccggtgatgtaatcagagtccgggccggcaagaaaggcgacacaggccgccacatcctcaggctctgacaggcggccgagcgtgatgcgttttgcaaactcctgcgtgccataaccggcaggtttgcccgccgcttcggaaatttgccgatcgatttctgcccacattggcgtgttaacaatgccggggcaaaaaccattcaccgtgatccccgcaggtgccagatcccgagccgcagtttgtgttaaacctcgcacggcaaacttgcttgagctgtacactgccagttcgggattgcctacgtgcccggcctgagaacaggcgttaatgattttcccaccgtgcccttccgatgcgaacgcttttaccgccgcctgaatgccccaaatcacacctttgacgttaacgttgtaaaccttgtcgatgacgtcttcggtgatttcatcaatcggcgtggagggtgcgacacccgcgttattgacgatgacgttaaaatcacccaagacgcggcgtgcttcttctaccgcatgaaatacctgatcccgttttgacacatcaaccttgatggccagcgcacggctgccttctttttcgatcttttccgcgacccgagaagcggtttcgatattgaaatcagccactgcaaccgcaaaaccgtctttagccagacgtaaggcaatggcttcaccaatgccctgacccgcacctgtaacaagcgcaactcgctttttcatcatcgtttccttattccattttccattgaaatcaaagcaactgactgaggtgtagctgacccatcagcaagtggttatcggcataatccaccggcaccgccaccacagccggcccctgcacatccatcgctttgcgtagcgttggctcaagttcagatgcactgttcaccgcgaaccctgctgcaccgaatgcctctgcataagctttaaagtcgattgggccaaagttcactcctgaaacacgctggtatttcttctcttcctgcatcgccaccatgttgtaagcattatcgacccagacaatgtgcaaaatattcgctttcagcctgaccgcggtttccagctccatgcttgattgcaggaagccgccgtctcccgaaaccgagacgaccttgcgctgtggatcgaccagccaggcgccgatcgcccagggcagagcaacgcccatggtttgctgtccgttggagatcatgatttgccgtgcacggaaactgtagagatagcgggcaatccagatatggaagctccccatatcgacggtcagactgacatcgctgttaataatgtcctgcatcgcgcgaacgatgcgcagtggatgaagggcaaactgattgaggcttgccccctgcaaggcaagtaactgccgctgttgctgacgatcgtccagtacgcttgcagcttcatggctgagttgtaaaggatgggtgatacgttcagccagtttacgcagagtctcggcaatgttgccgaccagttccgcatcaggcaggtagcggttatctgtttctgcgggcaccacatcaatgtggactaacgtcgcattaccgctgttccacatcgctggctcatattcaaccgggctgtaaccgatggtaataatcaggtccgcctgttgcagcagcttgtcaccggcctggttgttgaaaagcccaacgcgaccggcaaaacgggaaaagtgttcctggcgaatggcacctgcggcctgataggtactggtgaccggaatatggctgcggtttaacagatcgtgaatcgcctcgctgttctcaggctggctggccatcaggcccagtaaaataaccgggtttttcgcgttggcgatttcacggctgaccgcatcaatcatgatgtcaggtgccgcgcccaaggtgatgcggcctttactggtgagcactttacccgttaccggctgatcaacaatatcctgcggcaggctgacaaatgcaccgccgccgcgtccatgctctgcatgacggaacgcgttcgacacgcattccgccagcgcagaagaatccgtcacttcgaccgcatattttgtcaccgggcgaaacatggagacggtatccaggctctggtgaacctgcttggcgctgtcggagcgtttgaccgcaccgccaatggccaccaccggatcgccttcactggtggcggtagccataccggtgaccaggtttgaacagccaggaccggatgtcaccagcgccacgcccgcattacccgtcagtcggcccaccgcagcggccataaaagccgcattggcttcatgccgcacggggattgtttgaatagtcgaatccagcagagaatcaaataccttatcgatttttgcccctggaatgccaaacacatggctgacgccctgcgcttcaagttgtgcgacaaccaagtcggcaccgcaggtccagagattcgtatcagagagagttttcatattcagacctcgtcattagctttcgacagaacggattgcgtcatccaggttttctggcgtcaggttggcattaagaaagtcgctgttttctggcaaatcgatgaccagtgtgctgatggcaccaaaggtcagcgtgccctgctccagcacataatccaggatatggccgccaccggttctgtcgtctgtgatgaaatgttcgtgatagcccgcaacattgataccttgcatgtactgcggcgtgcggaaaccaatgagttcaccgctgcggtgggtgaattcaaatacgggttgattgcccaggacttcaggcatcgatcgataggggcggcactggcacggaacggtacgcgtctggactgaggaaaaatgtccacttacacgcagtgcacaaaactgattatctgacgtgatttcactgtcaataagctgatgcagctcatcgcgttgcaccgcacgttcaaagacatgtttatgctgcggctgaaaaaaggtcattaccgcaaagggggttttctgatcgggatcggcaggccgggcactgccatcggcgcgcagctgataaacgttgctgtcaaaagcaatcagttcgccatccagctgattaaaggttcccaggccaaaatcgcccttacgcaataagtccgcaattctggtttcaccatcataaaccccactcagtagcgcactcatcagagaggtttgatacataacgctttctggcatgtttttctgcagtctctggacagtatcttttagttgatcctcgcaggaacaatcagttacaaaattgctcatcggatgcctcataggttaactgttaagccgtgttaacataatggtggccctgtttgatgacagaatccaatagcaaaacctgttaactttgagacgtttttaatatggaactgcgccaccttcgttattttgttgctgtcgcacagacgctgcatttcactcgcgcggccgaactgcttggcatttcgcagccaccgttgagccagcaaattcagcgactggagcatgaaatcggtacaccgctgttgaaacggctgacgcgcggcgtggaactgacggatgcaggaaaaacgtttttgacggatgcgattgaaatcattcaactcgccgatcatgcgctggagaaggcgaaaggtgttgcccggggaattagcggcaaaatgtcgctgggctttgccagttcggtggcgtttaatcctcgcgtctttgagattatacggcggtttaaagggcgttatcccgcgctggaattaatgacacgggaagagaatatgtcattacttattcaggatctgcaggaaggattactggacgcggcctttattcgtctcccctgcgaaagcagtaagccctttaatttacgtgttatttctaccgaacggatggtgctggccttaccggcgacgcatcgcctgcagcaaaatccctgtattgccttgagtgagctggcacaggaaaccttaattattttcccgcgcgacgtttcacccagcctttatgagcttatcgtcagtgcctgtttacgcgcaggtttcaccccttcatctttccagcaggcgccgcaaatcagttcttctcttggcatggtgggcgcaggttgcggtatcgcgcttatcccggaatcgatggtttgcgttcagaatccacaggtgtgctttcgcgaaattgaaaataataccctgttcacggatgttgcttttgcatggcgacgtaatcatacatccaaggcggtcaaccacctgttgtctctgatggccgagggcgaaaaaacaggctgatggaggcgttaacagagcgccagcttgctggttaaccatccctgaatacaggcggatagcgttgtctttatccgtttaaacatatgagtgaacccggatgaaaacaccattagcaatatcactctgttttatcttcccggtcgtttttgcgcattgcgcaattttcagcagagacggtcgcgggcattcttttacgaaacataaattcctaccgctttattaaaaacgcaggatgtgcaggtcacacattatttaacgcatgaacaaagagtgcgctgtgcgggtatttatgccggtttggtatggatcgctgcaaacaggctgaggcaccgcgtagtcttcactgccggcgtaaaccgtgcacagccaggacaacgccgcgcgtcagcaagattcatttttaacgttaaaacctgtattccagttcaggtaaagagaaccttcgccctgtcctgcgcttaatgtaaaagggtgcgctggagacttaattgaatagatgacggcgtaaaacaaatcacgttgtgttattcatgcgcctcttcgcattagcgaaacaacgcttcgcattacttttatttatgcaccttactggtgcaacaaagtcaatatcatttgaaacaattccttaactttttgaccctcttcaaagaactgataaatagtcaaatttttaatttatgcattaattatgcgttctttatgcacaaaacagccgaccttaaggcaggtaatgggcgttattattcactcttattcaccaggaatcgatatagcatggggataatccctgcctggtcgacatcaaattttttctggtggtgataaattatgtcggcgcgctcaagcgcgtgtcgtttccacggttcaacacaataaataacttcgataagaaaggttttgtatggataagttatcttacgcgtctgacagtagtacttcagcctggtccacctacctacaacaaatcgatcgcgttgcgccttatttaggcgacctcactcgctggattgacactttacgtcatcctaaacgtgcattaatcgttgatattcctttgcaaatggatgacggctctattcgccattttgagggttatcgtgttcagcacaacctgtcacgcggtccgggcaaaggcggcattcgctatcatcccgatgtcgatttaaatgaagtgatggccctttcagcctggatgaccatcaaatgtgccgccgtcaatctgccctatggtggcgcaaaaggcggcattcgcgttgatccgttcaaattgtctgaaggcgagcttgagcgattaacacgccgctataccagtgaaattggcatcatcattgggccacagaaagatattccggcaccggatgtgggcaccaacggtaaagtcatggcctggatgatggacacctattctatgaatctcggcaccaccgtgaccggcgtggtcacaggcaaacctattcacctgggcggctctctgggtcgtgaaaaagccacaggtcgcggtgtatttgtcacaggccgtgaagtagcaggccgtgcaggtattccaattgaaggcgcacgcgttgccgtacagggctttggtaacgtaggcagtgaggccgcgcggttgttcagccaggccggtgcacgcgtggtggtgattcaggatcataccgctacgctgttcaatgccgacggtattgatatggatgcgctgacgcaatggcagattgaacacaagcagattgcaggctttacgggcgcgcaaagcattgagaaagacgccttctggcacacggaaatggatattctgattcctgccgcccttgaaggtcaaattacccgtgaacgtgcggagattctgagttgtaagctggtgcttgaaggcgctaatggcccgacctatccggacgccgatgatgttctggccaaccgcggtgtgattgtggtgcccgacgttatctgtaacgccggtggggtaaccgtcagttacttcgaatgggtgcaggatatggccagcttcttctggagcgaagacgaaattaacaaacgttcagacaagatcatgacggaagccatggttcacgtttgggaaaaagcaaaagagaaggactgctctctgcgtaccgcagcctatatcgtcgcctgtgaacgtattctcatggcacgtaaagatcgcggtatctatccaggctaatcccctctaataaaacaacccgcagcgcgcgggttgtttttattttctgttttgcccgatatcaacggaactgttctaccgtttgcgccagctgctgggcctggtcttcaagtgaactggctgccgcagacatctgctgtaccagtgcggcgttctgctgtgtcgtgccgtccatctcgttaaccgcgatcgtgacctgaccgataccgcgcgcctgttcatctgaggccgacacaatctcatcaataatactttgcacagaagagacagccttcgtcatctcgtgcatcgttttccccgcctcgttgaccagtttcacaccgctttgtacgcgaacgctggattcttcaatgagggccgcgatatctttaactgcgctcgcactgcgttgcgcaagattacgaacctccgaggcaacgacagcaaatccacggccctgctcgccggcacgcgccgcctcaactgccgcgttgagcgcaaggatgttagtctggaaggcaatgctgttgatcatggtcgtaatatcaccaatcttcttcgaactgtcatcgatctgcgacatggtttgcaccacttgcccaaccagcgtttcaccccggctggcgatagaggtagcattttcggtcagattggtggcttgctgcgcattgtcggcgttcagccgaaccgttgcactgatttgctccatgctggccgcggtttcttccagggctgccgcctgttgttcggtacgcgatgccagatcgaggttaccactggcgatctcgcttgcaccttctcgtaccgatgcgctggcatctttaatctgacccacaatagattgcagctgacgttgcatcgtatgcagagcataaaacaggctggtattgtcgccgggtgccaccgtgatggcgttactcagcttaccgtccgcaacggccagcgcgattctggccgcttcggctggctcaccgccgagcgggcgcatcactttgcgattgaacaataaccccaggacagccccaaccagcagaatgctcaccagcatcagtccgatggcccagtagcgttgccgattcgccgccgccatcacctgactgaccggtgccacaatgccgacgtaccagggcttatcgctgttacccaccgttaccgggtaccaggtgtacatggccttctcacccagcaacggatcgtcatgctccacgatctgttgagtgaaattgtctttctcacctttccaggctttaccagcctcatctttatctggtgaggaaaccactttaccgctattggaaagcagtaacgcataaccagtaccctgccacggcttaatctgattcactttcttttgtaacgaggccagggatatatcggaggtaacgaccgcatagagtttgccctgatcgacaatgggcgaggccaccgaggtcaacaacgtcggcacgccgttataggcataactgtagggctcaatcagcgtgtctttctttgtctgctgcggcaccagataataatcgccctggcccggcgtcaaaaaagaaagtaacggatgcatagaataattaccggactgatcgcggtcgacaaaccaggcatatcgcccctgaggcgcctgccctttctgcgtggcaaaatctgcgtcccgaccatcaaaagcattgggttcaaaaataacggacatggagagatagtcagggttggccctgagtgtatattccataattttgtcggcaattttacgatcgttaacgcccgctttcggtaatgcgataaggctttgccctaagctgtgcgccatattaagggcataactcagctcttgctgaatttgcagtccacgactttgcgcaatctgctgcagatatttttccgccagcgttttttgttctttcgccgactgccagctcagaacaccaattgtgacggtaaatccaagcgtgatggttaagccgcccgccagcagcatctgcgtgcgggtactcatcgttttttttacgggttgagtggtcatactgattcccctggaatataccggctaaattgaccaccctgtcagatacaatctgtcgtgtccctggaagaactatcggcgtgtcataaatgaactttaataagattgatgcatacccgcgccggatcacatagcccgtcgaacgtaacgtgaggaagtatgatttcaaaagacaatgcggaacattctgtgtggggaaataactgtgatggctggcattttgtgaaaagccaggatctgagcattatttatgagcatatgccgcccgccacctctgaaacacggcacgttcacagccgcgcccgtcagttctttttatccttgagggccagctgacgatggaaattgagggcgttgtacatcgcctgcaggctcagcaggggattgaaatcccgccgggagcccgtcaccaggcgcgaaacgacagcagtgacggcgtcacttttttagtcatctcccagcctaccacgcggggcgatcgcacagatttaacctgagttactgacgggaaatgcgcatcaatccattgctaatatcgatagtattgatgtgaaacaataccgcatcaggaataatatgtcagtttacgtcacccctttgacaggacataactgaaccggaaattgaccatgcttaacaaaccaggcaggtttcatggctatacgctttgcctgacgtgcattgccagatatcttcatcactatgcttttgccgtgacgcacttgatacgctaatgactgacatacaacacatttttgcggaagggagttacgaatgatatcagaacgcgagagacgtaaagcggtacgctggaagctgacttccagcgtaaaggatcaggcggctttaacggcacgcacctttttgtcgttttgagcaggagaatcagcatccgcgacatccgttgcgctgtcgaccgttacggactcgggtaacttactggtgcgaaggatatgttgcaccgcctctttttgttctgccagcaacaagcctaatgattcagcctgcgattcgtccatatcagcctgatgcgtcagcagccagtcggtgaaggcttccgccatatccagcatcttgtcgtaggcatcagcctcttttttgttggcaaatgtcatcttctcttcaccttttctgaccactacaaattttgtttcgacagccatagtttttgccctcaggtactgtgtattcatacagtctatcacagtagtccgcgttttccagagaagaataaacactaccgctaagacggaggtcgtccgccgtttttaccgtgcaccggttgaagcggtctgggttattaagccagtaactcttccataaagtcagccagggctttgcggggatcgtcctcttctgacacgatcatttcgatgccccactgacccaagacctcttttgccaccgggttattgcgattagtaaagaggtaggacttagggcgcgcggtggccagtccagtgcgtccccacattttcgtcaggcgataaaacaacagacgaatattaaaatcactgatgctgtaacccacaaataatacggaattgcccatcacatcatgcgtcagcttgatatccagtggcgaatcaaagtagaggcgctcaaaatagctactttcatctaaaacaatggaagtatcgtcgtcgaaatcaccatgaagtttgatgatatggcgcttatcttccgttaatgagaccaagtcagccgcgttagccactttaaaatagggtacgccgtgcgcctcgtgcgccgcctctaaccacctgtcatagttggtggtgtaaatacgggagaaattgccctgagtaatcatggtatgaatttcagagctacggacatcgatatccggccgatgccattcgcggtccatccaacttcttaacgggccaagcgatccttttttctgcttgtagtactccgccagagagagatgcgtcccataggtattaaaaatcttgggatcgtaacccagctcgttagccagatgggcgatgagttcatgccattccggcaggccgagattgcgggaaaggcccgcaccggcaaacagtatcagcttaccggaatcataagcccgttttagttcaggtttcatgccacgcctcgtgcggttttcaggaaggacgcgaagcggtccagcgcaatgcgacggtttgaaatttcgtttttcttgtcgcccatttcagcaaaggtttggtcgtaaccttcggggataaagacgcaatcccactgaaatccccggggacccgcaggctttggcgctatcgtcccgcgcaattcaccgtaaaactgatacattttgcgcccatcacaatagccaagtaccgttttggccgtgacgccctggctgtccagcccgttaaccagggaggcaaaacggtcggcatccagtcggttccagaaaatacgcgtcagaccggctggcaggccattcagaccatccagataaagcccggtatgctcgacgaaaagaggacgtcctataatagaaaaagctttggtcagcttatcgcggactaaatccagctcgttctccgtttgaatttcttctatgcgacgtgcgatcggtaatacttctacgcccactggctccagtattccgcgaacctctgccagtttttgttcattggccgaaaggaatctgattttcatacttcttccaggttaattagtttgcctcaaacagcaccatgatagcggcagaacacagggttaacgctggtcagtgtagcgcaaatccggggctttctgacgtgaagattgcatcaaaacgtgatggatcatggatttgcagttggcagaggcgagcaaaacaccgattgctgaaagcgcctcgcgtgaggcgcctattgaagaggctgtagactgttcagaagcgatagctggcggtgacagacacgttgcgaggttcgccgtaaacgatgtctcccgcaacgttggtgtcataggttttatcaaaaaggttattgatgttgccctggacagcaaaatttttagtgacctgatagcggctgaacacattcactaaggcataactcccctgctctgcacgccatgtccccttgccttctggtgcggagttatcactccagacatgggtttgccatttcacaccgccgcctaccgtcaggtcaggcagcatggataaacggtagcttgtaaagacgctcaactgcgttcgtggcagatcgggctttaacgccgtgccctctcgctgttctgcaatataacgggtgccacccaatgtcatttgccagttatcggttattgcgccattaatttcaaactcgaccccgcggctgaccgtgccatttttaccttcataagctgactcagtggtccccggaataatacgccccgtggtttgcgcgacattatccagctcggcacgaaacaccgataacgacgtcgttaaacggctgtcgaaccagtcagatttgacgcccgcttcataatttttacccataaccggtgccagataggcgcctgagatatcacgataggattgtggctgaaacacagaggtgtagctggcgtacgttgaccagttctcatcaatgtcataaatcaaaccggcataaggcgtgatattatttttttccatatcattggtcagggtgtttttgctccaacgggtataacgcgcgcccagtatcagatttagcggatcggcgactgaaatacgtgtcgcaaggtaacctgaagtttggcgggtaatatcctgttgggatagcgtgcgtggctcccagtccgtttccgggaactgaccatcaaagagattgaagtcacctaattccgctgaagagatattggcaaaggtaccgtaataggtgtttttctgcctgctgtagctgacacccagcattaattcgtggttacgtccaaaaagttgataagggccactggcaaaggtgtcgatggcatcgactttacgttttgccgaattatatcccgtgccgcctacgaccggataatcagcataaggcgaaacgcctgcgccggtatttttgtcgaaatagccagcgatatacatcattttactgttaagcgtggactggtcgtgcgttccgtttaaagtccattgccagccgctgtcaaaggtgtgtttcagccgggcaaagagctttctgctctctttatcgttataagtccagtcaggcgcggtattaaagccgcgacgataatcagtttttgtaccatcggtataccagcgaggcagtccgccccacattgggctgtcagtattgagttgctgaaattcatagcccgcagaaacggtggtggtattattcaggtccgcatcgatcacgccatagataaatttcttttctgcgccataccgctcaacaaaactgttattgtcctggtaacccgcaatcactctgccccgcacattgcctgacgctgtaagcggtgactgtacgtccatgacgtaacgctgcttattcctgctgccgaaactcgaagacacctctccctctggctgacggctgtcagcatgtttacgcaccatattaacggccgctgaaggattgcctgccccggttaataacccgtttgcgcccctgaccacttcaatatgttcgtacagtgcgctatcggtttgtgcatcgcccagattccagcgctcttcaaatacggtgggaataccgtcaatcagataattatcgattaaaaacccgcgagaataataggtcttgcgatccatatccgcggtgctggtctgaatggctgtcgtattatccagaacgtcattcagtgactggagctgttggtccttcatccgctgctcactgataatgctgacggattgggggatatcacgtaccgtcgaaagcaatttattgcccgcccgggttaccggaacgctgtaatccgatgctgtgttttcgacgacagggggttcagcagccgtgacgatgagtgtttggttattcactgccgaaacaggcgctgtcgttgcaaacacgttgtgtgacacgatcccagtaattaacgtcgtcaaaagtgaatagcgagagggaaccagagggaaaatcgactgcaggcgatcccgttgaacatgaagtgtactcaaaagcattgtaaacgcctcgtttcgttttttatttgccactgcagcgaatcagtccccaaaaactgccgcacagcctgagcataatgaataaggtcaaaagccatcaaacacaaaagcaaatgagaaatatacgcatttagattatcattgcaagttattgttaatatttataagtaatgattccagaaaagctgaaaggagtacggcattgataacgcgggagttttgctgaaagatgaggtgtagggtcaccagacaaaggccacaacaacccaggcgtttttaaaaggctggtaatttattgtacagcgagtgatgtcatcttatgaataaaatgattgccgggttccactcctgttttgatttcagtcccccggagaatgcctgggtaaatgccaggaaaaatcccatcgggtttccgctgcgatataggtataacgttatctaaagcggttattagtgattgaatttttattctgtcttaaccttattagcgcttcgcttatgatttagctcgccatacttatggctgtgatacagcgtgattaactgtcaggccagcataagacatcatgtatgtcacgtttgacgcctctgttaggcacaaaaaatgtattgatattgggttccggctggatgagacgtttatacctcgttcaaaaaaaagccgcgataaaagagccaatgggctaagccaatttgaagcagattccaacatgaatatcagggtttacttatgacaaatgtcactgtcagcgacaggcattttggtgcattctgacgatgcgaatgtttttctattaaatggcagatattattcactatacgttatcatttttctgcggggccgatgaaacccgttatcttaagggatctgcactactactggcaaaggcaagatggctttatgttatgatttaattgatttttctatttataaataaagtttataatacgtcttgcgcagaagatgctcactcctgagcatggctgtgctgcctaaatagggtttatgacatcaatgttttttaatacgttatgtctgtttgcgccccaaagaagtggtaataatcctaacagtaacaaatttgtacatttcagactgaagagatatttccttcctggaatatttttcgtagaatgaccctgtttaaatattcgctgtaatttaaggattaatcaatggatgcgctcaaagcattaaataaccttcgtattttacgcgcacaagcccgggaaattgagcttgatgtgttaaatgagatgctcgaaaagctttctgtcgttgtcgctgaacgccgtgaagaagaagaagccgagcaagccctgcagcgtgaaaaagcagacaagctggctaagtataaagaaatgctgatgaatgacggcattgatatttctgagctggtggatttgccaacagaaacgaaaacaaaagctaaacgtgcaccacgtccggctaaataccaatataccgatgaaaacggtgaaactaaatcatggacaggtcagggtcgtacaccatcgccaattaaaaaggcgctggatgcaggcggttctcttgatgacttcctgatctgataaaaaaagcggtgttgataacaacaccgctttttattggaaaccgtatcaatcatgctttacgggctcatagtcataacagatgagccgtctaattttagcggttcgccctcaaaacgatgacgtaaacaatggtaatcatcactgtttataattaattctaacgatgccgaatagttgtccagcgcagcccgcatttgcacaagatagtcgtgagtatcgtaaacccggtctatcccttctaacgcatgattcataatttttcttgccacgtcgttgggcgtatccagcgcagataatttcgaacgtgccgttcgacgtaaatctcgtggcgtaaagtgttccagccccaacccacgcggtgcgcgcagcatacggcgcaaagcctgatttaacgcgcctttagacagcggctgcatcacatcgcgcggtgccggcaccagccagggcgaagcgggatcgctggcattgagtaatgattcgatgcagagtcgcattaatgccgagacgggcaaagtatgttcgcgatgagacttattacgcgttccctgtttccagagccctgactgcaaattgaattctgacttgcgtgcctggacgatttcatcaggacgtcgcgcactgacaaggcaaaggcgcagtgcccaccgtgcctgctcagaaagcgcccagttgtccagaccatgccagaacacccagatctccgcatccgacaactgccggcttcgcggcggcgcagcgcgaccggcaatatcgcgtttcttcattgacgcaacgggagaatgttcaagataaccctgcatttcagcccaggataaaaactgtttcgttagagcaaagacccggcgcgcctcttcttttttaccctctgaaatcagtatgttatacaaacgatttagccgcagccgcgtcagatcttttaacggcagcgcaccgatattgggcaatacatgtctgagcagggaggacaccgcaatttcgggacgacgacgcgtcacaagtaatgacagttttacccacactttcatgacctgctcaactgtgccttcatcaccaaagttatctacctcagataacgaagcacttctgacctgattaagccacgccatgacgtgatgcccgacatggggcgaaacggtttttgtgcggatttctgtcactgcccttccctgatgataaagctgaaacgcggattctactcttcagatgattgtgactccagacctattaagtctggagtcacaataacgccgctacgcggattctgataaaaaagcaggggatatttgcgctgctgatataagccctgaatggcaacagaggatcaacgcagacaaggtagaaggagacgaaaaaatgcccgttaaatactgaacacatacgcacataccacgcctgttagatgcgcagacgtcatcatcaccgcgttttatgatgacccgttcttaaatgcggttttgcattctcagttatgacgctgagtgccaaactgaggagacgctggcgagtctcgcgctctgtttgacctgaacagcaatgctcaacggtaaatgtcgtttaaacaacaaagcgaaccgataatccaggacgccatcaggcaccatgacttttacgccactcctccaccatttcccgggacacgtcttttttataacagaggggagaatagccgcccggcttgctccatgcgctacgcttgccacaactgctaccgttgcgcgctgaattaaacgggcacgcgcaaacaccgggataggacgcgattgaatcctcaataatcagctgacgaatttggtcatccgtctgccggagagcctttgcgacagaactctcggcccacagtaaactcatcaccataaggcatgaggtaaaaatgaaatgttttttcatcacatccctcctgaattaagagggatagcgtaaatcaatatgtgaatccgcaatcgttcgaacaaagtaaaaattcatgcttctgtcaggcgacttgatatctccctaaaaggacgtcaacttttactaaatgtgtagttaaacactctgccattttttgtctgcactgtgagtgtttcacctgcagaggtatccagcgctctggctttgctgtatttccacatcagtaactgctgcccattggggtaaggtgtttccgtatcaggcgggccaaacatcgcgatcagttccgcacgtgttgtctgacctggcctgatattctgaacggtggcggtatcaaaattatgtcccactgagttagagcatgctgttaacgcgaacatcaggcctgtgatgaagaatgctctcataacgttgttcccggtaattacgaagtaagaagtggataagcgtgaccgtttcatcatgccgttttatgcggttcaggcaccttcgtgcccgtcattaaaatatcatcatctgcctttaaacatctcacctatcgtaatcatcctgactaatctgaaccgcttcttttttaactgatgtgccgagtgaaggcggattctcaggagtcggcccattgctgaaaagacggttaccgttatccagcactgacctggccgaatcagacagtatggccagcggtgataaaaaatttagccttcacggataacctttgtaccgccgacataatgcactcagcgtctctgttgccgattttcagatgtagagtatggttcaggatctgccagagggcttaaaaatcgcaatctggaaaacgggcctgacacaggtgcgctggcggatgaatattactgaaacgttctgacccgctgtgatttttttctttaactctcccttcataacgcgtagcctgtatacaaaacgtatatattccatataggcttcgtatgggcattgtcaaaatatccgatctgatgcatgaaaacctgcgcatcgccagccaggcgatgagccgctcgatcaacgctcaggctgagcactggttaaaactcggtatgttggccgagctgtatcctcaactgacacaacatgagctggctcaaacgttgatccgtatcgaaatgaacggcggcgcggatattcgccaggtgctacataacgccgatttagcctcacaaggagaagtgtaatggggaccgttaagatccattccgcagaagaaattgaaaaagcacgtgctgccggacatgctgcagcccaggttttggcaatgattaccccgcatgtgcgcccgggaatcacgactgaacaactggacgatatctgtcacgattttatcgtgaatgaacttaaggttacgccagccaacatcggctatcacggttacacgcgcacaacctgcacctctgtgaatcatgtggtttgccacggcatccctgctgccaaaaaattaaaagacggcgatattgtgaatatcgacgtagccgttattaaagatggctggtatggcgatacgagccgaatgtattttgttggcacaccgtccgtacgcgccaaacgcctggtcgatattacttatcagtccctggttgcgggcattaaaacggtgaagcctggtgcgacactgggtgatattggtgccgccattcagcgccttgctgaaaacgccggcttttcggtggtgcgggaatattgtggtcatggcgtgggcgagatttatcatactgatccacaggttcttcattatggtaccccaggcgaagggatgccgttgaaggcagggatgattttcaccatcgagcccatgatcaacgcaggcaaagccggcaccagcgtcctctctgatggctggactgtggtcacgaaagaccgatcgctttcagcccagtgggagcatacggtggcggtgactgagacagggtttgatttgcttacgccctggcctgaaggcactggcgactatcctgcaatctgatagcaaaagccgccttgagataaggcggcgttaatttctggctgattacagtatcggtaagctgatgttaaaccagtaaaaaagcgcccgtgctacaccgcttcatgtattatcaggcctgccataatttcagatcattacgccccgatcgcttaacctcatacagggcttcatcagcgcgtcgcagccattcatgtatagagctggctttttccgcacaggcaataccaatgctgactgaacatctgaactctgctgaagcaggcaagcgtaattgcgctatgtttcgttgaatggtttcggccagcctgacgatgttaacgtcatttgagtcacgtacgatcacgcccagttcatcgccaccaaagcgcgccgggatgtccttcatccctacgctgtcacgcagcaacccggaaatttcagccagtagaaaatcccctgcttcatgaccaaaggtatcgttgacgttcttgaaatggtcgacatcaataagtatcaggtacgccttactgtctccacgccgggtgcgcagaaattcactttcaagccgccgttcaaacaggcgtcggttaggaatttgcaaactggggtccatcaaggcgatcctttccagctcacggttcttctggcgcagattaaacgtcagattatgggataccacgcttagcgctaacagataaaacgtggccagcggtatcgtaagccatgccgaacggatgctaaattccatcaaaactggcgcgccctctattgtccataccatgataaaggcaaacagaaacgcctgtagtgcagagagaagttgtggccagcctccggcggcataacggtcggagaccagtaccgccataatgacaaaggatggcatcgggctcacggccatgagtgctacccaaataccgccgaaggcggcatcgagcgttaaattggttcgttctctggcggttgaatcacgtgatgtaatggcaagacaatatgccaggcagggccagataataacgttactaatcagtaagaccaatatggcgggttttttgcccagctccatcaaaacggatgcaatcggcaaagcgcataaaatcgtgcccagttggcgcatggcgaacatgcgacggacaaatcgcgtggatcgcatcttaagatgatgatcttcgggggagtaataagtcattcgcaagcgtaattgacggtatattcagcgcagtttatccataaaaaatgtaaaccgcataaatttttaagcgttttaccgctttatttattattgtttttactctgctcaatgctgattttgtacaggcagtttagtgagagtggcataagcccaacgataaacagaattatatcgtcaggcgtcagcatcattattctgtcgttatcttctgcggccttttgcgactgaagcagaccagttaaagtcgctaacttcactcgcggcaattgatgaaggtttctttttcctgaccggttttttgctctctttttctgcttttaacttttcattaagcagtttatcggccatcacctgctggcgggcttcagtgttaagctctttttcttttttgctgtcaggctctttgccagtgcgttgacggtgcttttccatcagattttgaagggcttcgttaacggcaagtcgctcttcatcactgaactgatcgatggaaatcatcttcttgtcattcataatcgctttcctcgtggtaagttcactagcagtgtacatcatgcggctgtcgtaaaacgcattacctgatacttaactgactcagcctgaagatttttaacgtgtgaagcttgtatcatttcctctcaggctgactaaaataagcggaaattttactgagaatccacgtaatgaatattcccctgcacagtgaccacaagccttttatcgaagccctgctggatgaaacggttgacgcgattgaaatgcactcgccccaggctgaacatatcgaacgcgctttcaccgttgcgcttcagcaaaagaaccgcgaagccgaggcagactggaaacgcacgataacctttttagcgttgttcgtgttcctttatgccgcgctgggtgcctcgttgacgctggacctgagcccagccggggcgagccataaaagtattgagtatgcgctggaagccgttccagtcctgattgcgttttcaggcttttttatctccgtcctgtatctgtttattgtacgcacgggttcacgacaacgtcgtaactggcaaaaaaccctcctgattttagaaagatacacgactggaaacctgtttaaactgacgcatcagcaaggcgccggcaccagtaactactcgctctcgtccatcatgctagccctgtcgatgttcatttgtctcacctggttgattatctataactatctgaccttcaccaccagcggcgtatttggcagcgtgatttccctgtttatcagcacgatggtttatgtgattctggatattcagctgctgaagccctggcgatcggatgctgaaacgcaaccgtcaggcaccgaagaagagaagaaagccgacaaataatccccatcagcccggtgtaagccgggctgtggatcgctattctgcaagacctgaaaaccacgcgtatgctgactctgggcttttgctactgtcacttacagtatgttgtaactataagcggcaacttttatgatgctttggtacaccgacgacgctggcacctgccgctgacagcgtcgtaaaaagctaatcattcacctttaataacatcattgatgtgacactgtcacacctatctgatatacgacctttgcctttatgggcacagcacaaatcccggcgttaaggcgttattcaaagggaaactcgcgcgccagaatccgggcaattacatttagcgccccttcatcctgattgctttcagttttaaaacgcgccacggcggataccggctctacggcattggccatcgcaaaactgaaacaggcctgacgcagcatttcaatatcgttcgcgctgtcgccaatcgccaccacctcacaatcgctgatgccccatttttgttgcagcaaagcaatgccatgtgctttatgacaaccaggaataatcaggtcgataaaaccatagccactcgatacgggatgcataatatgatcgatctcgccgagtttgttatgcaaacgatccatcaggctttcaatgccttcgtgcgccagattaagcgaaaatttaaaaatggtgtcgtcaatatcataaagattatcgcgcttttcgagccgataataatggttattgagcatctgaataacgctttcaggcatggaagaatgaacataagcgcccttacgtccacagacgaccgtgctgatatccggctcttttgccagtatctccaacacgcggtgcacgctttccctggccagctcaccacaaaaaatttcctggtcgccctctgacacccacgcgccattttcggcgacaaaggcgatttcatttttgatgtcaggaaagtagcgctgtagctgataatattgattgccactggcgacaacaaagcgaatgcctttttgttttagcagggcgtactggcgtgaaaagcgctgaacgttgtactgcttattttcgtccagaaaagtcccatccatatcaactgcaatcatccttactgccattgtcgttccccccttgtctcccggcctgaataggctgactgttgcttcaagcttactcgctgtagggattaatgagaattccaatcattaaatatccttctgttagctcacattgtgcgccagtcgcgattttacccatcagcaatctgttaaacataagttcatctttcgaatgtaatgaaaaaaatcttcatctgaaatataaactatctgttaagggccacaattatgactgtgaagcttcaacacacaccgttaccccacgatattccagcagcgatccgtcagtttaagcagcaggtgcgtcagcagatcggcgatgttgaaggcttattcagtgaggtttgcaataaaatcgagcaggccataagccaggccaaagcggaagaacaacagagcggcagcgcctggccggtgatttcacccgaacagattacagatggcacgctgccccctgagacacgagaaagaataaaacgtcgtggctgtgtggtcgtaaagcagcattttccccgagaacaggcgctggcatgggatgccgccatgttgcgttatctggatgacaatcagttcgatgcacagtatcgcggtcccggggacaatttttttggaagtctcgaagcctcccggcctgaaatttatccaatttactggtctcaggcgcaaatggaggcgcgccagagtcatgaaatggcacaggtgcagtcgtttctaaatcgcctgtggcgattcgaatccgaaggtcagcaatggttcgatccggatgtgaatcttatctatccggaccgaattcgccgacgtccgccgggaacaacgtcgaaagggttgggggcgcatacggattccggtgcgcttgaacgctggttgttgcccgcgtatcaacgcgtctttcgctcgctttttgacggcaatgttgagcgttacgacccatggaatgcagcccatcgtagcgaagtgaacgagtttgatgttcccgataccacaaaatgctcggctttccgcacgtttcagggatggactgcgctctccgatatgatgcccggtcagggcttactgcacgtggttcccgtgccggaagccatcgcctatgtcctgcttcgaccgttattatcggatgtggctgacgatgaattgtgtggcgttgagccggggcgcgtgcttgcagtaaatgaaaaatggcacccacatttgataaagggattatgctcggtaccggctataacggcgggcgactccgtttggtggcactgtgacctcattcacgccgtcgcaccggttgaaaaccagcagggctggggcaatgttatgtatattcccgctgcgcccatgtgtgataaaaaccgggcctacgcgcatcttgtcgcgcgcgcacttgagcaaggccattcccctgctgattttcctcctgagcactacgaagctggctggaaaaatcgctttaccctcgccgatcttaatctcaacggaaaacgggggctgggtttagcctgaaacccgtatcgcttaacgtcagcttaatccatggatgcaaagaaccacgatgaatacgcgtcagcaacaaattatcgaactggttaattcacgtggcagcgtcgccgtcagcgagctggctcagcttgtcggtgtttcagaggtcacggtacgtcaggatctcaaccaactggcgcaacagcgggttctgcgtcgggttcatggcgcggcccaggcgctggacagcgacgatgttggcacgcgcatgaacacccgttatggtattaagctggctctcgcccgctatgccgctgatctgatcaacgatggcgagtctgtattgattgaaggcggcagcaccaatgccctgctggcacgcatactggccagccgcaaaagcctgacgttaatcacggtaagccactatatcggtcacctgcttaaagatgcggcttgtgacgtgattattctgggtggcatgttgcaaaagagcagcgaatccataaccggcccgttaacccgctactgtattcagcagatccactttcacaaagcctttgttggcgcagatggctggcatccggaaaccggctttaccggtcgcgatatgcagagatgtgatgtggttgacgccgtgctggcgaaaggcgcagacagttatgttctgaccgacagatctaaattcgggcaaatacatccttatcccttgtcgtccggttatcagcctggccatgttattacagaggatgggctttccccggacgtggtggcccggctttctgagcaaggtatcgcgctgatgcaggtcgggatcgccgccttgcaggcagagacgtcagggggcaacggtgatggagtcgcgcaggacaaggctgcccttaaaaggcgttaacgtcgttaactcgccgccatccagcatcgaaaccagccggttaatggtctcgttaatcatatcggttacgggaaatttcacgctggaaagtgcaggaataatgtagggcgccagcgggatatcgtcaaagccaatcacggagactgttcctggcacagcgatattattttccgtcagctgtttgatggccccaatagccatttcatcattgctggcaacgatggcactgaaggattgtccccttgcgagcaaggttttcaccgccagcatgccgctttgcgcggtccactttccgtgcacaataagctgctgatttatggcgattccctgctcgcgtagcgcggtttgatagcccgaaagccgttcctgactggtaggtgaatccagtgatcccgtaataaacgcgatattacgatggccctgctccatcagataacggatggccatctggctggccatgtgctgatcgctataaacgcagaagctgtcattgatacgcaggcgacgattaatgaccatgacaggttgcttgtgctgcgagatcatcgcgtccagctcatcaatgctgagaaagcgcggatagataataatgccatcgcaacgcaggtcgagcagaaactggatagccgcacgctcctgttctgcggtgtgtttaccatcggccaggatcaattgacgattttgctgctccataattctggcagagtgcgacatcagctcactaaaaatgttaccgctgtaaagtgtgttggtgaccaccagcccaatggtttggctacttttattcgccaggttgcgtgccagcagatttggccgatagcctgtctccgcaatggcctgtaatacgcgatctcgtttctcctgccccacataaccattgcccgacaacactcgcgatactgtcgcttttgagacgccggcgcgttttgctacttcagatattgttgtcatgttctcgctgcccgtgtcctcagagtaaatgcagtctacctaagcctttcattatttgaaatatttgcccttagcccggcatggcgctcttttccacttcaagtgattgccatcacaaaaataacagatggtcattttacgctcttgtttaaacagtaaaacatcttcatgattttgtgaaaccggtttcctatttagctgccccttcggtcagatacaacctgagtcaggctgactgaaggcgtataacaataaagcggcggctccagcggaaacccgagcgcattttcctctaccctacgagataaaatcatgccaggaaattatgcagagatttcacaggctatcgttaataagctgggcggcctgaacaatatcagtgccgtcacgcattgtatgactcgcctgcgttttgtggtgaaagacgatagcctggttgaccttgccggattaaaaaccctcaatggcattatgggcgttgtgcataccgatacacagttgcaggtgattattggcaatgatgtgtcgaaagcttatgaggcagttttggcattgggcgatccgcagtcagacggtactgcgcccaggaaacggcgactcacgctaaaaagcgtgggggccgctattctggatgcgctggtcggcaccatgtcaccgctgattcccgccattatcggcggttcaatggtcaagctgttggccatgatcctggatatggccggtgtatttgagaaaggctcatcgactctggtcatattgaacgtgattggagatggtgctttcttctttttgcccattatggtggctgcgtcagcggcgcttaaattcaagacgaacatgtcactggcgatagccatcgctggcgtcctggtgcatcccaactttattgacctgatggctaaagcggcgcagggacaacccgtggagtttgctttcatcccggtaacggccgtgaaatatacctatacggtaataccggcgctggtgatgacgtggattttgtctcacattgaacgtggtgtggatcgtattacgcctgcggtaacaaaaaactttctgaagccgatgttgattgtgctgatcgccgcaccgattgcgattgttttgattggcccgattggtatctggatcggcagtggaatctccgccgtggtttacaccattcacggttatttgggctggctttcggttgcgattatgggcgcgctctggcccttgctggtgatgaccggcatgcatcgggttttcacacccactattatccagaccattgctgaaaccggtaaagagggcatggttatgccttcggaaattggcgctaatctgtcccttggcggctcttcgctcgccgtcgcctgtaaaacgaaaaacccggaattacgtcaaaccgcgctggcagcagcagcctctgccattgtggccggcatttctgaaccggccctttacggtgtcgctgtgcgtttaaaacgccctttgattgccagtatgatcagtgggtttatttgtggtgccgtcgccggcataggcggtttggccagccattcgatggcatcacccggattgtttaccagcgttcagttttttgatccagccaacccgatgtccattgtttgggttgtcgcggtgatggtgctctctgtggtgctgtcatttattcttaccctgattctgggctttgacgatattcctgaaaccaccagcctggcagcatcacaacctaaggtttcacctgaaaaagcaaaagcggctaacgctagctgatcattaatgactgtgttaaagaggatttcatgtctgaatcacgattcccgcaaggatttttatggggcggtgccttatccgcaaatcagtcagaaggcgcttttcttgaaggcgggaaaggattaaccaccgttgacatgctccccatcgggcctgcacgtatgccggtcaagctgggtcaggaaaaacgtgacgcactgcgggacgatgaattctatcccagccacactgcgatcgatttttatcatcgttatcgtgaagacatcgctttaatggcagaaatgggctttacggtttttcgcacgtcgattgcctggagccgtatttttccgcgcggcgatgaagtcacgcccaatgaagaggggctggctttttatcgtgacatgtttaccgaatgtcgcaagtacggcattgaacccttagtgacgctttgccattttgatgtacctatgcatctggttacgcaatacggttcgtggcgcaatcgtaaaatgatcgatttttttgcccgttatgcacgcagttgttttgaggcgtttgatggtttagtgaagtactggctgacctttaatgaaataaatatcatgctgcacagccctttttcgggcgcaggactggtatttgaaccgggtgaaaacagtgagcaggttaaatatcaggccgctcaccatgagctggtggcaagcgcgcgggtgacaaaaatagctcatgaaatcaacccggataatcagattggctgcatgctggctggcggcaatttttatccctggtcgagcaaacctgacgatgtctgggcggcgctgcaaaaagatcgtgagaacctgtttttcattgatattcaggcgcggggtgcctatcccgcctactctgctcgccttttccgcgagaaaggcatccagattgaaatggcagaagacgatgctgatgtactcatgaacaccgtcgatttcgtgtcattcagttactatgcttcccgttgtgcgtccgccgatatgaatgagcagaacagcagcgcggcaaacgtggtgaaatcccttacgaatccgcatattcagcgtagtgaatggggctggggcatcgatccgcttggactccgcatcaccatgaacatgatgtacgaccgttaccagaagccgcttttcctggtggagaatggcctgggcgcacgcgatgaggtcaatgatgaaggcgaaattattgatgattatcgcatcagctatttgcgtgagcacattcggaccatgggagaggcgataagtgatgggatacccgtaatcggctacaccacgtggggctgtattgacctgattgccgcctcaacgggtgagatgagtaaacgctatgggtttgtgtatgtcgatcgtgacgatcgtgggcaaggcacgctggcccggcggcgaaaaaaatccttctggtggtataaaaaagtgattgccagtaacggcagcgatctggattgacggcacaacgcgcattcaccttattgctgcccgagtgcgcgttgtgcaaaacgcgctgtactcagcttgactgaccgtactgagaaggcgacagatactgtcgcctttatcgcgtttacttctgcagtaaccagtgttcgatatcgctggctggaagcggtttcgaaaagaagtagccctggatttgatcgcagccgtactgcttcagcaaactcagtgtggcttctgtttctacaccttctgccaacaccgtatagtccaactccttcaacatctggataatgcttctgacgataattctggaggcagaatcgctatccatccgactgattaaagacatatcaaccttaatcacatctaacggaatttcctgcaggtaactaatgttgctgtaacctgtaccgaaatcgtccagtgagataataaacccgtgggctttaagcgcttcgagtccattaatcgccacatcgctttccgttatcagctcattttccagacattccacgcccattaatgatgttggcaattctgcagcctgcatcttactggctaaactggaagcaaactccgctctggaaaagtcacgttcgctgacgttgacggataccgggattaattcaaattctttattccactgcgttaactgaatgatgacgcgatcgataacccagtcagtcagcaccgaaatcaggttggtttttacggccaagggtataaagtcgacgggaaacagctcgcctctttccggatggtgccagcgaattaatgcctcaagcccaacggtttttcccgtctttaagcacacttttggctgatacgcgaggtacaggccttcgtcttttttaagcgcctgggccagatcgttcataatcaagaaatcttccgtgcgccgcgaatcgtatgcatgatcgaacgtcatagcaccaccgttctggtgaatacattcgtgcaacgcactgaccgcctgacggacaacttcatttgcatcaatatcgcgggaaacaaactcggtttcgcctgcataaacgtcgatatcaatggtgatgttatccgctaaatctgctttaaggttggttaacacctcaatggtactttgcgcgctatagccgccaaaataaggctggattaatgcaaagcgccccggtgcaaatgaataaagcatgtcatctggctgaagctgaagacgagcgctgaccagcccggcaatttgcctgagtaagttttccactggcgcaatgccaaaggtacgtgataactcatatgcctggggaatatcaatacagtcgataagaatcatgcgaaaacgacgatcgggattgctgacggccagctgttgcatgtcgcgaatcaggcgtggccggttcggtagatgcgtaatcagatcggtgaaactggcaagattccatgcatccagaaaggatgtcaccagtcttgccagcgacttcagtgtttccaactgctcatcactaaacgtatgaggctgcgtatcggtcacgcaaagcgtccctaacaccagcccttccagattggataacgacacgcccgcataaaaccggatgtgaggttcaccctcaactaagggatgaaaagtgaagcggctgtcttgcaatgtatcctgtacaacgagctgcccgtcgccatcaataacatgacgacacaaggaaacttcgcgtgctgattctttgaggttaaagttgcgggaaaccttaatatactgatttttatcatcaataattgaaataaaactgcctgaaatacccagcgcctgcgcggcaagatgaacaaatttttccagcacctcatccctggtaatatcaggtgacaaaagtgctttaaccgctttaagacgattttcgtcattgccactttgattatcgtgcacaacagcctccccttgtgcgggtgcaaaaaacgcagaaaaacaatttagcttaaatttaaatatttagcgccatattaaccgacaatttatagcaaacaggggccatgtgcgactgtataacatgcgcgaaactgttttcagaaatttttaacatgataccgtgctgccagcatcgggtttgccgtttctctgaacaacaggggcgattaataacccataaaagcggtaattaaataatcgcgcaaataataacaattgttattagttttatggttaccatcaatcccttaaaggcgcttgccgttaatcctgatggccagagaaataataccagaatccttttaattcaagttgttaattctgtgaaattgatctctttgggtcgtgtttcccaacctgttaccgcgacatcttcattgcgttgctgaagtcaaaatcgtcgctcagtgacacgatcacaacgcgcagtaaaggatcagtgaagccaacatccataaccgcgtccctgtaagtgcatagctgcatatataatttgcggatggatcaaggccaggccgcttaaggcggcttttccattgtgcgcggcggcggttgtcgatgcagactgtagcagcccttctgtcatcgcccctcactttcctttagatctctgtgtgaacagacttcgaaatcttcccttcacgtagtaagctacgcccttacagccaacatgggctatcttcccctgaccgttctgcaacgacgaatactcacgggcgcctgtttgaccacgattaactgatttaaacccccagcgcctcctcagggttgctggtcagggttgttcaggaatggaagtatgcttaccgaagaacagttgaatgatattgtcagtcacccggatgaggtttcacatcaggttgtggcaatggcgaaagagttactcgcgtaccgtgccgcttttgcacatccttacgcgatcatagagcctttgggaatgacctatattggcgacgaaaatgcggcgatggtttggcatccaaaacatgttgaagaaggtgacacctgcctgtacctgaaaccacacatagtaaagtagaggccatgctcagtgccgtccaacacgatcttaacgattgccagactcgttaacgattacaggcatattgatgtggctttatcgaagtaactaattttcatcattgaccattacctgaagcagggaaatcaactgctgctgctgttcggcagtcagcttttttagaaaatgcgcatccaccgacatcgctgctgttctggctgactccagtacgctatgaccctgcgccgtcaaggttataaagcgacggcgcttgtcagtttccccttgcacgcgtatcaacaacgcttttgcttccatccttaccagtaactccgcaagggtagctttggtcatcaacgcttcagccatgagttccatctgttctattcctggcttatcggcgacggcgcaaagcaccgaatattgttgcttagtaatctctttcagcgttttttgccatagtgatgtgtgttcctgaaatagctgtcgcatcagatgaaaatgaacattgccaagttgagttttcatagttaagcctgtaatcctctttttccttaagaataccttatcccctgacgtcgggttactcctgatcgcactcgccacttcgttcgtacacgaacattttgtgccattcgacttgtcaccaaagattaatcgcgataactttagttcgtatacgaacaatcagtctggaggtcgatttgcgactcattattggtattactggtgcaacaggcgcacctctggccgtcgcacttctacaggcactccgttcgtttcctgatatcgaaacccacctggttatgtcgaaatgggccaaaaccactatcgaactggagacacctttttcatcgcgagatgtggcttcaatggctgatgtggttcacagtccggccgatcaagccgcctcgatttcatcaggttcattcaaaactgacggcatgatagtgatcccttgcagtatgaaaacactggccgggatcagagcaggatacgccgatggcttagtgggacgcgctgccgatgttgtcctgaaagaaggccgaaaactggtgctggttgcgcgcgaaaccccactgagcaccatccatttggaaaatatgctggcactgtcgcgtatgggcgtggctttagtgccaccaatgcctgctttttataatcatccaaaatcgttggacgacatcactaaccacatcgtggcgcgtgtactcgatcaatttggtatcgacttttcaaaagcgcagcgctggcaagggctgtgtgcaaccaccgctccccttcatgacctgtctcacgaggattaatcatggtttatgacgatttacgcagctttcttagcatgttaaatgaacaaggtcagcttcttcatattgatgaagaggttaatgcagaacctgatattgccgctgctgcaaacgccactggtcgcataggcgacggtgctccagccctctctttcacccgtattaaaggatttcaccatgcacatgtcgtgatgaacaccctgggatcctggcaaaatcacgcaattgcccttggtctggcaccgactacgcccgttaaacagcaggtcgacgagtttatccgtcgttgggataattttcctgtcgccccagaacgacgagccaatccggcgtgggctgaaaacagcgtggaaaatgatgatatcaacctgttcgatatactgccgctgtttcgtttaaatgatggcgatggcggtttctatctggataaagcctgtgttgtttcacgtgatccgctggatcctgataactttgggaaacaaaacgtcggcatttatcgtatggaggtaaaaggcaagcgcaagcttgggttgcaacctgtgcccatgcacgatatcgctctccacctgcataaggccgaagaacgtggggaggatttgcccatcgcgattaccttaggtaacgatcctgtcattacattaatgggcgctacaccacttcgctacgatcagtctgagtatgaaatggcaggagccctacgtgaacaagcctatccgattgcgactgcgccgctgacaggtctggatgtaccatggggctctgaggtgattcttgaaggcgtgatcgaaagtcgtaaacgtgaaattgaaggccctttcggtgaattcaccgggcactattcaggcggccgtaatatgaccgtggtgcgcattgataaagtgtcataccgcacgaaccccatttttgaatcactgtatctaggcatgccgtggactgaaattgactatctgattggccccgcgacatgcgttccactttaccagcagcttaaagccgaattcccggaagtacaggcggttaatgccatgtacacccatggcttactcgccattatttccactaaaaaacgctatggtggattcgccagggctgttggattacgtgctatgactactccccatggcctgggctacgtgaagatggtcatcatggtcgatgaagatgttgatccctttgatctgccgcaggtaatgtgggcactctcttcgaaggttaatcctgccggcgacctggtccaactccctaatatgtcagtgctggagcttgaccccggctccagtcccgccggcattactgacaagttgattattgatgccaccacacctgtcgcacctgatgtgcgaggtcactatagccagccagtgaaagatctgcctgaaacggcgctctgggtagagaaactcaccgccatgctggcaaaacgtaaataaggagaaacagatgatttgtccccgttgtgaagaccacagtattgaaaccatggcgacatctccggttgaagatgcctggatcgtctttcaatgccagcactgcctgtatacctggcgtaatactgaacctgcccgccgtacacaacgcgaacactacccggaagcgtttcgcatgactcaggaagatattgataatgcacccgcagtacccgcagtgccgacgttattaactgatcgccagagttattaagaaagaaggcatgcagcgacattcaggtaagcgaacagtcgctgctctgagcacccatgtgatcggcaacaacgctctgcaaaaacgctgattatatagaatccgcgatggtcagcgtaggcgtcaggtttgactgaagcgcttgcctgatctcaacgtccagattagcatcggtgacaatatcggtgagctcatttaaatgcaccacattgaagagtgaccatgccccatattttgagctgtccgccagtaaaatccggcgatgagcgttcattatcagatcgtgtttcagtgccgctttttcttctgtcggggaagttacgcctttagcgaggtcccaaccgttgccactcaggaacgcaatatcaggattaatattgttgagcattttacgcccgtgatcgccaatacaggactggctgctctcatcaatgcgcccaccgattattgtcacttcgatttgtttgaactctgagagaaacagggcgatgtgtaagtcattggtaatcacgcgcaacggcatatgggtaatttgccgggccagttcaaacatcgtggtgcccgcatccagaatgacagcatctccggctttaacaaagctggccgccacgcgcgcgatagcatgtttttccaccagattacgcgaggacttttccagcgtggtcggctgagaagggataaaacgattcagtgtcacaccgccatgtgttcggctgacaacaccttcgtgatcgagtttaatcagatcgcgtctgatcgttgccggtgaggcacccgttaccgtaacaagctgctcaactgtgaccagattattccctttgaggtaattcattatcgattctaaacggctgttttctttcatattataaatgcccgataaggtctctattttccgtaatgccgctatgatcgcaaactgtgctttttctgtccaggcaatctcagaaaagaggattgcgccgacgcaatttgtgagtgtgaatggttgttatggcacaacggctcattcgcaaaatgcgaatgacggcattaagtgcagcgaagagaaaacatcccgctcttttcaggaaaattaatcccgtaaataatgtcggtgcgcctggctaattttatttgccgtttaaaaatccgttattttctcagctgtatgtcttttcatataacgcttataacgcacgaataaagacagctatctcggtaaacaggagggcgaacgttatatccagagcaggttttatctgggtatcaaaggggaatgtagcgcgtacaacgtggggagcatcatgattgaagtcaaaggagaataagcgcagcgatccttgctgctgttgatatatcgcaaagcgtttaatacctgcgctattcgccgcgaggcgatagggcaacactacatagcatcacgatattccggccaggcaaccgcatcggcatgacccgaacctgcggaggcaaacagactgccctggaagttgataatgcccgccgcttcaagccacatccactcctcggccttaacgataccagcagcgatcaccgtgatctctaaggcagaacagcatttgataatcgcctggacaaccgcctgcttcgggccgctccgatgaacatccgttgtaatactggaatcgatacgaatgcgatcgggctggatgtgtgtcagtaacgacaggccagccgatcccgcaccaaagttatcgacggacaaactgatacctgcggctttgagctgcctgacggcaacggaaaacgcttcgagtctggagatgacttcggtttcgctcacgccaagcaccacctgttccgggactaatccggccgcattgattgtcgagacaatctttgcaaccgcatccggtaccaccaccagcgtcatgggaagcaggctgacatacagggtcatttcatccggacaggccctgccggccatatcgaaagccttgatcaccgcctcaaggtcagcatcatgtaacgcttgctcggagccgttctggtcggtgccacgatgacgcgtatccgtgattgcctcaatcgctgtgacctgtctggcaaggggatcgaccaccgggcggaaactaataccggaggaagcgggttttgccgcactcatcgcaggacgttcgggaataaactcccagtattcggatggcaagacctcgtaatagttttctttctcacgcgcttcaacaaaggtacgcagaaactgcaacgccctgtcagcgtaggtcagttggtatttagacgtgcctttatcgagtacagcctgaagcacggttgaacgatcatgctggcgtaaatcaaacagctccataccggcattaccaaaccgacgggatggcgcgtagtcacgcatcaattcaaccacgttgtgatggcggcgagcggcacagatgcgctggtaaacggcaagcacgccctcttcagggccttccagtaactggaaaaaatgggtgccattaaagagcaaaatgccggtcacttcatgggaagcattgaatatgctggcatcgtccaccatgtcaggaagcgtcttaacgggcacgtcatctgagatgtggctgcgataaataattgtggtcagcaaagggcagctccaacgtcatcgtgattgaggctgttagcttatcagttattgtcctgatatgcaggtatcggttgggagatgagcacgataatttacattaatatgcaacagaaatgattctcaggtaagacaacgcacaggtcggccctgcaaaaagggcatcacctcaatgattaattttatttatttaatgtcgcatttcccatttcacgcattcagagataacgctgcggctgagggctgtttataacccccttcccgctgttaatcatgattaatcccttgtattaccagctaatgttcacaaaaactcagtatacggcgatgtggcacgctaacttatgacgtttaccggttattctcacgcccgatcatacattaacaaaaccaaacaataggataaatttaatttagcgcataatattaagtaaacgcgaccctgtttaattaaataactgcaatgttatttaaccttactggccagaaaaaaccttttaaaaatgacactgacgccaatggtaattttaatttgcgttaagtgggtagggataaaaaaataattacgccttaacccttccaaagaaaaaattaatttaattgcttttgccttttataatgattgggctttatttttgctatttatcgtacactcttcttttgcagtttcattgagcaaacgggcaggagcggaaatgtctacggaatctagcgacaaggaacatcaccgcaccagtgcaacaaaagcacttagtctttccgatcggggccgggatgaggtgctgaaaaaattcttgcgtctggccagtcaactgctgggtatcaatggaagttacattactgttctgaacgatgaccagcatattgttcgcgccaactataatattgagctgcaggatacgtcacgcgagcaagcgctgtgccgatatgttgtggaaggcggcgcaacggtcattgtaccggacaccacctgcgattcacgttttgcccatcatccactgatcaggcatgcacctttcatccgcttttatgtaggtacgccgctaaaaaaccgcaatggccagatactgggcacgctgtgtttgacggatacagtgccgcgccctttcaatgaccagcaaaaaaaataacagaatccctggctgggttaatcatcgcttttcttgatgcctggcactccgcggctttcatcgaaccggttaccgggttagccaaccgcgaacgtcttattcgcgatatacagcgccttgccacccaaaaggataaatcgctgcgccgtctggtgttgattgattgtatcgatatgtcacgcgcgtttgagttatcacgatcgttgggcatggccgcgctggagtcactgctgaaagatgtcgcgacactattgctgttacgccttcggccaactaatggctgccagttttacactatcgcaacaggacgttttgctattttaacccaggctgacagccccgtgagtgcaacctgggtggctgagcggctgggagcaatcagcgctgatatgggcgacggtctgaccatggcgctgacgacctatacggagcaaactgattttattgccagcgatgcgccgccttgtgaagtcctccgacgggcagtcaatgcgctggagtacatcagcggacagacattatcgcaggttcgttttgatgaaatcagcgacataagctgtgcgactgatgtcaccttgatgagcgacctggcagaagccttacggcacaatcacggcttattcttggtttttcagcccaaagtctgtattaaaagtggtaaacccgttggtcttgaagcacaggtgcgttggcatcatccgttacgcggtgagctgttagcagatcactttgtcgctctggctaaaggaacggaacttgatacgcaactgacaacctggcaggtcgacagcgccatttcccgtcttaaacgtttacgacatcatcctgtccagttgccaataacaatcagtattaatgagcgagatattgctgacagcacgtttgcagaaaaactggctgaaaaaatgctcaaggccgcccttcccacatcaatgcttatcatcaacatattgaaaaccgagcatatgattgacagtccaaccgctatgctcggactggaaatgctcaggctttcaggcttcagcatgtcatgggaagatacggctaagggctacagcaaaatacgttacctacgacagagcccgcctgaagtcataaaacttgataacgtactggcaaaagaacttaatgccaggatcacgtcacgtctgattgcccacagcatctttactaccttaaaagcgctcaataccctcgtgctggccgatggaaaagattacccgtcatcggtttctgcgcctttagaagaccgtgacgatgttgcacgtgagtattttaatataaagccaatggctgagacagagcttgatacctggcttaaatggaagctgcctggctgagatcctggataatgacgttttaatcagagcaggtttctgcccactccgcgctcaccgtttttttatttcctggccaggtaacgtttactgtcacgagcctgaatacgcgcggccgttggcgaagggaaaatataattaaacaggtcacgatacaggcccagatgtttaatcacgccttcacgaatgtttttggtgatgtcattgaccaaaaagtcgctcgtggtattgaaacttcccattttaaaaaaggctttatcaaaaacggtaatagtaccttcccatttcatatgatattcatctcgggcgacatcatgggtggcaataaacaggcctttatgtgtttttacaccgtggttacccacatacgtcacctgtgaatcgtagccacgcttgttgcgccaacggcaaaattcataaggcacatcataatgcggcaaaataaaatcgggacagcgaaaattctcatcactcaataagccgtccagcgtgacggaaaaatgcaaaaaatcctgcatgaaatcgaactgtcgggttttagttaattcaacgttgatggtgaaatgacctgagtgcacataccagtaattagtaaatccattcacgagaatacaaaatacctgccagtcactgagccgtcgatccccggctaatcctctgaaacggctgatcatcaaccttgatttcgggttctgatacgccttaagcaacggatcattcatacctttcagtaacatcaggcccactcctttgttatttggcttatcctgccatgccgttttcatcctgaaaaggtggcgtcctctgattgtgcggcgttaagcacggcttcagtaatgctttaatcactcgcgcgcgctacacaggtatcttcaccccatcctgtccgttgtttttgtatgaggccagggatttcaggcgcgcttatttcctgagcaggtacacacagggctgaaacggttgtcgggcgtcagcggatatagcgttgaaatttgagcggataaatcagaatgggaatatggctaatgcccgttgctgatgacaggcaataaaatcatgtttcaattgaccgtaaatcttgatgtcgccctgacaggcaagttgtgcagcgcatttaaccgccgcatattcatcccgtacctttggagagtgacgtaaataatcccgaaaggcgagatgccgcctgatatcggggctgccagagataaaagcatgaatgtggtgggtccgcgcctccgcacctttcgtgaaatagcgtctccccggcatcccgttttctccgcgcgattggtagcccatctgtattagcgcctcagcagtcggggagtcatgatttaacacttctgtcaacatatcgatgacgggttttgccgctaagccttccacagctgtactgccaatgtgatggatagtcacaagcgtgtcgcccagcgccgccgcaacaacggcagcttcagttgaaaagtgatctgcccattcaggccggtattcactgataattagcgggcgtggacgcattgacaggtacctgtgttaacgcccttttttcttacggccgggctggttgaaacgcttgcgcgacgcagatttatcctcggtcttatcaccctgcttaggtgcacttttcatcggctttttcgccgccggacttttttgtgatgttttcttggctggtttttcatccgaggatgagttttccagtaatttgaacagctcgactaattcatcatccgtcagatcgcgccattcacccaagggaatgcccttgagattgacgttcatgatgcgcgtgcgttcaagcttcgtcacttcatagccaaagtgtttgcacatgcgacggatttgccggttaagcccctgaaccagcgtaatacgaaacacataaggcgcttctttctttactttgcattttttggtcaccgttcccaacataggaacgcccgccgccatgcccgcaataaactcatcggtaacaggtttatcgacggtaaccacatattccttttcgtggttattgccggcacgtaaaattttattgaccaggtcgccatggttggtcagaaaaattaagccctgagaatctttatcaagacgaccaataggaaaaacgcgtttgctgtgattaacaaagtcactgatattatcgcgctcaccctcttccatggtggtaataatcccggtgggcttgttcagtgcaatcagcactaaatcatcttcatcacgtggctcaattaactgaccattcacttttacgacatcgccggcaaaaacctgggcacccaccgcggcgcgtttgccattgatgaaaacgttaccctgttcgataaagcgatcggcatcgcgacgagagcatattccgctctcactgatgtatttattgagccgtgtagatgaattggtcagcatggttcctccaaaaacgcgaactataccttaccaaaacacgcttgcgaagcgggtggcgtcaaactttctgtgccacctgccctgtcacaccggaagtcatcattgcacgccatgacgtcattgcaacggatgaattgacccggctcagtctgataagtaagactgaaatgtctcgcgtccctgcgaatcactcaccctaaaagcgtgcgctcagacccaggttccatgtgacgtcatgataatcactggcacccgccaccgtcgatacggcggcataagcggttaccgtatcgccgaagggtacgttcgcgccaacagccatatccacccagtctttatcctggcctgcacgggtacgtcggaaggcagtacgggtcgattttaaacctgcactcactgaggagtcagtatctccaaactgatggttataactcacctgcgcccatggattgatccataagcctttggtgtcgacacgccaacctgctgcgccaacttgtgagtgccgggtttgcccggagaaccgcatcgcactgctgctgtcgccgagctcctggtaaccgtccgccttaacatagtccagcgcatagctggcaacgggcccggtggtgaccacatcgcctaacggtaaatcccagcccgtttgcagccgcatccccatgagttttcctgcgctgcttccctgttctgtgcgggtagcgggcccgagtttaatctgacgttctatcccgtcataatccagatccgcatagtggacatcggcgttcacccacagctgatccagtagctgaagctggctccagagcgcgaccatgttgccacgaagccggtaatcatagcgatcagagggctgctgccgttgactggcggtcgacagcaatgcccccgcctgccagttatcggtgagctgataaccgatgccaacagacagattagcggtatcggtgtcgccatcgttaaaaacatcatctttgttgcgggcgtgctgaccggcataaccgccaaacaccgtgaactgacctgcttctgaagcttgcttgcgctgttgctgtaaatgaccatccagtgtgttgtgcatatcatgcagcatggccaggggtgcctgggtcagcacagccacctgggcgggcgcatccagaatcgactggatgtagtcagcgataatggcatgtacggcaggactgggatgaagacgatcggcaaacagataattttgctgagatgaaaaacccgttgttgctgaggtgcagtttacggaagaggtgccgggtggacaggccatgcctgccgtattactcagcccgtacagggcgggattttggatgacttcactgaagagtccattgatatccacccgaacaatgtttccctgggtggttgccagtgcgttttcttcaagctggttataccgcgcggtcagtgctgccgcctgaccgctcagctgctgccatgctgcaaataactgttgcgcaatcaggtcgcgaacagctggcacacttgaaagttgcgcggcggcctgattaaacgcagcctgaatggcctgctgtcgcgctgcattatcaggcgtggctgccgcgttcagagactgaaacgcagcagtcacggcagcggaactgaacggctgaagaatcgcctctattaatgcgggtgtcgcccccacattgggtaccgtcggcacaatcacggtgcccgcgccagcgtcaagtagcgccttgacctggctggctgccgcgcctgcactgttatcaacaatcgatgtggccaatggcggaagggcaaccgccgccgccagatcgttgccgcctatccagtgaatatacaagccattgggatcggcccgaccattggtagaagccagataacgggcaacctgatcctgagtattaaattgtggattaagggcaggcacagcaacggcgcctcctgctgcgtaattgctaccgccagcggaagagggttgcaatgtcagccctgcttcgcgagcgataatttcatcataaagcagattatttgcggaattatacgtaaaccggccgacgtttcctgtatcgctcaggctgtcaccaaatacggtaagactgtcccatgccattaccggcagcggggttatcagggcactcatggtggcaagggccactagcgacacaggaaaccatgcacgatctttcttcatgattagctccgttcagggacgtaacaaggatggataaatcgaagaacagcaaataacgtcacggcagagtaatagccgttgattgaagaacgctccaggcgaaagcaggcgtgcgctcgcaaaaacagaaattttttttaaaattccgaaaaatgccagccccctgctcatcgctgatgccgggatacgttcaaaaatgcgccttaacggttgagggcgactgttcagccctgggccgtggcaacgcgggatttgccagattatcgtccagctttgttacaccaaaacggatgcgctatttcttagccgcaggcttaagccctctgtagaaatcctgcagacgtttcatcgttttcactgtgcggtctggcagggaagaggcaaccgataaaatcatcatctccaggcaaaccatgacggtgccatgtagcgggatgcggccattttctcccccgcgcggaacgtggatcaccacatcagcttcccgggcaaaaaacgagtcggtggcattggtgagtaaaataacaggaatgctgagccttttggcttcgcgtatcacggtgctgccctcacgatgcgctgacttctgcgccatcatcaccagtacatcgccccgttgcaaagccaacatttgctccgccaacgcaatgcctgcacgattaagtgaaaacgccggtaagccaatgcggtttaacagccgggcgctgtaatcagcgaggatgcctgaggcattgatcccaaaaatggcaacctgacgggcttcgatcatcaatgaagtcgcctcagccagcgcctgacggttgtgctcagaagataaaacgtggcacgcatgaagatgtccctgcaaaacaaagtctattgaggaggagacatcacgcgtcacgtcattcaccgtggtgatcatcttctcttcagaagacatgccaggcccgaaccaggcctgcagcacttttttgagatcgcgcaaacctgaaaaacccagcgcctggatggcacggataacggtggcatcagacgtatggttagcagtagcaatttccattgccgtactgtcaatcaccgtttcccggttgtcatttatataatgtgcgaccaccagaaggcgtggagagagttgttgctcacgtgaacgtaaacgctcacccaatatgtcaacgcggcttttagtttgtattccgatgatcgtccgcctttttaaatagcaaaaacactgcgacatacccttttcgttttcccggttaactaagcacaggtgagaaaatcccattgcctggggctcagtaaagcttttaaggacccggttttctctttcgctttccactgatagtaaacctgcaaactgtagtcagaaagccagcaatgcggaaagcagccgtctgcttaccacccatcgcctgccgaaatccgttttgggaaagggataatcgcctttaatttcattaagtaataagcaaaaaccagccaggaaaaagcattgcggcgtgcattttaacatgtagtaaaaattccggtatttctgtttactactacatcgcgcaatggttgaatgattatcaattacaaatcagcgcgtgaacagatcctttatgcttttccttcgtcgctgaataaatacgcgcagtcaatgtggttatttactttatttctctctttgatgatcagcgaaaacaaataatgaaaaaacgttccaacgatattaaacacctgggaatccagcaggcggtgatgctggcgatctgttctggcgcgctgcttgcaccgggtgaaagcctggcggcgaccagtgatgatacggtgacagtaaccagcgatgctaacagcaatgacggctatgccgcctccaccagcagcgttagcacaaaaacccctgtgtctcgtctggatgaggcgcaatctgtcagtaccgtgacacagcaacagctcgacgactaccaggccagcagcctgagcgacgcgatgcgttttgtcagtggcgttgctgaggcaaacacactggcgggaacagaagatggttttgtccgccgtgggttcggtagcaattccgatggttccatttatcgtgatggcatccgcagcagccaggggttaaatctggatgccacgacggaacgcgttgaggtactcaaaggctcggcgtctttgctctacggtattcagaatcctggtggagtgatcaacgtcatcagcaaaaagcctcaatactcatggcaatcctcggtaagcggtcgctacgcgagtgaaggcggcggtgccggtacgctggatgtgaccgggccgttgggcaatggttttgccttcaggctgatcgcagaaaaacaacgtcaggattactggcgtaattttggcagtgatgaacactcgctgctggccccgtcgctgcaatggtatggtgaaaaagccagcctgttagtgagttacagcgattatcgttatgacattccctacgatcgcggcaccgcctttattaacggctctcctgtcgacctgccctacaagaagagactggatgacaaagccaatcatgcctggggacgcaatcaggcactcaacgctcattacgactggcagtttaatgacagctggagtacgcgattgacccttggctggaatcagcgccgttatgacaataatgaagtgcgggtgacggcgattgatcctgccagcggcgtggttacgcggcgtgccgatgccaaccgcggatttaatcaaaaaaccaactacctgtcgtgggatgtgctgggtaatccagaactttttggcatgacacatgcgctggtattcggcacagattatgaaatgaatcaaacctatcgtgcgcatcagtatcagggcaaaaatgaccggcgcttcaactatttcaatccggtttatgacatgctgtctcccgtaaccgacagcaccactgaaaatagcgcgaatgccaacaacctgaaccgtattcacagccgttcggtttatctgaaagacagcatttcgctgagtcccgactggatcgcggtggttggcgggcgataccaacattacgagcaacgggcttcgaaaggtttcaacccggtgattcagacactggatgatgaagggaataaattcctgccacaaaccgggctgatttataaattaacgcccgatatttcgctttacaccagcatgagtaaatccttcacgccctcaacggatgtggatgacgaaggtaatgtcagcaagcccgagcagggaacgacctgggaagtaggaagcaaatggcaaatctcccctcgcctgttcgcttcggtcgcgctttacagaattgatgaaaagcagatgtcactcagcattaatggcacgactcgtcctgttaacaaagcgcgctctcagggcgtggaagttgagctgaatggcgaagttacgccagactgggatatcagtgccaattacagttatgacaatgccgagatcgtcgatgacacgatcaatccggccaacaacggcaaccgcttacaaaatgcgcctgaacatgccggtgcgctttacctgagccataacctggtcataccgggtttgcccggcgattttcgtgtcggtggtggtgcacgctatgtcggcaatcgtgcgggcgatcctgacaacagctttactttaccggattacgttgtcgctgacggcttcattgcctggaacaaccacctgctgggcgaaaaaacccagttgaggcttaatctgaataacctgtttaacaaacactattacacgtcgagcggcggtaacctgcgcgtacgtgaaggtgaaacccgcaacctgatggtacaagcccgtgttgaattctgattcttttatgaagttctggctgcgcacgctcctgctgctgtccgtgacaatcagcacgctcgcctggggcaaaacgattaccgatatcaatggcactcgggttactgtgcccgatcatccccagcgaatcgtcctcggtgagagcaggatgctgtacacctttgccatgctggaggccggcaatcctttcaaaaggctggttggctggccgcaggacctgaaaaagtacgaccggcagacctgggatattttcgcgcaccagtttcccgagatgctgaacataccgtcaatagggttagatggcaccaatgatatcaatcctgagcgggtgattgcgttaaaaccggacgtggttatcctgcccgaactggctcgcagcagtgaggcggggcaacggctggaagcggtattaaaagcagccaatattcccgtggtgaaaattgatttacgggtacatctcctgcaaaacacgacgcgcagtgttgccattctgggagaggtgctgaatcagcgtcagcgggcaacggctttcaatcagttttatcagcaacatatgcagactattcagcagcgccttgccggttttcagggccgtaaacccacagtgctgttacagcttcacctgggccgccgaaatgaatgctgcgtgaccgccgtgaacggaagccttggcgatgtgctgtcctttgcgggcggagacaatattgccagtaagaaggtgcctggcgtattcggtcggctgaatgaagaaacagtgattaccgcgaatccggaatattatttcgcgaccggtagcggtggcagcgacgatgcttcagaccttcgtatcggtcccgctatcagtcaggcggaaacgcgtgcgtccctgcagcagctcaccgcgcaacaaaatggcctgaagcagctgcgtgcgctgcataacggtcatgccgcggcaatgtggcataatttttatctcagcccctggcatgttgccgcagcagagttttttgccaaaaccctttatccagacctgtttaatgacgttaatccggaacaaactctgcggcagatctttaacgatttccttcccgttccctattcaggcacctatttttactcgctgaagaaagagtcgcagtaacctgcgaaccggcggcaagctgcacgtagcgccgccggcccctctgctgacctaagctccgtgttggtttttaatccgtacgatatctgccatcaccgacaacgcaatctccgcaggcgttttactgcctatggctatgccaatcggcgcgctaatcctggcgagttcctcctgatcaaatcccgctatcgcctgaaggcgagcctttcgtttggcgctgtttttttccgatcccatgatgccgatataaaatgcgtgcgtgttgaccgcttccatcatggttaactcatcaatacggggatcgtgtgttaacgatacgatggcgactgaagcatgggcaccgtttaactccagccagcgtgcaggatgctgcggcacaatcgtgatattatcttcacccgtaaagtggcgttccagctcacttaacatctccggacgatgttcacagacccgtacatgaaaacccaacagctggccaaaacgaatgcattcaaacgcaacggcagaatagcctgccaccaacagttcgggaatggcgcccacgggcaacacgatgtcagggtcctgatagctgagcacaggtaacacggccgagagggccacaacgtcccaggatgcacgttcgcctgcggacaaggtttttatcagccgggatttaccgatgagcgcctgatgcatggcctgtaacagcgcgccgctgacagtatcagggagcaggtattccaccagcacgtccagcctgccgccacagggcagttgtacctgggtttgccgtccaccctcgccatagcggatgacctggctgtttacccggtaacgtccttctgccagacgcgccaaaaaatcctcttcaatgcagccacccgaaagcgagccacaacactcgccattctggttgatgaccatcatcgtgcccggcgcccggggcgaagagccccaggtacgcagtacggtacacaaccagaccgcctgccccgcatgatgccagcgcaaggccgtgtcgataacccgctgatccaatgtaatcataagtggctcctgacgtgccgtaagtcatccgggtaatcaatatcgtcgagacaaccccgatcgctgagcggcacatagcggatttgctgatgtttaagcacgctttgtgcacccacatcgcctgtcagctgttgcaacgcgggaaaaaacgatcgctgaaagccaaccggatgaccgggctggccttcaacctgcgggcgcgcaagcggataaaaatgcaaagcctgattcaccgcctgatagctttcagcggtgagaaaaggcatatctcccagtgcaatgatgaccgcatcatagtccagacaggcgccgacgcctgccgctatcgactcacccaaaccgccactgacacaaaataccggtcttacgttgtgcagtaacgcatgaatggccttatcttccggacgcgtgacgacaatgacatccataccgcttgcctttgcctgttccagcgtgtgctgcaaaacgggttttccctccagtaccgccagcagtttgtggtggccatttccctgtcgaaaccggcggctcattcccgccgccgttagcacaattgccgttttcacatccgcactcctgccaacatcgccatgcatgcttaaaggatcttgtccagcgtaatgggcaaatccctgacgcgtttaccggtagcgtgataaaccgcattgctgatggccgcagcaacgcccacgatgccgagttcacccaccgttttgccgcccatgctggtggctttgtagtcaggttcgccaacatcaatggtggtgatggcgggaatatctgcattcactggaatcaggtagtcggccaggttgttgttaatcactctgccattacgcgggtcaataattccgccttcaagtaatgcctgacctacgcccataatcatgccgcccacccactggcttcgggcgagtttgggattatagagccggccactgtcgaaagccgcgaccatgcgctttagacgtatggtgccaaaatcttcatccacccttacttcaacaaactgcgcactccagctgtgagccgacacgtcctgtggtcgactcatttcattcaggctaccggtgacgctgtcccgctcctgcgctgacatctccggagagaaggtgccaccttccacgctgagcccgtccaggtgagccagcttaatcagttcactaaagctaacggcctgggaaggtttggcggtgagctgtatccccccgttcgccagcgtgagccgatcctgtggtacgccggcaagcggagaaccctgggtctggctggccagcgcaagtaaacgcgcacgcagctttttcgcagtatcgtctacggcggcggtcaggtttcctgccagctgagatccacccgccacgcccgcccgaggcagttgcgtatcccctaactcaacgtcgatgcgttgtgaatcaacgcccagtatatcggcggcggtttgcgccagtatggtataggtgccggtgccgatatccgcgccggcgcactgcaccacgagctgtccttgagaagacagcagaatttttgcttccgccggcatggtattcaccggataggtacccgaagccattccccagccaatgagttctcggccttcgcgcatcgatcgcggtgccatgatgcgcttgtcccaaccaaacgcctcagcgcctttttggtacgcctctttcaggcggcgcgaactccacggaagatccttctggtaatcacgatcggcccagttaaggagacgaaaagccagcggatcaagattgagttcataggccatctcatccatcgctacttccaaaccaaatgcgctcgggttttcaccgggcgcgcgcatccagcctggcgtcaccatgttgacaggcctgacctgatgctgggcagagagattttcgatggcatacatgcggccggtcaccttgctgcagttttcggcgaacacatcgataagtgacgtttcactgaaactgcgcaggataacggactggattttaccctcccgcgtcgcgcccatttcaagctgttgtgaggtcgccggacgcccgcccagaccggtaaaggtttgtggacgcgtcagtgacacacgaaccgggcgattaagcgcgcgtgatgccacacaggccagcgcgacatgcgtatagggcacgggtttagacccaaagccgccgccaacatagggtgaaatgatacgcacttgctttggtgtgatgcccatccattccgcaatttccacctgggcacccatcacccactggctgggctcccagaccgtcatgtggccattatcccactgtgcaatacaggcatgaggctccatgggcatattgtattcacgtggtgtggtgtaacgctgattgatacggacctcggcgttacgcattgccgcttgcgcgtcgcccagattaatatcctgggacgtcagtggcttaggttctacaccctcatctgtcggggatatcagcgcaggcgacgtctcataggcaatctcgatcagtgaggctgcgtatgttgcctgctcgaacgtgtcggccacgaccaggccaatattctgaccattatggataatgacatcatcctggatcggcgtataagttgtctgggcagcgccaccgtcggcgatgggcgtcggcttgttaatctttaaagtattgaggtgcgtatagaccgcaataacgccatcagcgcgttcggctttggcggtatccatatgtttgattcgcccactggcgacagtggactgaatcacaacaccgtgcacagcattctcaggtttatgctcaatcgcgtaacgggcttttcccgtcactttcaccttgccatcaccccgggatcgtggtgtccccaggcccgaaaggctggcgggtgcgcggcgatagtgatcgttatgctcgcccgctgcggagacatctttctcattgcctggcaggtcgtttttgtcatgtttcatgccatttctcctgccgccatcaaggcgcgcgcaatgacccgtggcgtaagttttattttgtgcgcattgccagagagcgcctgggtttcctgagtaatcaactcggcagccgcataaagcgtttgctgctcgaaaggctgacctgccagcgcctgctcaatgcggcgtgcgcgccagggttttgttgccacaccacccaaagcgatatgaaccgtttcaatccggccctgattgagagtcagtccaacggctgcactggcactggcgaattcgtaagaagtgcgatcgcggacttttaaatagtgggagtgcttcagcgcggcagactgcgggatttcaatggccacaataatttcatccgcctggagagcatgttcatgatgcggtgtgtcccctggcagcagaaagaaatcctcaaccagaatacgtcgcctctgttgctggctgttttgcaccaccaccgttgcatcgaatgccgtcagggcaacagcaaaatcaccgggatagacggcaacacagtgctcactgtttcccagaatggcatgattggtattgacgccatgtagcgcggcgcagccagagccaggaacgcgtttgttacacgcggagaaggttgccggatcgcgataataggcacagcgggtacgctggcataagttaccgccaagggtggccatattacgaatttgcggcgatgccgcctgccataagctgccatacagcgcgggcgcttctcgctcacaggccggatgactggccaggtcactcatggtaaccagtgcgccaatcgtgatggtatcctgactgaaatcaatgtcagacaggccggataacccagcaatattggtcaggcgggagggcgtaaaaacaccacatttcattaaatcgagctgcgtcgtgccacccgcgataagatggttttcgggttgatttttggctcctgccgcatcctcgatggaatgcgcaacctgccagtgaaattcattcatcgtgcctcctccgccatttcagccgcagcctgcttaatcgcatcaatgatgaaaggataagcaccacagcgacaaaggttgccgctcatgtattcacgaatttcatcgtcggagccggtatggccttctttgatacaggcaaccgcagacataatctgccctggcgtacagtaaccgcactgaaaaccatcatgctcaacaaaacagcgctgcaccgggtgcagttcacctgaagcctgttccagaccttcaatcgtggtcacggttttaccttgcgtctgcgcagccagcgtcagacaactcagcacccgctgctcattaaccaggacggtacaggcaccacattgcccctggtcgcagccttttttcgtgccggtcagattaagatgatcgcgcagcgcatctaataaggttacgcgaggatcgacgtttacctctcgggtctgaccattgacctgcatcgttaacggtattttttctgacattgtctgtttcccatgattgcagagccggttaggtgatctgttgcttatacataacgggcgagataagaacggggaaagtcggataaccctgatgtttacatgcgtatgtacgtcattaggtttagcacttatttttaggaggcgaagtaaaaatacgaagattggcgtgattagggcgcgccagccgcctgggtttacacggcggccagcgcgttcatcagcatcataaatggggtaagcgcggtagtttgtggttagttatcagaaaactgacgataaagaccagcgcaaacaacacgacaatcgtcggcgcgggggcactgtcgataaaaaaagacagataaacaccacagagtgacacaatcagtgaaatcagcgtcgccagcatcagggcatgggagaatcgatgggtcagcaaaacggcaatggcacctggggcgatgagcagagaaatcgataaaataatgccaacggctttcaatgtcgccacaatggtcagagagaccatacataacagcccataatgcagccagcgcaccggcaaaccacagacctgcgcctgctgtgcatcaaaactgaacagcatcaaatcacgccacttcaggctgaccatgacgacaattacggcggcaatgcccagggtctggaatatgtcgctgcgactgataccgagcatatcgccgaataaaatatggtcgaggtggatcgccggtttcacggcaatatataagatcaaacccacggcaaacataccggaaaaaacaatgcccaggaccgtatcctgcttgattctactgttgtctttgagataaccactggcaacagcacagaaaaaaccggcactgaatgcgccaacagccagaggtaacgacagcatccaggccaacacaatgccggggaaaacggcatggctcatggcatcccccatcaatgcccagcccttcagcaccaaaaaaacggacagcagcgcacaaggcaccgcgaccacggcggcaatgagtaaagcatgattcataaaatcgaactgaaacggttccagccacatcatcatgcctcccggatggactgcgtttgggcacgacggcggttcgccaacagaccatgcttaggcgcaaacacaaaggccagcaaaaacagtaatgtctgcgccacaacaatgattccgcccgtcgcgccatcaaggtaatagctcacccacgcgcccagaaagcttgtaatgctaccgatggcgacagcgataaccagtaaacggggaaaccggtcggtcagtaaccatgccgttgcccccggtgtgacaaccagacagatgaccagaaaggctcccacggtttgcagggccgcaaccgttgaaacagccagtaaggtgaaaaataagatcttcagacgtccgggatgtaaacccacggcgcgggcatggttttcatcaaaaaaggtcaccatcaaatccttccatttaaaaaataaaatgatggcagaggtgagtccgataataaccagttgaaagatatcggaaggcgcaatggccagaatattgccaagtacgatggtctgaatattcacggaagtgggattcagtgaaaccataaacagcccaagaccgaagaacgaggaaaaaatcagaccaatgatggcatcctctttcagccgcgtgcgctggttaagcagcaacatgcttcctgcggctaatcccccggataaaaaagcgcccaaggcaaagggcaagccgagcatataagcgcccgccacgccgggtacaattgaatgtgatagtgcatcgccaataagcgaccaccctttcagcatcaggtaacaggaaagaaaggcgcacaggccgccaaccatggctgagatcgccatggcattcaccatatattgataaccaaaaggttccagtaatgttgtcatggttggcctcgcgatggattagcgcatgccggtgcaatcacaggacgctcactatcagtgataacctgactgtggccgccgtcgatcatcacatgacgcagcacgccgctaaatgcacgctcaaggttttcgggcgtgaatgtggtggctgtgggtccactggccagaatggtgcctttaaccatgacggtgtaatcacaaaactcggtaaccgatccgaggttgtgtgtcgaaaccagcatggttttgccttcatcacgcagttcacgcaacaagctgataattttggcctcagtctgaacatcaacgccggtaaagggttcatccagtaaaatcacctcaccctgttgggcaatcgctcgggcgagaaaaacgcgttttttctgaccgccagaaagctcaccgatttgccgttcgcggaatgccagcatatcgacacgggccagggcgtcagtcacgcggtcacgatcgtgctgtttaggtctgcgcatcaggcccatatgcccgtaacgtcccatcatgaccacatcatccaccagaaccggaaaagaccagtccacctcttccgcctggggtacgtaggccaccaggctgcgacgaagcgctttacgtattggcatacccagtatgctgatttgcccagcgtgggcaggtacaaatcccatcatcgctttaaaaagcgtggattttcccgatccattaacaccgacgagtgccgcaattgaacccgctggcacactgaaactggcattatgcagcgcggtgtgtccattgcggtaggtcaccgagaggtcggaaacaacaattgttgggctcattgtgttttcatcccatcgttgatgccgttgaccagggtttgagtggtcactttcaacaggtcaaggtaagtcggcaccggaccactggacgtactcagggaatccacaaacagcacgccgccataatgcgcatgggtttcacgtgcaacctgacgggctggtttatcggaaacggtactttcactgaagataacgggaatggcattttttttcatttggtcgataacgtggcgaacctgttgcggcgttccctgctgatccgcattgattggccagagataaagctctttaagtcctaaatcacgagccagataggagaatgcgccctcgctggtgactatccagcgtttgttttcaggaatagcggcaatttgctgacgaaccggttcgagcgctgtgacaatcttttgtttataggcggcagcattgcgctgataggtactggcattggctggatcgtatttgactaaggcgtcacggatattatccacataaatgagtgcattatctggcgacatccatgcatgaggattaggtttgccgttatacggcccctcccctattcccatcggcgttatgcctgttgaaacgacgacttcaggaacgcccttgagatgctgataaaaacgctgaaaccagagctccagattcaggccattagccatcaccagttgcgcgccttgtgcacgcttgatatcccccggcgtcggctgatactcatgaatttccgcgccgggtttggtaatcgacgtgacttcagctgcgtcacctgccacattttttgccatgtcagcgataacagtaaaggtggtgacaaccttaaatttttccgccgcatagctgtgaacactaaggaacagactaaaaaagatgccaagtgtagtaactgatatttttctcaccatattcgccacccaacgtttgaatgtaaccattttcataatttagcattagctaacttttatagcacaggctataaaagaacacacagaaacactttgtgaagttttttaatgaaatgaatggaagtttgagcttttgtaatgcagagtggctaaatagttattctaaaagcaaaatccgggcaatatggcgcaacccgatatgcaaaaattcgacgcaatgtgcggtgcacaaccgattcctcacagcggatagctcttaaggtaaaagggaacagtattctttgctaaaattactctcatcgaacaacgatcaaaggaggctcttttgttactttcccagcagcaactgaccaacacgatcattggcgaagccgccctgaatctgattgcaattaatcaggatgtcagcgtcgagtctctggtcgatgagcttaacgtgatgacgaaatctgaagtcgatgaggccagactgtcacaattgtatgatgcaacgaaatggcttatgggtttcaggaaaattggatctcgcctggcagcaggtcccggctggtcagcacgtaagtccgtgttttcaccatccgcagataatgactgcgatgacattttcttaaaatagtactatgctcctttcagagcagcaggttattaaccttgtgccttttagcgttaaggcaacataacctccacacatgctctatccttctgtaacttcttgttttaaatgcgttagcatcttttgcacaaaaaaaacctctcaagttcatcaaaattctgtacaagtttttaaaacttgtataactttcgctctatggcaaagtacattttaaccacttgaggataacagtatgcgtcagaacggacatgcaccggataataccagcgacatcgcccgttacttcaaccaggcaaatttgccctcgcagcaagaaacgctgggagagattgttgttgagctactgcgcgcaggtcaaaccctttctcgtaaagcaatttgcagtaaattacttcaccgtcttgatagttgtgatgccacggagcaacaacgtcattaccaggagttgattggattattgtttagtcgcgaaagcgaatagaaggttttcatctttaaatattaattcgttaccgaaagtaatttctgatcgggcagtaccacatttactcaaagggatagtactgcccacagctgacgcgggaaggttagctgtccccgtcatcgtgaccggaacatggccacaaatcgtaatcagagaagccagtatgtacagaagtgaagaagaaaaaataacggacgtgatgataggtgaggctgttctgaccttactcaaatcggaaagtccgatatccagtaatgcgttaattgctcagctagaagcgatggcaggcgaaaccgacgatgtaacgaagcttcaggctattaaagttgcgattgttgaagtccaaaaaggaatagcctcagccaacagccgccgaagagtcgatcttcccgaacgtgataatcatcgcttaaacaacgatggccctccggaaggctctaaaaaacattaagttcaagacgattgcctaacgattgagcaatcgtaaagtgtaagaactaacctgtgttacgcccgattaaccttaatatttaatgacactgtcggctgactcccaaagatgcaactgacgattttcctagagaattatgactatgcaacagagcacatcagatttagccatcatcgagttttttcgcagtgagggagagcatcttgctcaggaaactgagttgcttggcagagttatcagaaatatcgttagcgatgagaagcgcgtaaccaataaagccatcatcctgtatttgattgcagagcttgaatgcactgatgatgagttccggattgagctgttacgcagaacgctggaaatcgttgtcggccgtacgccggacgatgcaggtatttgattctgttacctgcgtgattcagtaatggatgacgcaggtaatgcccacgtcagttttgttttatcctgcaaaatggtgaggttacaggtcagcattagtgcattttgcgtgaaaaaaaatggattgcgcgctggcaaagtactttgaatcgcctgtcacggctgtcctgactcaaacgaaacaatgcatctgtgatttggtgaaactgtatgggctcacccaccttcagaagttcacttaccactctcccaatcagcgcacgaatatcgttgtcttcatggttattcacataacctccaactggtgtatgtatatacagactaacacctttgttatcatgaaaacaaagcggataatgaaaataaaccttaagcgaagcggcaatacagcgttatattattgattttttgggtctatttattttcatccctgctaaaaaattatactcaccctaaaaatcttacaaaatcagataaaccgtaaagatttatttcttttttggtcagttaatcggaatgtatgctcgcataacgttcccaatccattgaatagcgattccaggttttaatataaaaatattatttattgtcgtgatcagcatttcattaataaacaaaaggcggttaacgaaataaacatcagcgaaaaccgcctttccgataaattaactattacaacttctttgcattatataacgtggtcacaattgcgcttactgagagaataatgagaaaaatacccagcccaatcatagcgttaaaggcataggttttaaacaggagcagaccgacaatacaaccggttaaaaaagacaacaccgtagttaaatgcgtatataactgcttttgtgcaaatcgtctgtcacaaggctctgcacgtgatacaaacgacgacagataagaaccgaatgcgattccggcgtcagtaagcgtgccagtaatatgtgtcgatctgacgcggccgtttgataattgtgtcgaggtcgcgttgtggagccccatcaggaatccaagcattaacaggacctcaccattgtaactgggtgaataaaataatttttcaaacagcgatgcggcagtcagggcaaaaccttctgccagtatgatcaggcagaaaatggttctgattttacgcctttctcctgcgataatgactaacctggcggatgtgcatccaatgacaaatgccgagatcaaaccggcaagaaaaagcaggctatccagatcggaagtaaagacttctgttgaaatttgagaggtattcccgctcatgtgcgacgggaaaaaaccaaatgcgcccaatgccatagcattaagtatgccggcggttgttgccagtgcaagggccagatagcggtcctctgtatgagatcttatcttcttcttttttataagcacgccgttcccctatgaatgtgtatatctctccccagggttacctaaaaccccgccatctaatggtagtaggctttcgaatgcatagcggttaatacagataagtctgggtctgtaacctgttaattgtattaatttttatagttttctggccaggatttcatggaaagtaaacacctgttacaaccggtttttcttccataaatctcctaatcttatggcatatccacggcagagacggctcactttagcgagggtttaactatgcaacgcatttatggcaggatacgcgcccgggctctggccactcacaccagtcatatgaataagtcaggataaatacatgacagctttaaaacgtaaattcattattccggcagccattgccattggcggcctgggatggtggttaattccccattataatgctgaagatgaggcctattacatttccgtgctctgcgcggtatctcagcagaatgaacatcagttacacaaagatatgcaaaacgtgatagagggcagtaattcagattacgcgttgcaaaaaatccatttcatccctgccctcgcaaaccgggtcattaatgactggaagacgctgacgcctgagcagaaacagcaagcttcacataacagtagccagtgcacacaactgatacgtgcgcagaaatgattcatcaggagcaaagcactatggtgccagaacggaaaaactatcccgcactggggcaggtaaatgccccttacgtccatgccgtccgccacaatcaaacgctctatgtatcaggcttaacggctttcggtactaccgcgcatcagagtgatattgcggatcaggcagacgtcatcttcgatcaactggaaactatagccgcggcggagcacacctcactggcgaatttaatcaaagtgactatttttattacctcctttgccgatattgatgcgctgcgtcacgtactgtttaaacgatacggagaccacttacctgccagctcgttggtgcaggttagtgcactgttttcgccagacttgctcattgaaatcgacgcaatcatcgccctgtgattttataaatactgcacgcacgttgtgatacaggttaactacactcttatcggcggtgcataactcctcttattcatacgatgtccgccgttagcgtcaccaccatcaaaacgcagcgttatggatatttattttgctaagcaggcagacgatattttgcaggacaggattagctttgaaatgccggtcagtgacaacaacctatcaaagtaaaatatggcatgctcttgcacgttgctcgcctaacttttcgccttcaggggaaatcatgatgaccggcacatggatatctgatgcgcccaataccggtgttgacaatgctatctactgcatagctgacgccttctgcgcttatatttgattgtaactatcagcacgaatcctcttgatgatgctggtctctgcgcattggaagggaacagcaattcatttccagcccggttaaggttgtcgctctctcggtgttaagcagaggataagcaaggctacgcgccctgcccgccttttatgatctggatgttatctctggattatcagaacggtttttggctttcatgtgctcccgctatacgcaacataatgattttttttgccagggtgcacattgctcgcggggacaggtcagctgctgctcctcaacgccacaaaggaaggttttcttcgccggaatattccgccgcacaatctacctggtggtgagtcaaacgcagccatttagcttccacgtgaaccgtcattgaaagtgccccacaaccagctgaacacttttgcttttcgtctggggaatgcactgtgctgcaagtggcaggcttcagcaatttatcataatgaagaacgttcgtttctcctgttccaggtgcaggtatatattcagcctgccgatgaaacgcagtgcagcacctgaatttcagcctgaaatcgccaagcatcctgcccatatctgattacagtgaatgtaatttctgttcactgtaatcaggcagctaaacaaacacagcacacgcagtggctgcaaatagtcgggtatcagcatatagggttcactacagcgttgtgtattatgttaaataacatagcatcaacaaatcaacgacagtcagggtactgagttaaagctgagaactaccacgtagcagagtaaatactcccttttgcggcgtaatgatggctaattgtccgttgcctcgcaaccttgttaatccagataaggaacgcatttaaaagcgcacgggattacccatttatccgagtaacgacggtatctgcaatgtgatctgtcgaatgatggtgtgttttctggctcattaaatactggtcaaagatagagtttaaacaggcagcaacgcgtgaatgatataagcattgtttttaggccgttaaaaattgagttgtcgtgcgcgtatgcctgagccagatattctcccataagtatcctctgaccgacttcttaacaccattctggttcactgaatctaagggggaagaagaatttcaggctgaaatcgccaaacaggccgctttactgttactgattacagtgaacgttatgcatgtattcactgtaatcagcgcaacaccgacacagatacgatccttccctttaagcccattggttaaaccccggattgcgctgactctacttgtaatcctgtctgccgctgaacgggaaatatcacccgctccgtaagaatgtacactcacgtatgccaacgctgaagcattcactgcaataagtagatgatactgagtggcaacttttttaaagggataagtggaagcgatcggctccagagcagccgtttctgattacagtgaataaaagtacgggcaatctcttcgccgttatcctctaaagaaactaccagtttggcattggctgatactgttttctttggacaaatggcatcagggcttttgcgtctgatagggggaacgttagactgaccgagttgggacgtgattcatacgacacatactaagaacggccttgaatgaacgctttacattcaggtttcgcaggaacggataaataataatccgtcgtaaaatcttttttgttcaacatgacgatgtgacgtcgcgatcataccgagttaagagagatcggcagtaatgtttgtagaagggccagggacataagtgcacatattgagggcggtctgtcgtggccttaatctgttgcactcgccaataagttttccagacacgtcaaaacctcagttttgcacctaagcaatatcgtttactcagagaggcatttgctcttacagatcagatgaattggctaaggtgtgactttcgtcatccacttttaccatttgattgcaacaggatgacagcctacgttcaaaagggtttattcagaattcccttacttatccactttttctgtggataagtaagggatattttctgtatatcattctcaatgatatttagcatttttccttttcgcattctaaagcggataaaatctgtagatctgagcgattttatcgcctctgcaatgacaaaactttcacttcggatggaatttcagcctgaaatcgccatattaaaaacgttatttatcaatagtataatcttaaaaacagcgctgctttcgccatcccgttatgctgttagcgactctgcatattgcgtgatgcggttaaaatgctatctcggatcgttaagctgttaagagagacctccagacaggagaatgcttgagcaaatatcgctcaggccttacatcgacgttcaatgaaaattttcagcgttaaaaccgtctttgtcattcttgtccggttttcaaaatgcttttttgatcagtttttacgatcacgaaaaactggcgaatctcagattagtgaaaataaaatagccatttaaatcataatcttaaaaaagactgaggcaattttctttggcgatttcagcctgaaattcgctattaacagcgtactgaaacgtgaatggcggagaaaaaaagaagggggaaaagcgcaaaccagacaaatacaggttgcctggtttgatgtacgttttaacgcgtcatatatttctttaaggtttcagcaatgaccttatcaagctcatcctggagctctttggactgacggttaaactcatagctgaacattcttccgcgcgtttttttacgtgcaaagcgatctttatctgcaaaagaccagagggtgaccgccgttgttttatctttttccggttctttcaccagtgtctgactgccctgacgaatcaacctgagaatggtatttttcagttcatcctcagctaaaccctcacgcgctcttaccacatcaatttccgctgagattgcgtttatcagtgcctctacagtctggcctgtttcactgagtttatccgccgcctggagcaacgccttataatcaggataagtcagctcagattgattcggaaaaagggatatcaaatcagcaggaacgctagcggcctgcagggctcgcgtaactttggcttgtgaaagcccttggttttcagcaatctctttttgtgacaagccaccgtctttgagtgccagtaaccgcataccgacttcacgcaaattatgctcacgtgctgtctggatatcctgagccagccggcgggcttcatcaggcgttatcgccgcatctgtgacaagcacatcaaggccggttttacagtacagcgccgccgcacgacgtcgtgagccatccaggatctcaatacgttcaccttgcatgacaccaatggcagggaagaactgctgaagcttaatagtgcgaataatatcgcgtagcgagtccggtgtgagtccagactgatcacgcccatttgtttccatggtcacaaacgttttggcttcaacgtcattcgcaagaatatgttcaaaacgaaataaggcacgctttcctgttgccagtacaaacgtttgtgaatggctatcagcgcttttttctgtgtttaacggtgtctggctgaaggttctgccgatcgttattctttttgcactcatataaacctcagttcaggcggataaattcaatgcggtcgaaaaccgcttttgcaaagtcttcagcggcagaacgggcatttttcaacgcctcactgctgccgacgtaggtagagggattggcagatatcacggtgtcaaaagactcaccacatcgctcaaaaccatccagacgcggcagcgtcgcatccaacatatcgccaccgaaaatttctttcgccaggctgtggcaaagtttgtggtctgctttgtttgaaagcttagacataaacccaatgttgccctgaagtcgacaggtcgcgccggactcttcaataatgccaatgagctcgggcaaacgggtcaggtacttgagtgtggaatgaaaatccacctgcgcaggcgggacaggcgtcatcagcagatcggacgcggctatcgcattttttaaaaaggcatctaaatgtggcccgctatcaatgaagataaagtcgtaatcttttttaagcttagaaaccacattatcgtataacactgaatgaatattttgcccgggcagatgtgtggcacaaagctgatcccaacttgatgcaataaatgcatcatctatcgacgcaggcagcacatccacaccggggatgatggatgacacaataaattcattcaccagctcatcacgcgtgacgttttgcagcatcgcctgagcggccgtggcctcaacaagtccaacagaacgctcatggtttaaaaacatggtggccgaggactgtggatcaaggtcaataacgagaatgcgcaggtcttcatacaagaggtgagggtgcgctcgcagcgcgtgagccagagaaaccgtagaaacggtttttgaaacaccacctttaagattacccacaaacaaagtaaaggcttcagtatggcgatcgcggtatttaggcacgccgcgatgatgataaatatcaataatattctgaatggacatcgcgtatttgacggagctgcctgctgcacgtttatcgaactgatagccactctcttccatttcgttcactgcataatctacgctggcacgcgttaactttggcagtttcgccagcgcagccttggcatagatttggtagtaactgttttcttgcaactcaagtttttgtgcctgaatttgttcagtaaggctcaataacatgcgttctgaacgctgagcaactttcatgacctgactatcatcgttagccatacttactccaaacatgtaggatttatgaatttatacctaaatcctgcacatgaggcaagaatttatcttataaacgtaatcttgtgttaggtgtgaaactcctgatttttgtgacgctattcgcacaattcactgtaatgagcgagtgtcgcgctggacaggcatcgcgtgaaacgcgtctagtccgagcttattccaccttataacgcctgataagcctgaacacagccctgtcgaatcccactcccgcgccccatatgtatgaaacgggcaacctgaacaatgaacagaagtgataacgttcactgtaatcagtaggtttttacattaatcaatctgccctgaaaaggttagctggcccggcatgaagaagaggaaacaggttaaggtagcgtcatagcgcgctcaatcaggacgctctaatgcgttcactgtggttagtagaaacaggaaacccaacaagcctaaaacattcactataaacagtagaagattcactgtagtcagtaacgacttagcgataatgcgaaactcctcatcttactggacagctctctacagccggcaccaggcagtaaagaacaggagtgagtgagggaggtaaagacagtttttgatttactacagcagggctaaaaattcactatagtcagcaagggcggcaaccataatattcactgtaatcagtaaaactgcccggttcgcataaacgttcactgtagtcagtaatctcagtcatgttgagtctggctttcatgcccagcagcactcttcagcacaccgccaccctcatcaagtgccatgacggtgcactccagaacgcttgtatgccgtacccgggttaaaacattcactgtagtcagtaggggagacagtctgccggtaatcaatgcctcgttatccatcaacagagcatcaaggaagtccgtgccgccagaggcgttttcgtcaaaacattcactgtagtcagtggagttaacaatgtctcttcccccgcaccgcatttagtcattacctgtgaaaatggttgaatgcagtttgcagattcactgtagtcagtaaaacattcactgtaatcagtagatgaaaaaacgagaatccgcaccaaacctggaagcggggcaccgacaggtgaaatgttcactgtaatcagcacctgtgttttcaggtaccgcgctaccggctggacgttcactgtaatgagtcaagatgttcactgtaatcagtaaatgtgatggccgatatgactatcgcgctctacaggtaacatcacgttcactgtaatcagcaatccaactaaccctgtcacttttttcacgtgtcattatctggaatgttaaagccaaaacgaggagaaggactcgaaaaaacccaaaaaaaagctctttttaaacagagggatacatttaaaattcactgtaatcagcttgatagataacgtgcggggattcactataatcagtcctgtctgctgatgtgcacgccagaggcaacattcactgtaatcagtaattgtgtgttcggaagaggaaacaggaactaacaataataatagtgagcgcctacaaacatataagcaattgattaatatcacatttaaaaaaaggggtttgaacagagagttttaggcagtacgcttttactgactatagtgaacggcgctgattacagtgaacaccttgcgcactacatcgcacgggaatagcggagaagagaatgcggatgtcactttcaggcaaaagtgacactgcaacgcaggatgtactgattacagtgaaccttcgggctagtcctcaaaatcgatgtcttcgagcgtatcgattccctcaagattgcttatgccatcaagctttggcgttctgctgtgaatgatgaaaaacacggaacgcccgcgtttaacttcagaataatcaaggtaaccaatctctttgagctgttccatcgcgcgacgcaccacatggttctgagtggtaatttttgatccgagattcaggcgcatgcgtaaacgcgcaagagaaataggagcaggattggttggcaggctctcaaggaacgtataaagcgcctgagccgattctttacgcttaaggcgggagatggcgcgtagttgcagtaaaaccttgtggtcgaagttgtagagctcaaatagcttaggatcggcctgtatgcgcacgatatctttttcacgatcgtagtaggccgactggacaaggtgcgtatggtaggctttaccgttaccttcaaaagaaagcgtattcgtcgcgatacgacgtaatgaggcgtcaaggcgcttgcgtaacgcagcagaggagttcgcagaaggtattccgcacatcttcacgaaatcaataaagggcagcgtcaccgtgtctccctgtgtcggatagcgggaaaatgactggataatacctgcccatgtcttaaagtcattatccatatccagcctggcaccggtgatggtaatcttttcataaccttccgctttaaccagcgaaaggtttttaagttctttagtggcatcggttgaagccatcgcacccgagatgccacgcgctgtggatttaagcgtgggcacaaacaaacccaggcgcattaaagcaacaggctggacggtattatttttgtttggatgaagctggataacttcgccactgtttttggtcacagacagaaaaggctctagtaacgctttgttttcactatctttatctgccattggataagatcttcattctgtggatgaaaaggatcgttttctgactacagtgaacattagcactgattatagtgaactttctactgtgtgtagtgaataaagtactgattacagtgaatactttactgattacagtgaatgacaacaccctctcagcccttgtgtggtgcggcctgcggcgatcggggatctctttggatctataagggatctctttatgatcgttatataggaactaatcactgtataagtggataactcaaaaaaaacagcctctctgcgcacaccttgcgagtatcctcacagcctttgctcaaagcatagcgagaaagtcgatcataatgattttctcaaaggatcattctctttataaattctgctttcattttttataaacaacttgctcactattattcatttttcatcagcatcatcccagcgtatggtgatcgcgtctcttattgataaaggatcaagtccatgactgactttgcgatttcacgtaatcccacaacaggcgagattcttgcccaatacccaatgcaaagcgcttctgaactggagcaagcgctaaataccagcgcaacggcttacaaagagtggcggcaaagcagcatggcaacccgtgtaagcgtgcttcgtcaactgagccaacagcttcgtgagcgcgaacctgaactgacacggatgattacccttgaaatgggtaagcccgttgcacaggcgagaggagagatcctgaaatgcgcgaacctgtgcgactggtatgcggaacatggacctgcaatgctggcagaccagccttcgcaggttcctgatgcatggcagtcatttcgtccaatcggcgttattctggccgtcatgccgtggaatttccctttctggcaggttctgcgcggcgcagtaggcatgctacttgctggcaatacctacctactcaaacatgcccccaacgtcatgggcagcgctacgctgatggcagaattgtttgatgcgactgacctgcccaaaggcggttttaatgtgattaatgttgataacgaaggcgtttcagctgcaatcaaagatgatcgcatcgcggctgttgctgtaacaggtagcgtccgtgccggtgcagctatcgcagcacaggcaggtgcggcattgaaaaagacagtgcttgagttagggggatcggacccttttatcgtgctggccgatgctgaccttgatgaggccgtaaaatcggcagtaacaggccgctatcaaaataccggacaggtttgtatggccgctaaacgctttattatcgaagcatccatcgctgatgagttcaaaaagcgttttgttgacgcagtcaaatcactcaaaattggcgatcctcttgatgaacagactttcatcggtccgatggcacgagccgatctgcgcgatgagctcgatgagcaggtcaaagccagtttgcgtgaaggtgcccgtttggtgttaggcggcgagaaaatagcagggcagggcaattattacgccccaaccatccttgcagatgtcaccaacgacatgaccgctttcagacaagagctgtttggtcccgtggcggcaattgcagtggcaaacgatgctcagcatgcgctggaaatcgccaataacagcgattttgggctgagtgcaacagtctggaccgctgatgaagaggttgccgcacgcatgagtgatgagctggaagtgggcgcagtctttattaacggcaatggcgcttccgatccgcgcgttactatcggtggtgtcaaaaagagtggctacggccgcgagctgtcacactttggcgtgcatgaattctgtaatgtgcagacagtatggaaaaaccgccgttaatgagccttactgaagtttgttctgcggattcacagctaaaaccggcgcatcgttgtgcgccggtttattctgaaggactgcgcgacagaatgatttgactgactgttcaccacagcaggttatctgaagcgccccggatctgaccctcaggattccgcatcctcaaaccagcccggcatcggatcggaaagcgtcacccagtatgcgggcccctgggccatttcctgtggcgttaagagcgcggcgtcaagcgcactacgcacctgtttctcatccatttctataccgataaatacgagttcttgtcgggcatctccaatgccatccagccagttttctgcaataaaattaagagactcagtatcctgaggccatttctcacgtggaatgctggcccaccagcttccggcatgtccatgacgggcaaccgcccctgcctgtgaccacattgcagcaaattccggacggctggccagccagaagtagcctttggaacgaatcacaccatcaagctggtggttaacagcatgccagaaacgttcggggtgaaagggccgcctggcgcgataaacaaaactacgaataccgtactcttcagtttctgattggtgctcgccacgaagttctcttagccagcctggtgcctgcgctgcctgatcaaagtcaaacagcccggtatccagcacctgatcaagtgggacgttaccaaaatgactggtgatgatatgcgctcgcggattcaatgaatgcaacattgctttaagcgtctgttgatcttcctcgctgatcaggtctgttttattaacgaccagtacatcgcaaaattcgatttgatcaatcagtaaatctacgacagaccgttcatcttcttcgcccagggattcaccgcgcgcctgcagtgagtcgacggaacgataatcacgaaggaagttataaccatctacgacagtaatcatcgtatccagtcgggcaatactggataaactttcaccgtcctcatcggcgaaggtgaaggtttctgccacgggaagcggttcagatatgccggttgattcaatgaccagatgatcaaaacgaccttcctgcgccagccgtttgacctccagcagcagatcttcacgaagtgtgcagcatatgcagccattactcatctctacaagcttttcatcggtacgcgacagctcagcaccgccgttgcgcactaacgccgcatcaatattgacttcagacatgtcattaacgatgacagcaatacgtcgcccctcacgattgttaagaatgtggttaagaagcgtggttttacctgcgccgagaaaacccgacagcacagaaaccggtaaacgagtgtcctggaagtcggggagggaatggtgtgccatgcgttatccttcaaatcagctttatatataatgttataacataacaaaatgaaggtaattttcaacactgtttgtcaggatgatcgaaacgcacactggcagcgagaagcggggctgacccgtttctaatctccctgcgctttaatgggttttgattttaaatgatatgttataacattatacattctgggaaatattatgtggtaaacagaaatatcatgacacaacttaaaagcctgttttacagcgcgattgcgggcctgatagtggcttcattgagtgcttatgctgacgagaccagatcggttcgaattgcggccccttttgaaattaaagggaccgatcctgcactttccggcgatattttacttcgcatggatgtcgttgaaacactcgtggagacagatatcacaggtgcgcctgttcctgcgctggcagagagctggcaggcttctcctgacggtctgcagtggcgtttcaggctgcgggcgaacgcgcactttcacgatggatctctggtcaccgctgaaagtgtcgtaaaatcactgaatatcgcccgcagtaagccgggtttactggataaagccccaataacatcgattgtcggcgaagacagacaggtcaccattacgctcagtgaaccctttacgccgctcctggcggtactggcggaaagccgttcacaaattctggcgctggcatcatgggataacgcaaacgccatcacgcgcatcattggtagcggtcctttccagttagtccgtttccaaccgcctcagacgctgagcgtaaaaagatttgagggatactgggggaataaacccgccgttgttaacgctgaatttttatccgcaggacgtgcagaaacccgcgcactgttggccgaaagcggagacgccgattatgtttttaaccttgatgcagccagccgccaacgcctgtcacaaaaaaaatccctgcaacttcttaccgtttccgttccgcgaacggtgatgctcaaactgaacctgactcatccttttctcaaagagcaaaccacgcgagaggcgttaagcctggcaattaatcgtcgcgcactggccaatgcaatattgcgctatcccggcgcagcaacacagatgtttccgccttcaatggcggaatggcacaatcccgcattaccggccctggatttctcaccacagcgcgcaacagcattactcacacaatcaggctggaagcccggtcgggatgggattctggtgcgcgacgggcagcggtttacactgacgctgttaacctatccggatcgcccggaactgccgttaatcgccatggtgatccaacagcaactgcgtcagactggaattgatgtcgtcatcaattcaaccaactccagtgaaattcctgcccgtcatcatgacgggagcctgcagatggcgctgttcgcccgtaattttgccttaacacccgatcccaccggcacgctgcttcaggattacggcacccagggcggtgactggggcgcgatgaactggcatgacaaggcctttggcgaggcgctcaatacgctatcacgccgttatgatgttgcgatgaggcaaaaggccagagaggtcattacttcggctttacagcgtgatttgcctgtgatccccatcgcctggtatcagcaatcggcagcggtcaatgtcaatcttacctcggtaacgcttgatccctttgaacgccatttcggtctgcgtgatatgagatgggtgaagtgatgcttaaacaactcagctggcgcctgtgccaggccgcttttgtcgttctcaccgtcggcatcttaaccttcgttctggtgcaggcgttaccgggtgatatggcctggcgcattgcatcggggcgttatggttatgatcgggtcgatctggccgccgtcgccaaagtacaacagcaactggcggatatcactgctcagggaagcgcactgtggcaatggctgtgggatctgctgcgcttcaattttggtcattcactggtgtcgggtgagccggtaagcaacgaactggcctggcaattaaaacaaacgcttgcgcttgccggcttctccctgttgctgacgttgttgctggctataccgattggtctctgggcgggctgccatccaggcggctttttggaccggctcattaactggctggcagccatactcaaatcgattccacattttgcgttgggcctgctgcttgtcgtgttgtttgcgctgcgcctgggctggctgcccagtgcagggcagggagagtggcgacatttcatcctgccctcaatgaccctggcgttgtcactgagtgccgtgggcgcacgtgtggtacgtgaggcaacgcatcaggccgtcaccgcaacctggtatcgctgggggacacagaaaggactgtctggctcgcgtctgttctggcggcacggtctacgcaacctcagcgtgccggtcgtgacctggctcggcatgcagtttgtctggttggtggaaggtgtggtggtggtcgaaacgctgttcgcctggccgggtattggccatgcgctggtgcatgcgatttttgcccgggacgtgcccgtaattcaggcctgtgcgctggtactggggctgacgtttgtcactttaaatatgcttgtcgatggtttgtgttacgtactggacccaagggggaaacgcgcatgacctaccgtcaaaaaacgggtctgactctcctcctgttgttgctcgcgttcgcctggctggtgccactgttgagttccggggaccccgtgcaacaggacctgctgcagatgttacagcttcccactggagaggcctggctgggttatgaccaccttggtcgttcaatgctggcccgtttaagcgcagcgcttcgtctgtcgctggggctggcggcgatgtgcgtcattacggcactgacgatgggcaccctggcggggatcatcagtgcctggcacggtggctgggttgaccgcatatgcaatgcgttagcggatatgtgcctggcgcttcccggtctgttgctggtgttgctgttagccgctatcgcgccagactcgccaggcatgttgtggctcggtatttcactggtactgtgggtggagtttttccgtgtgacgcgagccgccttgcggcccgtcgttacgtctccggcagtccagtcctctttactgcttggtttctcgatggtctatctgttgcgcagacacttgtggccagcaatggcgcctttgctgctgacattaacggtgtatgcgtttagcaatgccattatggcggtgtccgcattgggattcatcagcgtgggcgtacgaccgccaacgccagagctgggactgatgatgacagaactctttccctatgcctgggaagccccctggcttttactgcagcctgtaatggcgctttttatcgtattgatcggcctgaatttattggtgaacaaggagcgtatatgactggcatggtgataaaacaggtcgccgtttacgccgaacactgcatcgtcgagcctgtgagcatggtcattcaaccaggcaggcccatgacgctggtcggggaaaccggatcggggaaaagcttattcgcccaggccatcatgggcgcattacctcaggggctgtacgcaaaaggcaccgttgagatcgacgggcaacactatgatctccaaaccgatttgcttcatcttcgggcgctgtggggacaccgcattgcatcactgccgcaggaaccctggctcgcgctcgatccgacgatgcgcgttaatgctcaggttgaagaaggttaccgttatgtacggggattaacgcgtgatgacgcccagcagtccactgcagaagtgctcaatcatctggggcttacgcaggcctcagcgcgttttccctggcagctttcaggcggaatggcccagcgcgtttgttttgcggcggcacgtgctggtggggccacgatgttgattgctgacgaacccactaaagggttggacgtcgctcgacgggatgaaataggtcgcctgttgaacacggcggttgcccggggcgaaaccttattgacgatcacgcacgacattgcactggccaggcagctggctggcgatgtcatggtgatgcataaaggccaggtcattgagcagggcactgccaggcgggtgctgagcaggccacaagagcgctacacgcaacagttgctggcggctgaaccgcaggcctgggcaacaggcttgcgggtgccctgtgatgaaaccatcgtgttacagtcagaaggcctttcgctgaaacgttcaggaaaaaggctgtttcacgatgcggctttaacctttcgggccggtgaaatcgtagggctttacggcgaaagcggctgtggtaaaagtagcctgggagatacgctgtgtggtctggtaaaaccggatgcaggcagagtcatacggcccggcaagatcagtaagttacgttaccaaaaactgtatcaggatccctccgccatttttccacctgacgtgtcgatggcacaggttatcgatgatgtgctgcgcctgcaccacgccacggttcagcgacgtgatgaactgatggtgcaactgggattagcgcatgatttactgagccgtccggcttctggtttgtcaggtggcgagcttcagcgtttttccctgctgcgggtcatgctactggaccctgtctttttatttgccgatgagccgacgtcgcgtctggacccgcttgttcagcagcagacgctggcgctacttaccgggctggcaacaaagcagcgttgtgccattttgctggtcagccatgacctcgccttactggagaagagcgcgcatcaagtcatctcactggcttccctcagacagggttccgcagtcatgactgcgcatgggtaaacgaaggcagggaagcctgccttcacacgtgctccatgaccaacacagccagcgtgtcgggctcaagcgcgcggaaaatatgctcactgtcgcccggataactgatgtaatcgcctaccgccagttcaaccggtgaatcgaccggacccaccagcgcacgcccttgggttaaaattaaatgttcaatggtattgggcgaatgcggctgtgagcagcgttcactaccgggctggatgtgcaacaaatagatatcccgtcgagcgcccggtgggcaggttgccaacagcaccgctttatagtcagcctgctcggcggctaccgctggaccctcgccgcggcgaataacctgcaggcgattcgcttccggctccatcaggcgggcaaaaggaatattcaacgccacacacagtgaccacaatgtttcaatgccgggattgccattaccggcttcaagctgagacagggtcgattttgcaatacctgcgcgacgggccacctctgcgagcgtcaggccagtacgctggcgttctctcactaagctattggcaatgatgttaatgggcgtactcatcattcatcctgttcattaaaacgaacgtatcgttcatcttgtaatacatgttggatgttcattataatggataaaacgttcgatatgggatttgattttgatgccggcaaaaaaaacgacgctcgataagggcgtgattaaagcgatttttctggtctgtatcgcagatgggattgtaggcctgtcttatggttctcttgctactgcggatggctttccgttttgggtgccactggcgttatcgactctcgtactggctggtgcatcagaattcttatttattggcatcgtggcaggcggtggcagcccgttgactgcggcggcggcgggcctgctggttaacgcacgccatctccccttcggtattgctgttaaagatttggtgggtcagggctggcgaggcctgttcggctgtcacatcatgaacgatgaaagtgtggtgtttggcatctctcagccaacactggcccagcgccgcagtgccttttggctgtgtggcatcggtattggattgatctggccatttagcgtgatgcttggggccgcgattggtcagtttatcccgagtatctccgctatcggtctggatgccgttttccccgccattcttatcgccctgattttcccggcgctacgtaaaccccgcacctgtatccctgcgacgacaggtgcgctggtgtcgctggtggtcacgccatttgttcccgcagggatgccggttctgttttccctgttagggctgctgacgtggagatcgcgtaaatgaatcacccgatgattattgcaggaattgcactgctggccgccgggacctatgccattcgctatgccggcgtcaaactgggtaacaggttgcctgtcagtgaacggacgcagcatatgctatctgatgcggcaaccgtgctgttactggccgtagcggccaccaccaccctgtttgaaggcccgcattttgccgggatggcaaggttgttgggtgtgtcgtttgccctttttcttgcctggcgtaaagccccgcttatcgtgattattttgggcgcggcctgtatgaccgccttgctgcgttatctgaatgtgccttagacgctgatgacaaattgttgcgtcagccttgacgtaagacgcagcttaaaatacaactagaacccgtcaggggagtctcgccagagagactgagaggctaatagcgcaatgcgcggcttagcgacccttagaacctgacccagttgatactggcgtaggaagacgggtatcttcgcccagtgcagatacttgccgcagagcctgcttttactgtgctcatgctttttcccttctcgtatcacgggtctctgatttaaacagagaggccaatgtgaaaatcctgtttctgattttacgctgtcaggttggctggcaatgagccgctggtcggtgctgggcagtggtgtgtccgggctgtgcattgctacgttactggcggagcgcggcgaaaatgtcgaaatcatcacgttacctgattgccgggcagcttcccactgggctggcggtatgctggccccctggtgcgaagcggaaagtgcgccgcagcaggtcgtggactggggccagcatgccgccgcatggtggtcggcccgcatcagcggcgttgaacaaaagggcacgctggtgattgcgccgccgcgcgaccgtgctgaattaacccgttttgcgaacatgacgtctgaacatcagtgggtgatgcctgcagagatcgaacccgcgctggaaaaccgttttgcgcgtggactatttttcgctgcagaagcccatcttgatccccgtctggcaatgcaacagttacaaacgcgcttaatcaatgctggcgtgaattttcacagcggtaaacccagtgggaaggttattgattgccgtggtatccatgcccaggaatccctgccggcactccgcgccgtacgcggtgaaatggtcatcctgcagacgaatgagataacgttctcccggccggttcgccttctgcacccgcgctttccctgttatctggtacctcgagcgcaagggcattttatgctcggcgcgaccatggtcgaaagccaggatgacagcccgatcagcgcgcgcgcaatgatggaactgttaagcgctgcttacagcatccatcctgcccttgccgaagcacgcatcattgaaagcggtacgggtttgcgtcctgcttaccctcataatctgcccgatgttcgttatgaaaacggcattttttccatcaacggtatgtatcgtcacggcttcttattggccccgatgatggccgagaagcttatgcaacaacttacgtcagagggaatacgatgaaaatagaactgaacggccttgctattgagactcaggcccggacgctggctgaattgttggcggaacaggatattgatgcgggctgtgtcgccagcgcgcttaacggcacctttattccccgggaacgctattcctcccaaccgcttgaggccggttgtcgtctggaagtgttatcaccgatgcagggaggttaacgatgttttacgactatagcgggcagtcacgttttttactgggcacggcgggttatccctcgccagatattttgcaacaggccgtcagcgcatcgggcgcagacattattacagtcagtttacgtcgtgaaggaagccagggcggcgcatttcgcgaccttctgaaaacgctgaataaacgcgtattaccgaacacggcaggctgtcatacggttaaagaagccgttaccactgcacatatggcgcgggagttgttcgccacgtcgtgggtcaaacttgaagtgattggtcatgccgacaccttgcagcccgatccttttgccctggttgaagcggcgcgtattttgtgtgccgagggttttcatgtctttccctacaccacagaagacctgattgttggcgagaaactgctggatgctggctgcgaagtgctgatgccatggggcgcgcccatcggttccgggcagggattacgcaatattgagggcttacgcacgatgcgtgcctggtttaaagacgttccgctgattattgacgccgggatcggtgcgccgagtcaggcggcccaggcgatggaattaggtttcgacgctgtgttactgaataccgccgtcgcgaaatccagcgatccggtgcgcatggctggtgcctttgctggcgccattgacgcgggacatcaggcacgtcaggcagggatgatggaacgccgcgacatggcggcggcgtccacgcccattttcgggctggcccagttcagctaaggagcggtgatgtcgcgttatcaacgacagacaatgctgccagacgtcggggagcaagggcagcagtccctgtcagctgcgcgtgtcttagtggtcggtgcaggtgggctggcttccacgctgctgccactgctggctggcgctggcatcggttatatccggctttatgacgatgatgttgtggcgctgcataatctgcatcgtcagacgctgtttaccacggccgacattggcgagccgaaggttttttgcgcgcaacgcgcgctggcacagcgtaacccggatacggttgttgaagtatatcctgtggcgttgcgcgccagtattgttgaggcggcaatgacggatatcgatctggtggtcgatgcagcggataacttcgcggtgacttacctgctttccgatatttgctttgcccggggtgttccgctggtttgcgcctcggtgctggagcgacagggctatgctggcggattttgcggcggtgcgccaagctatcgcgcactgtttccacacttacccaaagcctcaggcaactgcaacactgcaggcgttttgggtccggcagtcgccaccttaggtgctttacaggcgcagatggcactcagtatcctgttgaatttgtcgccttcaccattgggttgcatgattaattgtgattttgtgtcctggcaactgcgtcagttccgattcgacaatgcgcccgaacctgaaaaagccggaattccgtttatcgattcggccctgttaaccccaaacgactgtgtggtcgatttgcgcgggaccgacgaagcacctgttagcgttattcccgatgtgacgcggatattgccccagcatatcgccagctggcagccgcccgcggacaaacgcattgttctggtctgtgccagtggcattcgtgccgcccaggctgctctggctctggaagcgcggggctgtcagcggctggcaatcattgcagaccgataacacagacgaaaaagcgggatgattaattctggtctttgcggttggtttgataaatgtcgggtcgggttatagtccaggcataatcgggtctgttcactggctgataaccgaatttctggtacaaccagggggcggttgaagtaaacagcaagagtcggcgcaatgtgttaatgacagaatgggactgacagcattcaatcagccatccgccgagcccgctaccctggtattcttcaaggacatagacatcacacaggtatgcgaaggtcgcggagtcggtgataaatcgcgcaaaaccaatctgctggtggtgatgaaacagcccaaaatttaaactgttttctaccgacagtgccacggtggcgtaatcgataccggctgcccaacttgagcgggtgaggtaacggtgaatggcctcaatatccatctgcgatttatccgtcgtaatgcgataatcgtctttgtgccagtgctgaacaggtgccatcagttttccccctgtcttcccgatttaagtgagattgtcgataaccgtttcgctaaaacatcagcctgtaagactgcgcactgcaataaccataagcagtaatccgccacccatattcacgtagcgtttcagcgataccgggttcagtttttgcgccgagaacaccagcgcctgactaaagagggccagccagataaccatgatcgcaatgtgcactgtggccagcgtcagaaaggcatcaatacccgctctgttaccaacgaactgtgaaaccaccgtcaggtaaaacaggatagctttgggattggcgacattggccagccatgcacctttgatcgtaaccgcgctttctgtcgcgttcagcgcaaaggtcttcgtcctgacgccagtgataaataaaagcccgcccagccacagtaaatagagtacgccagccatttttaacaggccaaacagcgcgggtgaagcaaccagtgccgtcgacaggccgagaccgatcagtaaagcatgggtataaatccccagtgcggtgccgagcagggttttaaacagccctttgcgaccagccgtaagtgcactgttcattgccagcgtgaaacttgcgccgggtgaaagcgcaatggggagcagcgcgggcagaaaccccgccagattaatgtccatctttcacccgcacacaacgtcttttcacagcgtggacgaaatgcgttaacaaaaattatgtcggattataaaacgcacacagcttattgccggttgggtccctgagataggcgatgcattttccatctgtttctctgacctgcggcggtgtttctgccgatgtgccaccgttttcaatcccttgttgatgccagcgaaacacctcctcggatgagggcatggtgaagccgatggttccgccgttggcaaaggtggcgggctgaccattgatgggtttggtgatgataaaacgctgattatttttaatgtaataagggcgacctatggcatcaatgccctgatcgtcacaacggataaccgcgaaaatagcatcgtagaacgttttagcttgcgcaatatcatcggtcccaacaaccatatggctaaacatacttaactcctttttaacatcggtagggatatacttatcacatccggtttattgctgaccagctatgcgtaaggaggttccgatgaatgaccatcccgttttacaggttgtcaggttatgcgacagggcgatatcagccggtgattatgatgccttgatgaaacactatgcagacgatgccagcctggtcattaagccgggaatgaccgtgacgggcagcgtagctattcgccgtgcctttgaggccattgccaactattttcagcatcagctggtggtggagcagggcaggatggaggtcattgaaggggcaggaaccgcgctggttatcatggagacggtgctccgctatcccgatgggcagggacagtcgatagaaaacacccggcgtgccacttatgtgtttcggctggaaagtgataatcaatggcgctgtaccgtagataattcctatggcaccacgctacttgatcacgtgctttagcattgctgcttatgggcgcgtcatctgaacggtctgagccgttaatccgcgctggatgctggcgcgaattaacggctttttttaaatcacttctgccagctggaaggtttcgaatatcagttccatttcggtgctgaacccgccgttacgctgaaaatagcgttgatgttcgcgctgccagtactcaaggctcaggtcaccttcgccttccattatcgccatttctggcgttacgcggtcaaagcgcgtcacaaacaaccctgttgttctgatgacgcaaaccggtttatccgcgccgtttaaaatgatgctgtaactgccgggttgaggcttcacatcatcttcataccagccttgcagagagctgcaggtggcgatttttttgccggacagcaccagcgtcgccagcgcattggccatctcgggagaatcgccaaatgaccagcaaagtgcgtcaggatatttggctttaatctgttcaagcgtcatcgtcatactcagtccttttaccgcggggccagaatggctggagcattacgtcaggccagaatacgttgtgcccacacttcaaccgaatcaccactgcttatatccggttgtaccaggccattaatcataaaggtcggtgaaacatggataccgttttgacgggcatatttacagtgccatttcaccaggtcttgcaaatcatgacgatcaaaggcggcgtaagcatcgatgccgctgtattctttcagcctggcaagaagctggtggggcgtgacgtccatatttggaccccggcaatggtctgtaaactcaaacgcttcccgatggtcggcaacggcctgaagtaccgctttagccgccgctttgctttccaccgaagccgccaggatatagcgaacgatcacgcccgaatacatgtgccagggctgagactgaagatgaattttaagcgtcattttatcttcaccgacctgctctaaaagcgcatccagtttattgaacgcgcgcacggagaaggggcaggtgggctcaataaaaatttcgaacaggtgaggtccctgtccccaggtgagaggttctgctcttagcttttcgttgttcatcccaactcccattagctagttaagttccgggttcactgactgtggcaactttacgcgttttctgccgggtattcacctcaggagccgtttatccaccctgataaggattagtctcatttctcttacgttacggcaaatcagactaaaattattccttcaacggtttcgctttatgtgcacaacgtttaaggtttcaggattgttaaatcatgatcttaaacactattttgcaacgcgaaggcacaaagcggcaaactgatgcgagttgaaaaccgctagagtaacccgtttatcaacccggaaccgggcgtcgcgttttcctggcccgggacgtaaggattattgaatgtcgcattttcgtccggtcgcgctcgaacatgcaagccgcctgctgaatcatgggccgacgatattaattaccagtcgggacagtcagtctgagcgtcgcaacatcatggctgcggcctggtcagtgccggtagagttttcgccgccgcgggtggccatcattgtggataaatcgacctggtcacgtgagctgatcgaagccagcggcgcatttggtatttgtgtgcccgccgcaagttttgtcgacctcacgtatgccgtcggcagcacgacaggacgcgaccaggacaaatttgcggcgttctccattcaggccagtgagagtcagcacttcggtgtgcctctgttggaagagagctgtgtcgcctggatggaatgccgtttactgccggaaacagaagcacagcaggcatatgacaccctgtttggcgaagtggtcactgctgctgctgacagtcgggtcttttacgatgggcgctggcattttgatgacagtaactcagccctacatactttacatcaccttggcggtggccagttcgtgacggtggcgaacacgctgactgccaaatcaacgcgttaaatgaggtacagaatgacaattaagagttacgcagccatgcaggcgggacaagcactggagcgttacgactatgatccaggcccgttagacgcagaagatgtcgaagtagaagttgaatattgcggtgtatgccattcagatctgtcgatgatcgacaatgaatgggggatttcagcctatcccgtggttgccggtcacgaagtgattgggcgcgtggctgcgcttggcgacagtgccaaaagtaaaggcctgaagctgggacagcgcgtgggcatcggctggacagcgaaaagctgtcagcattgcgatccgtgcatcagcggcgatcatgttaactgtgccaatggcaccacaacgaccatcggtaacaacggtggtttcgctgataagctgcgcgctaactggcagtgggtcattccactacctgaaaagctggatgcggcaacggccggtccgctgctgtgcggtgggatcaccgtatttaaacctttactgatgcataacatcaccgcgatgagccgcgtcggcgtgatcggtattggtggtctgggtcatatcgccatcaaaattctgcatgcgatgggcgcagaagttaccgcgttcagctcctcggccaataaaaagcaagccattctggatatgggcgccgaccacgtggtgaacagccgtgatccagaagcgttaaaagggctggcgggtcagtttgacctgattatcagcactgttgcggttgatctcgactggcaaccctactttgcggcgctggcaccacgcggtaagttccataccgttggtgcagtattgaagccgtttgatgtgcctgcctttagcctgattttaggcgaccgtgccgttaccggttcttcaaccggttcacctgctcagttgcgttctctgttgaaactggctggtcgcgcggatatcgcgccgacggtggaatatttccccatgtcgaaaatcaacgaggcactggaacacgttcgcgcaggtaaagccaactaccgtgtggttctgaaagccgatttctaatctccggcgcgcctttctggcgcgccttttttctttcccaccaatagcgcggctaatctctgttaaaattaaatcctcacgcctgatgccggacgtctctactggagaaattatgttgtggatttggaatgccctgatcgtgttgattactgtgattggcatggaagtggttgctgcactggcacataaatacatcatgcatggctggggttggggatggcatctttcccatcatgaaccacgcaaaggcgcgtttgaagttaacgatctttatgccgttgtgtttgctggattatcgatcctgcttatttatctgggcagtacgggaatgtggccgcttcagtggattggtgcgggcatgacggcctatggattgctctatttcatggttcacgacgggctggtgcatcagcgttggccgttccggtatattccgcgcaaaggctacctgaagcggttgtatatggcccaccgcatgcatcatgccgtaagaggcaaagaaggctgtgtttcttttggttttctctatgcgccgccgctatcaaaacttcaggcgacgctaagagaacgacattcggctaaatcgggcgctgccagagatgggcagggcgaggcggatgaggccgcatccgggaagtaatggcctgaccggatgccatcaacagaagcgataatttttcgggtgtcgtggttgactgccgatggtcccaggcttctgttcctgcctgttcaaccttcaccccaattttacgataaacctgcttcgctgtggcgatggcccaggctgagcgcaagggcagcccggccagtcccgccgtagcggacaaatagtaaggttcggcttcctgcaccagacgtcgggcgatgcggctcagcgcctggcggttttccggtgccgcataattttctttattcagtccttcattttccagccaactcgccggcagataacaacgacccacatgcgcatcttccacaatatcgcgggcgatgttggtcaactgaaatgccagcccaaggtcacaggcgcggtccagtgtagcgttatcgcgtacgcccataatctgcgccatcatcaagccgaccacgcctgcaacgtgatagcaataccgtaatgtatcgtccaactgaatgtactccgcctcacgcacatccatggcaaagccttccagatgatcaaacgcgtaagcgggcgcaatatcatgggccatcgccacttcctgaaacgcagcaaacgccggttcgtgcatctgcgatccggcataggcctggcgcgttttcatctccaactgcatcaggcgttgctcaggcgtttgtaatgacggctgatcggtttgaaaacccagggtttgatcgtcaatcacgtcgtcacaatggcggcaccaggagtagagcataagtacactgcgccgggtttttgcgtcaaataactttgaggcagtcgcaaaacttttcgagccaacagccatcgtttcgaccgcatgattgagtaacgacggattattcaaatcaggtcctccagcattaaacctgcagttgccttagccgagccgatcacgccgggaatgcccgcgccgggatgggtgcctgcacctaccaggtaaagattattgatggttttatcgcggttgtgcggtcggaaccaggcgctctgtgtgagaacgggctcaacagaaaaggctgagccttgataggcattgagctggtcgcgaaaatcgaacggcgtaaacattcgctgcgtaaccaactggctacgcaagccaggcatgtaatgttgctcaaggtactcaaaaatacgatcgcgcagtcgcggcccttcaaccgtccagtcgaggttcgctgtgcctaaatgtggcacgggagctaacacatagtaactgccgcaaccttccggtgccagtgacgaatccgtgacacaaggtgcgtgcaggtaaagtgagaaatcgtctgcgagtccgtcatgattgaaaatttcatgaatcagctcacggtagcgagggccgaaacaaaccgtatggtgggcaagctgatcgtgatggtgattcagaccaaaatagagaacaaacaatgagttgctcatgcgcttagtttgcagttttttcgactgcttcacggcggcaggatgctgacttaacaggtcgcgataggtgtgaaccacatccgcattggaagcgacagcccgggtcgggaatctgcgtccgtcctctaaatgcacggcttcaatggtatcccccgtggtttccatgtggctgaccttcgcattcagtaccacttcgccacccagatcctgaaacagctttatcatccctttcactaatgccccggtaccaccgcgtggaaaccagacgccccattcgcgttcgagtgcatgtattagcgtataaatggaggaggtggcgaagggattgccgcccactaacagcgagtgaaaagaaaacgcctgacgaagatgttcatcctcaatgtagctggcaactttactgtaaacgcttcgccatgcctgcagtttcgccagttggggcgcggcgcgaagcatatccctgaacgacaagaaaggcacggtgccaagcttcagatagccttctttaaacaccgcacgtgaatagtccagaaactgacgatagccttcaacatcgcgtggattaaactgctgaatctgcgcctcaagctgtgcctgatcgttatcgtaattgaaaacctttcctgactcccaacacaggcgataaaacggcgcaaccggcagcagttcaacgtaatcttttaactgttttcccgccagggtaaagagttcttcaatggcgctgggatcggtaataacggtaggccctgcatcaaaagtgaatccctgatcttcatagacataagcccggccaccgggtttgtcgcgttgctcaagcagtaagacagggatccccgccgcctgcagacgaattgctaatgccaggccaccaaagcctgcaccaattaccgtagttggtttcatgttgtcgctctttaacgatgagtcgtcataattgcctgcaatgccgctaataccggaacaggcggcttgccgctcagaatacgtagccgatcggtcagcgtgagtttgcccgcataaaaacgggagattaaatcttcaggtaaaccatagaagcgctgcataacacgccagcgtgaatcggcgggtcccgctaaaaacagcatgcgattcaacatgcggaaaaagcgttgctgctgccagcgctcgtgggcaaagtgggtaatcgcctgatgaattgaggacgatgtaaagacatcaagcgcactcaggcgatcggccagcgcaaccgcaagggggagtgaataaccggttgtggggtgaaacagtccggcacgcagtccactgcaggctaaaggctgttgctgccaaaacgcggtgctatcgcccgttaaggttattggcaatgcgccctgttcctcacgaagcagagtctgaagctgccaatcctgctgggcagcataatcgcgaatattttgtcgcgcgcgttcaggttccagtgtcgcgttatcgatatagtgggtatcttcgattaacagttctgtcgcagatagcggcaggctgtaaacaaagcgataaccattttgctgatcgaccgtggcatccataataatgggtgaagataaaccgtgcggtttactgagtcgccattcctgtccgataaacgcctggaatcccacgttcagcgctgaatttggcgtataacctcgcccatcaatcaccgcgctggcgctgatgacctgaccattattcagtcgaacagcgtcggcgtgaacctctgccaccgcgcggctaatccataagtgctgaccaaacttctgttgtaaaacctcggcaaaacgctgcgaagtcacagaaaaatagccgctgttcagcttacgacgccgcgtgggaaagcggacctgatagtcgggccagtgatataccaccagcggtgctacccagcgatgttggctctcggttaaatcagcgtcgtgaaaggaccaggtatgattaccgcccgcctggggggccgcttcgataagcagaatacgcatgtcaggttgctgctgctgaaggcgcagggcaatgaggccattagccagcccggcgcccactaaaatcagatcataatgcggtcgcatagccgctccccttcaaaacgggctggccggtgcgcatggcctgctcaacgatatctgcagcggccattgtgccgccggctaaacgaagggcggtctggattttcgtcatgcgttgcgggtagtcgacgttggtcagcaatgcacgcatctggcgcgccagcgcatggctggtggtaaaacgggacgcacgttttcctatcccatgataaacaatacgtgaggccacgccgggctgatcaaatgccaacggaagggctaaaaggggcgtgcgataattaatggcatccagcaccgtattcatcccgccatgggtaatggcaagctgcgcctgcgacagcgcggccgactgatcggcaaaatccacaacctgcgtgtgacggcttcgcgccagctcttcggcctgaaaggcagtcaggcggccacagtgcgccaacagaagctgaccatcaatctcttcacaggctttcacgatggctttaaacagaccgtagcgatgaccctgcaacgtgcccagcgaggcgaaaattcggggcttttcagacggcgaaaaataaagcggcgaagaggttgatgtcgtctgcgtttctcgcagggggccaacagcatgaaaacaagccggtagcgctttacggggaaaatccagttctggaataagctgactgatttgtgccaatggcgaaaaacactgatggagtttatcccggggtgctaagcccatcctgtgactgtgatgggcaatgacgcggtcatgccgacgcatcagccagtcataaattttttcgctggctgcatagcgctcacgtgcggcatcgctggtgccatagtcaaaaggcatcaccgccaggggcaaatccggttcgcgattaagcgggagtgcacaggcaaccgagacaaacggcagccccagcgcttcagcgaccagagcgcctgctggctccatctgatcaacgatgacaccatctatcgccaaatcgttaaaggctctggggagcgccaggcacagcatatcgctggtgcgcgccatttcattgatgagccgaagcattgacggccccagaggatgggccgctaagtgcagcaggcgcgataatgagccagacggatggctttcttctcctacagcatgaaatccgatgtggggatgctgaatgagtggtttagtgtcctgttgctgaataaaggtcacctgatgaccgcgagccactaactcctgagcgaggttttccagtgcacggacatggctgtaaaaaggcggagcgatcgccgcgaagtggctcatgcagcatccttaactgacggcagcgagttttttgtcaaaccaggcctggataaattgttgagtagaatgaccgttttgacacgcggctgagaggtgctcactggcgagatgcagatgctgccgcagacgctcttcaactgctctggagcctaataaattgaccagggtcgatttgccttcatcctgattgatgtccttacccgtgtcagccatgccatccgttaagtcgtccagcagttgaaacgcttggccgagatcaagcgaaaaacggtgtaggtaatcgcgtgcttcgctggaggcattcgccacaattgaggccatctgcatagacgcgcaaaacagggtgctggttttaaagtggttcgtcatcaaaatggcttcagcgctgcgcggcttatcgccttctgacagatccttaaactgaccctgtaccaaaccttgcataccaatggcgtttgataattctgacactgcgcggttttttgccagcggcgtcaggccatctgcatcagcaatgaccccaaaggctttgctcagtaaggcgaccgccgccagtattgccacatgctcgccgtactgacagtgaacggtagggcggccccgacgcatctgcgcatcatccatacagggcatatcatcaagaatcaacgatgccgcgtgcaccatttccacggcgcaggcgatatccagcaatccctcgtggctgacagcgcagcccagatcgcgtgctgtgagcaacaacagcatcgggcgaatacgtttacccggtgccagcgcgccctcacgcatcgcggcacctacaaaatcccgttctccctcgacaggcaataactgctcaagccgccgatcaatatcagccagtaattgctcagcagcactgcgagtggggtgaacgtgtttttttgcgcagaccgtcattcgggctgtccttatcaacggatacatttatgacaacgctaaaagtgcgatgccctttaaagaaacgcttaatctgccataacatggttggcaggcttacccgttatttttacatttagggtttcaggttttttctcgctaaatccacataattaatactagttgagcctgtggaaaaggtggagaattcataaacctccgtcgtatttgcctgtggcgtgacaggttttcctgagcgcccggggttcagcttgccagtgcacgtaatgtcgcaattacctgagaaacgtcattagcactgagcgccgtgtctttagcaaatttcacctgtcccttctggtccagcacaatgactgccgcaccttcgggcttaagctgccagcggtgctgtgccacaccgctactgtcgataataaactgttcccatggcgatgcttttttactggcgcggatactattgaccacaaacagactgctgccaggtaaagcatcatcagtattgacgatggtcgtggtctggaattgttttttaggcaggttggcgtgctgaagagcgtcaatgagagctgccgactgttcttttgccgataatcgacccgcaacgtgaataattaaacgtgttttccccgtcagagtcagactgttccatttttgatagtcaatctttccgctatcgagccgcatctcacctttatccgcaataaagaccgacggtagaggctgcccgacaacgatgttatgggcgtttgcccaacaggaaacgagcaaaagcgccatcaatccataatgttgcactgtgttatctctggttattgggagccatcttaccagcttagcaattttatcaatcctttgactgttttatgcccattcctgttttagatcaataacggcgggatgggattgaacaaaaatgcatcaacaattcagggtcaggaggtaagcatgcactcagatcttatgacattatctgaaatggcggtctacctgggcatttctcaggcaagcctggtcagggcgctttgcaatcaaggcgaattaaatggtgtgcctcttcccgaggcgctggagcacctgcctctgacgcaacgccattggttgagagaggatgtcagtcagtttaaacatgcgctgcaacgtgcccatgttgtccaccatgattaaatacgtggcctgaaaacacccggtatatcgttatgatcaataaaacgcccgcaccaggcgggcgtcgtatttatttgccctgctcgtcgctttcacccaggaagaaataccagagtggaatagacatcaagccggtgaataccgtggtataaagcaaaatcatcatggcctgagtgatatacatcattagcgtccagtcgctgaaagggatgttgtattgttcaatgacgccactcaccatggctcgcgccatgaccgttcccactattatcgccagaatgacgacactgcgcagaaaataacgcatctctttacgcttaacggcaaaacgggattgcacaatcgccagcggggactgtttgtccagcggtgtgacagtatcctgacgtgtggcgcgatgtgcttttcgccagcgctggatgtcgagcagggcgaaggccagtaaactcaatcccatcagcggcaacgcataacctaataccagggcaagcatcaggcttgcgccctgaagatagcgcggtaaaaccagccatgccgacagcagggtttgcacgggattaacctgcggtaatgccggacggcgaatccaccacatgcgatagcccagtacgatcatcgcacacaagcccgcgccaaacagcaccaggatgagttgattgggtagcccaaacaacacgcccatgtgcgcatccacgccccagcgcgtcagtttggcgaccagagggaaatgggcaaactctacgtggtcgacaatgctaaagttatcaggattaacagaaaccgaatcgacatggctcggccagcggcggtcaatctcactcaccgtccatgcctgacctccacttttcggttgacgtaattcaatttttgccgcctccaggcctgcgctgcgtgcggcggcctcaaccctgtcccagtcagcgtcgggctgattaaggatggcgggagtgcgggcctggtgatctgacatggctggcatagcgccgctcatcgtcataccgtccatcgtggcatggtggtcggcgtgaggatcggcaggcaccgctggcgcatcaccgtttaacgcggttctgacctgaggcgtcaaccagccaaagtcgctacgcattttatcgatattattgccagcccattgtgaccaggttaatcccgttacggagaaaaacaccagacccagcgacagcactaagccaagtgtgacgtgccaggaacgcgttaaagcaaaaccagcccctgtctttttgaccttacgacggggacgtgtgcccagccacaatacgatgccgcccaatgccgctacccataaccacgacgccgccagctcactgtaattacggccgatatcacccagcagcaagccgcgatgaacctgatcgagccacatgcgcagtggcaacacgccgctggtgccataaaccgtcatatcgcctttcacaccaagcgtataaggatcgataaaaatcgaacgcgattctgaagggcctaactgcggatctgagaattgcacacgtgttgtatcctgtgcgccaggggcaggacgaacggcatagatccgtaaattacccgcataatgtcgtgccgcattaatttgcgcagaaaggggtttggcatggccctgcgcctgcgcgtcagtggttaatgcgtctttataaataaagttctctaattgcggcgttatgacatacaaggtgccggttaatgcggcaataaaaataaatggcgcaataaacaggccaatataaaaatgtagacgacgaagtacagtcagtaccgccccgcgaggaggtggattgttttcccgtgaaaaggtcatagctattccctattttcagaataccggggttttcttcccgcacgctggcgtgaaaaaaagatcacataaaggagataaacaatcgggacaacgggggcgcgcgaggccgataactccccttcaggcgtggcaacgcaaggtgtacaatgtgttgcggcggaggggcgcggctgataaggcacattagccagatgaagggaataaacacccacaacattaacgggacatgcaccaacagatcacaataaccgcaggcgacgccatcatccatcatcatgctgtgatcggccatcgccctgtcgctgtgatgatccatcatcggcatatccgcactcatgcccgacatgaccatggcatcatggtgttcaacaagatttttagatactaccggtgcaataaacaacagcagtacggccagtatcgcaatacaggcgctcaggcgttgtcgtttatagcgggtggatttcatcatcaaaacgaggacagttatttacaatttaagggcggcagtgtaacgcggcgtagataaaagggttaaaaaaaatggcacttaagacaaaaaaattagcaccttttgaacaccttcaccttaattagctttgagtttaactttcttgttactcatgtcgtacatttaaataacattattaatctgtgttgttgttatttgagagggacttaatgaaaattgtaacgctggatggcggcacgttgcccgtacccccaccgcaacccacctggtgtagtgactggcaatttcgtcatgacacggcagaggacgagattgttatggcgctcaagggcgcgaccattgccattactaataaggtacccttgcgcgcagcaacgctggcagcgctgcctgagctacgctacatctgtgtgacggcaaccggctatgactgtattgatatcgcggcctgcaaagaacgcggtattgtggtcagcaacattccgggctattcaacgcaaagtgtttccgagggcgtgatcgcgttcatttttgccctgcgacgccagatagtggaatacgctaacagcacgcgtcatttatggcctgaatcctctcatttttgcctgcaccagacgccgatacaagatatcgctggcgcgacgttgggtatcgtgggtaagggcgatattggcaccgctgtaggcaggctggcacaggcgctgggaatgcgagttgtttatgctgaacgcaagggcagcagcaaggtacgcgacggctatgtaagctttgatgagatgctggcctccagcgatatcatttcattgcactgccctttgagtgagcaaacccggcaactgatcgatcgtgatacgctgagcaaaatgaaaccccaggcgctactgatcaatactgcgcgaggcggtttaattcatgaagcccatctggcggaggcgctacggaatggtacgcttgccggtgctgcactggatgtgcttaccagtgaaccgcctgcagcggatcatcccttactccagcccgatatcccgaatctgatcctgacgccgcatgttgcctgggcgagtcatagcggtatgcataacctgctacagggcatcatggtcaatctggctggcttcgaacagaaccgtcctgtcaatgtagtaagctaagtcagaaaatcgagcgtcccagtttatcggtcaggcactccagcgcggcagtgccggctaatgaattacctgcattgtctaaccccggtgaccagacagcgatactcatttcaccggggatcacggcaatgatgccacctcctacgcctgatttagccggcattcccacccgccaggcaaattcgcctgctccgtcatacataccactggtgatcatcagtgcattgatttgtcgggcctgacgggaggtgatcaaggctgaaccctccagcgtttttccctggttagccaaataaataaaactgcgagccagttcaatacagttcatagacagcgagcaatagtggaagtaggtctgcatcacgctggtgacgtcgttattaaaattcccaaacgacttcatcagccaggcgatcgccgcattgcgggcagagtgttcatattctgagcgggcgacatggcgatcatactgaatatcgggttgctgactgagttgacggatgatctcaagcatgcgctggcgaggcgcagtcagccgtgtctccagcaaatcgcagatcaccagtgccccagcgttgataaaggggttgcgcggctttccctgctccagctcaagttgaaccagtgaattaaaaggttggccggacggttccttacccacacgttgccatatctcggcatcgtcatagcgtgtcagagcaacgctcaaagagagcactttggaaattgactggatcgaaaaacgtgtttcagcatcgcctgcctgaaaaacagtgccatcacgcaaacacactgctatacccaggttatccgctgcgacgtcagccagtgccggaatatagttggccaccttaccttgatgaaccaatggacgaacctgatccagaacggcttccagcaatgtattactaagagtggtcacacacgtctctccagaagaatggatgatggcgcaggatgatgagcgtcctgaaggcgcaaatcaatgggttgccggtaaaattgccagacgacatctgaaatctatgcacaggttgccattgcggctcatcattcattttgccgtagtgggtttgctgatttactaaaattcggaaataaataaaagcgaggaattatggcggagatgcgataacctctggatttaatttgcattgttggtgctgtttagcacgctaattttgaggtcaggcatgcgcgcttttgtttcaaatcgacccggaatcttccgtccccgtcggttgcggttgttgcaatatcttatacggcgtgacaaaacgccgattgcattgctgctgctggccgcgctggtgggggtactgacgggattaacggccgtggcatttgataaagcggtgagctgggtcattcattcccgcctcaactggcttagccaattcgagaatcagggcatattactgggattgtgcgcctttattttctctgccgtcctggcggcgatagggtattttctcgtcagacgctttgcccctgaagcgggaggttcaggcattcccgagatcgaaggggcgctggaagaactgcgaccggtacgctggtggcgggttctaccggttaaatttgtgggtggtttgggcgctttagggtcgggaatggtgctgggacgtgaagggccgacggtgcagatcggtgggaatatcggccgcatgtgtctggatatttttcgcatgcgttcgtctgaatcgcgccatactattctggcgaccggtgccgcctctgggctggccgctgccttcaatgcgccactggctggcattctgttcatcatcgaagaaatgcgcctgcagtttcgttttagcctgatatccatcaaagccgtgtttgttggcgtgattacatcaagtatcgtttttcgcacactgaacggtaacgagcccattattgatatcggacagctgaaagatgcgccgatacaaaccctctggttatatttactgttggggattttgtttggtggctgcggtgttgcctttaatcgcctgatatttacgcttcaggatctgtttcaaaagctacataagggccagacgtcacgttgggtgctgggtggcgcggtgttggggggattgtgcggtttgctggggttaatcctgcctcaggccgtcactggcggtattacgcttatccctgatttttcagcgggtcattacacatcaacggcattactttgcctgtttttattgcgagccttaaccaccttattgtgttttgcgtccggagcgcccggcggtatctttgcgcccatgctgacgcttggtacgttacttggcatcagcgtgggtcaactctgtgtcgcgatgttcccagaatatcaccttgaagccgcaacctttgcggtagcgggcatgggggcgttatttgcggcctcggtacgtgctccgctgaccggcattattttggtgctggagatgaccaataattaccaactgatcctgcccatgattattacctgccttggcgctaccttgtccgcacaatacttcggaggaacgccattgtattcaacccttcttgcgcggacgctggctaagcagcaacaaaacgatccagaggataatacaaggcgcgagcgagcctgagggttgcagcgaaggagtatttaaaagcgaaacggaagatgtatttaggtgacagcctggctgcccaggttaagacaatcggccctgactgacagaccgtcttacagccctgttgacccctggcatagctgggccagcgcgtcttcactcagacccgttgcttccctaatagcgtcatgtggcatgcccatgttgagcaggctacgggcgacttcacgcttgccttcgttcctgccaatctgcacgccttgctcaaggcctttctcaatacctttctgctcaagctgttgggcaatggtcattagcgcatctccgtgctgcggcacgcgttgtgccagttcgcgaacaaaggcttcggagtccgctgactcacctgcctgaactaaatagtgtaccagtgtggttacctgtggtgaagaaagatgattcgccattaagagcgtgaccaggcgatcggtcagtgccgcgatatcacgccggtgtatatgcttctgtagcaacgtgagtgcggccatgctgcgatggtgcataatctcgtcatccggtattaccgtgacatccactaatggaaattccctgctgtagaattttcccgccagctctggatattcaaatccatccagccatcgggtggaatagggataggggctgcgcttccctgcataaaaaagtatcggaatgaccagcggcagttttttatgcccggcggccagatggcgctgcattgccgccaccgcatagcgtaacaatctgaaggccatatgtttgtccggggtggactgatgctcaatgagcacatggatataaccctctccgccggtcgttgttttcatgcgatatagcacatcgctgaaatactgacgcaggtcgtcttcaatgaacgatcccgattcaagctttaatgaactgaggtcgcaaatcgcacgtaatcccgcaggaagatgcagttcgataaaatctcgtgcaatctctggctgcgtcagaaactggcgaaaggtggcatcgtgaggcgtcggtgtactgtgcttttttttcacggtttatcgtccttaaccggataccctacggtatgtccctttggcatcgcgtcatcaaacctggcgtggtctgaaaacccgaaataatcaggcatgacgcgcggcaacgatccgtccacaagtgctgtaacctgtgagtcgttgcgttgaggcgccggaggtcagtaaaaggcgatttagtgtggctgtaaagcctgcagatttagcgctgtgcaacttcacgcaaaatgggtcggggagtgcacctcagcgtgataagggcgaagcgcaagaggtgaatgggccctggaaaggcttaaaaattaagatgactaaaataatgcaaacatcagcgcgacggggaagctcataggccaggttgcgccgaccaaaagagcactcagtaattttatgctgagtttatctttggcgataaagaaggtaattaatgccgctaccgaggcaacaacgccgtagaagaccaacatatgttgataaagtgtcattttagccccgccgtctgtttcgttgtctggtacagatcatgcggaattttgtgactcagatcaagtatccggccttttgtgtaaataaaaaaatggcagcttagctggggtgttgttgcctgcctgctggccatcactggcgatttcaccctgaaacgttgccgtttaacgcggctttatccctgctcgcaggccgatcctcagtgccgaggttgtctggcgaatgacaggttttaacgttcgctagccctctgttccctgagtgcctgttactattacggggccgattttgagacatatactgtttcaacgcggggctaacatatcgtcgcccctcaggtctcgataacacaggagtatcaggtgaataaactttcctatctgttgttaatccttttatgtccttcggcttttgctttgacgctgcaatcaaaagacttcagtgataatggtctgttagacaaaaagtttgcgggtgccaataaaagtaacgccgcctgtaccggtgataacgtatcgcctgaacttaactggtctgaaataccggcaggcaccaaaagctttgctttagtgatgaccgatcctgtcggcgctaaaggattgggtgtaacccatatggtggcctataacattgccgccgatcgtaccgcttttgcccagggtgaactgacgcaaggaaaggggtacaccggagggaaaaactcaccaggcactgcgcattattacggaccttgcccacctgtgggctcaggtatgcatcattataatttcgtgcttatcgctaccgatctggcgccgtcggtgcttgaagccggattaacacaggatcagctactgaacaaacttaaaggccattctcttggtgcggccagcacggtggcccgctttggcaatgactgagtctgtaagtagcgcataaaaaaaaacaccctgcggacagggtgtttttatcgagatcgacagcttatttcgcgtcagctgacgctggctgaccggggtcaggctttttatccagtttactgatcaggctatgggcttcggcttcacttgccacggcgggagaagagccacttaatggtttacgggccgtttcccgaaccgtcagaatcgtcagcaacccaataacgcctgcgaccatcatgtaataggcgggcatcatggtgttctgcgtcgtatcaaccagccatgcggtcagtaaaggtgtggtaccaccaaacagcgagaccgaaagattaaagccaatcgccagagcactgtaacgaatatcagtggtaaagagcgcagggagcgttgaaggcatggtgccactaaagcaggtatgtaatatgcccaatattagcagcccggcaaaaacggcccacatgttatgtgtaccgatcaacataaagcttggaatcgcgagcaggatcagtcctaccgcaccaaaaccaatcacaggacgacgaccaatgcgatcggtccagcggccccacatgagcgtcagcggcatcatgacaaacatcaccaccatcaccagcagcagtccgctgagttcgggtaaacccagtacgccagtaaggtagctgggcatgtatgaggtcagcatatagtttgaaacgttaaacaacaggaccagcccaatacacttcatcattggcacgcggtgcttgcttaacatcttgaggagcgtcagacggggtttactttgctccagctcctcctgtttttgcatgtgttgcttgaaggccggtgtttcttcgagcttcagacggacatacaggccgaacaaacccagtggtgcggcgataaagaagggcacgcgccagccccatgacatcatggcttcaggcgagataacggtcgtcataaccgtcaccaggcaggcacccagcagataaccgcctaaggtcccgaactccaggaagctgcccatgaaaccgcggcgtttatcagttgaatattcagcgataaaggttgctgcaccgccatattctcctcctgtagaaaatccctgaacaagtcttgcaaccagcagaaggattggcgccatgataccgattgaggcataggacgggatgatgccgatgcagaacgtgcctatcgacatcattatcatggttatcgccagcactttctggcgcccgatgcggtcgcccaggggaccgaataccataccgcccagcggtcgcaccaaaaaggctgcggcaaaggtaccaaacgtagcgattaactggatggccgtattggcatcggggaagaaaactttgccgataatgacagccagatagctgtaaacaccgaagtcaaaccactccatggcattgcctaatgcggctgcaccgacagcacgtttcaacattccgttatcgataacggtgatgtcatcgaacgtgagcttttttggttttttattccagaaatgttttttaggcctgggtgacgatgaacgattggtatccatattttcctcatactacttaaatgaagacgacctatagctttcgcagccagtcagcgaggttaacggaaaaaaaggaagtgaaagctataagaggccagttacattaatgatagagcgttcttaaccgcagcgagaaaacatagtacatgaatgtaattttttgcaagtaatcagcaaaaaagactgtcttataaaagagatagccatacattattttttacttttgtttacatattgagatgttttgggcggcgtaaatgcctttttatgcacatcaatgctgtcacagaagcacggtgagtcgcggataacatccttggtaggggttcatcgatctgccagcacaggtgctggcagatcgatttgatttatgctggttctgcagctggtgttcgtccgctgctccaccacagcagtaacgccaccagggcgatgcaacctaatgcgctaaaggcaatgctgtaggaatagcgcgccacgatcagtccggtcatcgccgggctcattgatgcgccaacgccttgcatcagcatcaccacgctctgaccggcattaacgtgcccgcttccacgcagcagcgacacaatataacccgggacggcaacgccgaggatgccggccgcaataccatcgaggatttgcacagggatcacaaataacgtctctggaaactctgccgcaataagcgcacgaagcggcatcattaacagggcggtcataattaaatggcgatagccaattttatccacgcgtcgtgagacataaatcgctaccgggatcatgaccagttgggaaatcaccacggtcgccgcagcgtataagccggggtcaaccgcatgtggtccggtagaggaagcaacgcgcatactcagcatgggcagcagggcggcgttggccagatgaaacagcaataaagtcaggccggtaatcaacagtgccggtttacgtgccagtatccacaggctcagagtaggcttgtgcgactgattatcttctaatccgcgcgccacctcatgattgatatcctgcccccggatcgccatcgtcgcgatagctgcaaagacggccatgatcatcattaaaataaataccgcccccagcccccatttccaggctgcaaatcctgccaggacagccgccagcgtgtttcctgcatggttgtaggcctcattgcggcccatctggtggttaaatcccttttgtccggtcaaacccagcgttattcctgctacggttgggccaataaaggcggcagcaataccagcaacgatttgtgaaatgatcgctgtccaggactgatcgctgtaccagagcaataaagtggcaacggtaatcacgatgcatccgaccagtatgacaagtcgtttataccgcgtcgcatccgccaccacgccagcgggtaaggttgacagaagtccggcgatgccgcccgacgtcatcaccaggcctatttcatccgggctccagtggcgctctgtcaaaaaaatgcctaaaaagggccccagaccgtctctgacgtcggccagaaaaaaactcatcagacacagtgcctgaagtgaccgttgtgacatgtgattttccctgtagcaatagtaagggttgagtgaccaacacatttcaataagtaacctggtgaatcatggcagcaaaaacacgaagtaacataacgttaaagttacaaaatgaaaaaattcactttttatgcaatttgttctaacgacttcccggataagtgctgagcgcctgcggcaggattgtgcctcttgaggatttacgccgtcgttaagatgaaagcccggttaaggtttggggaaatcgtcagtgcgacccgatgatggactgacgctgaccgcgggcggcaaaacaagaccgcgcagaatacggcattccttgtccagcaaagactcaactgatgctctgttgcccttatcccagccgcggcgggttgccagcaggataaagcctttttcaccccagaaggtcgttggcaccaaggcgattccatattccgccagcataggaggcgacaggcgaaagtggctggcaacagaggcaatggggtaaatgcccatggctgtgggttgcagcacacgacgggcgtagtaggtatgagtaagcagcttatcgggcaggggatgccacgcatcctgaatatagggacgctcggccttcaactgcctgtaaacatcttctcgcaggcaggtaagatgaatgtgcaattgattctggctgcggccccaggctgaattgatcgccatcccgagcctgtcttcgggcaccggcctgccgtaaaccgacgttaactgataacgcatcagccaggcgtagccaaaatagtctggtcggttacgcaccgacagcaacgggctttcaataccggacatcggaatcgtgggaaccagaatgaaatgatagggatagcgtgggttttgaatcagggtgaaaccctgctgttttccttttggaatataaacttgctggcaaggggagggatggccggtgtactgatagttcaccatgcaaaggttgtccgtcaccgcccacaacgcatctgagcgagcgcatcccgccagcgtgagcgccattccagccagtatcatcaggcgacagagcagcgtcagcataaactcaaccgttcacagccaggaataacctgtggggatcggaaaagcgttcactgcctctgctacctgtaccgctcaatccttcccatgccatatcgcgtttgtccttttgtctgagcggtctgctatcccgtaatttagcgccactcggtaatgaacaccactggaaacgccagaaaagactgaaaaatgatgagataacgtgttttgtccatttctgaaagggccggcataaacccgcctggcaatgtggcaacggagacatcgtgtcctgacaggatcaacgaatggtcaactgggttaatgccgttaataacacatccactttgggcaggagctgtttacgtcgtggccaaatgacactcagcggcagaccatcaggttgcagttgcggtaatacgatttccagttcaccgcgggcgacggcgctctccaccagccacgatggcatttgcgcgacgcccaacccggcaatgactgcctgaagttgtgcatccacatcagccagcgccatgcgaaagggcacgtcgcgccagtaggtatgcccgtctttgccggtaaacaaccacggctttggcgtattatcggcacgttcatacaggatcgcccgatgctgcatcagcgcctgttcgctttgcggccgcccttcgcgcgccagccagtcaggcgaagcacaaaacaccattcgttcacgtcctatgtgacgacaacccattgaggcaggcaaatcgtctgatcctccaattctgaccgcaacatcaatcccttcatcaaacagatcggtgaagcgatccgaaaaacgcattctcaactcaagttcaggatgttgctgacaaaacggaatcagcaacggcatcacattcagtcgaccataagtatgaggtaccgcaagccgcagacgtccagaaggaataatacgttgcgctgccagtacggcttccgcttcagccagctcttccataatacgtaagcaggtctggtaataggcgctgcccgcatcggtcagttgcagtttacgggttgtgcgttcaagcaggcgcgatcccagacgcgtctccagccggctgacgcttttgcttacggctgagccggtaacatgtaaacgcgcagcggcagcggtaaaacttccgctttctacgctggccacaaaagggacaatgtccttcaaacgttgatcgtgcatgattgatgaactcaggttgataatggtgtgaattattacccgaaatgggaatgaaattctctattacccttagcattacgtaaaacgaggagaattaacatgcaaaaacaggctttgattgtcggcattagtggcgtgatcggtcgggcgttagctgaaagactacacaatgagggctggcaggtcagcggactgtcgcgcggccgcggcgcagtgcccgaaggctgcagcagcttaacggccgatctcaccgatcctgaagccgtacgggcggcactaaaagcgatcaaacccgatgcggttttcttcagcgtgtgggcacgacaggatacggaaaaagagaatattcgtgttaatggcggcatgattcgcaacgttatcgaagcactcggcgaacgtctgcagggtgcccatgtggcgctggtgacgggccttaagcactatctggggccatttgaagcttacggaaaaggagctgttccggtaacacctttccgtgaagaacaaggccgtcagccggtagacaatttctattatgcgcaagaagacgaagtctttgctggcgcagaaaagtatggctatcgctggagcgtacatcgtccgcacaccatcattggttatgcgctggggaatgccatgaacatggggcaaaccctcgccgtctatgcgacgttgtgtaaagagaaaggctggccatttatcttccctggctcgcctgagcagtggaatggcgtggttgacatgaccgacgctggccttctggcggagcaactcgcgtgggccgcgaccagccccgctgccgctaaccaggattttaacgcggtgaatggtgacgttttccgctggaactggatgtggccaaaactggctgagtattttggtgtagaggccgcagattatccggcgaagatgatgccgcttgacgggcgcatgcaggaggccgccagtgtatggcaggaacttgcccagcgcgagaacctgcgtgagaaagatattacccgactggcttcctggtggcacaccgatgccgatctgggccgcccaatggaagcctttactgacatgagcaaaagtcgcaaagcgggcttcaccggctaccggagtactctggacgcgtttattcagcttttcgataagcttaagcaagagaaaatcattccgtcataacgccttacagagcgccttatccggcgctcattatcgttttgcttatgtatatactgattgtctgactgatgtgagataaggagcagaatgatgacgacatgttttattattggcgcagctggcaaagtcggctttcatctgacgaagcagctcagtgctaagcaacatgcggtttctgcactgcatcgcaaacccgagcaggccgaagcacttaagttagcgggtgctgttcctgtggctggcgacattcagcaactgactgtggatcaactggcgcaaaaaatggcacatcatgaagtggtgatttttagcgcgggcgcgggtggcgcgggcattgaactgactaatgccattgatggtgagggcctggctctcgccgttgacgcagcagaaaaagcccatgtgaagcgctttatgctggtttcggccttcccggatgccggtcgtggtgaaaaaacctccgagagattcgagaactatatgcgcgtgaagcgacttgccgatgtgcgtttagttgaaagcgcgcttgactgggttattcttcggcccggtacgttaaccgatgttgcgggcacgggcagggtacgtgcagatttagctatcccttacgggtcggtcccgcgcgaggacgtagccgccacgctggtggcgctggtcgaaacaccgcaaatttcacacaaaattatcgagctgaccgaaggtgatgaaagaataagcgacgcaatgcatcgcctgcagcgcgattaaaaaaaacggccccgtaacaggggccgtttcgtattgctgactgcgtaagtttatttcacacagcgcgagcagtgttcacgttcaatatgctggaagaagtcatttcctttgtcatcaaccagaatgaaggccgggaaattctctacctcaattttccagatggcttccattcccagctctgcatactccacgcactccagactcttgatgctctgttgcgccagaacggcagcgggtccaccaatactgccaagatagaaaccgccatgtttatgacaggcatcggtgacctgctggctacggttgccttttgccagcatgactttgctgccgccattggcctgcagaagatcgacataggaatccatacggcctgcggtggtcgggcccagtgaacccgacgcatagccttccggtgtttttgccgggccagcataatagaccgggtgatctttaatgtactgcggcagcccttcaccgttatcaatacgttcttttaatttggcatgtgcaatgtcgcgggcaacaataatggtgccggtcagagacaaacgcgttgaaaccgggtattccgaaagctgagcaaggatttcattcattggacggttcaggtcgatatgaaccacttcgccttcaccctgcttgcgcaatgcttcagggataaagcgtcccggattggcttccagtttttcaatccagataccgtcgcggttgatttttgctttgatattgcggtcggcggaacatgaaacacccatgccaatggggcaggatgcgccgtggcgaggcaagcggactacgcggatgtcatgcgcaaaatatttgccgccaaactgtgctcccagcccaagctgctgcgccgcttccagtaactcctgctcaagctgaacatcacggaacgcctgaccatgctcgttaccttctgttggcaagccatcgtagtaatgggtcgaggccagctttacggttttcagcgtactttcggcagaggttccacctatcacaaaggcgatatggtaaggaggacaagccgccgtacccagcgtgcgcattttatcaaccagataatttttcaacttgcccgggctgagcagcgctttggtttcctgatacaaatacgttttgtttgcggaaccgccgcctttggcaatacaaaggaatttgtattcatcaccgtccacgctgtacaggtcaatctgcgccggaaggttggtgccggtattcacttctttgtacatatccagcgcggcgttttgcgagtaacgcaggttatcttcgatataggtattgtagataccttgtgacagcgccgcctcatcacccccgccggtccagactcgctggccttttttccccataatgatggccgtgcccgtgtcctgacaggtgggcaatacacctttagccgcaatctctgaattgcgtaaaaactgcagcgcaacgtacttatcgttattgctggcttcaggatcggccagaattgacgcaacctgctgctggtgggcggggcgcaacataaaagaggcatcatgaaatgcctgttgtgccaacagggtcaatgcctgtgggtccacttttaagatggactggccgtcaaactcagcaacggaaacataatcagggctgagcagatagtattcggtgtcctcgtgggtaagaggaaaggggttctgataaaaaaaaggtttgttcgacatagtatctcacttaatgacgtgctggctccattaaggcaggctgacaggagcaacatcaaaggcgaatgagttgtttattatgcttgccagcctttaacacaggctggcaagtgttggcatgttatcttatgacgcgtcgaattgcatttggcaccatcagaacatccacaccatccagggataggcgattagcatcatagcaatcaggaagatagcgccaaagatggtacccaaccgccagtaatccttcgttggtaagtagccgctgccgtaataaatggggcttgggccagtaccgtaaggtgtgatgatgcccatgacacccagcgaagtacacagcatcaggcagaacaccggcatattgatacctggaattgaggccgcaatggtcaacatggcaggcagcaacgcggtagtgtgcgcggtggtactggcaaacagatagtgcaagaggaagaaggcaatcagcagtaccacagcggatatttgtgggtcgtacccttgcagcaacattcccccttctttgcccagccaggcgataaagcctacacgggctaaaccatcagccagggcaaccagcgtggcaaaccaggcaaaggtgttccaggcggctttattgctggtgatgtcattccagttgagaacgccggtccacagcatcaggataatgaccagcagggctgccatcgccggttcgatccatgcggtggcaaaaatccacatcagcagcgcacagaccacaaacaccagtaacagaatttcattgcgggttagcttacccagtttttccagctcagcgatggcccagcgaggcacttcatcattcactttcacttccggcgggtagaaccagtacgccagcagcggcattgtcagaatcagcagcagacccagtggcagaaaggcaaggaaccacattccccatgaaatatcaaaaccaataacgcttttgactaacgcaagggcgagcaggttgggagccagagcagacagaaacatagagctggtgatacaggcggcagtgatggcaacccacatcagataagatccaattttacgcgcactgggatcattgggttttgaaccatacagcggtggcaggttagctatgatgggataaatggtgccgccactgcgcgccgtattagacggggtgaaaggggccagcagtaagtcagcgaaggtaatggcatagcccagggttaaactccggcggcccaggtatttcaccagaatcagtgccagacggcgaccaaactgggttttgtcatagccggcggcaaacataaatgcgccgaaaatcagccacaccgttgagttaccaaagccactcaccgcccatttgaatgactcggtggccagcttaaatttgggattggccagctctgccgggctaaaaagcagaaactgactgaacagggcaatgacgaccaccccggtcaggccaattactgcgccgggtaacggttcaaaaatcagcccgacgataacgccaacgaagatagcaaagaagtgccatgcataaggctcaagacctgatggcacgggaacaagtaataaaagcacggctaccacaatcggtagaattaacatcagcgctttatttttgcccgcagctgcaggggctgcttttgggggctctttgacgtttgagagtgttttcatagtatttttctacgtgttaaggataattcgatctgcgtcccggctattcatcaatacttgcctttttattcttgtttatgcgaataaaccgtgatgctttatattttttaagcgtttctacgagtgcgatgcagaaactttaagaggtcatgtcgatatgatgcgatttattccaaataaaatattgatccagatcaagtaagttaaattatatttttaatttttaacaatcatattttttataacgtataaatagattaaatatattaattaataaagttttttggcggttttttgaatgatggccaacaaaaatacctttttaatctgttgtttttattggttatttttaattttatgctttcaattgattttagttaactattggttaacaataaatatacattacgatttcgtttttcgcaaatagccatgcagaaatatttaaaagttaaataattaaaattatagcttatgaaactaaaataattggtatattagtgtcatgacatcggaccacttaattattaataaaatagcgtccgcaaaaaattcccagcttttgaaattttggagttaatcgcaatgaatacactcacccccattctcaatcccattactttgccgcggggcgcggttttaaaaaatcgcctgataatggcaccgatgacaacctgtacgggattttatgacggaaccgtcaccagtgaactggttgaatattatcgtgcccgtgctggcagtatcggaacggtcattgttgaatgctgctttatcgatccgcatggccccgcgtttccaggtgccattgccatcgacagtgataacaaaataccgggtttaaagagaatcgctgacgccatcaagcaagaaggatcgacggcgattttacagatctatcatggtggtcgcatggttgagcctgagctaataggcggtaaaacgcctgttgctccaagcgcgattgccgcaccgcgggaaggcgcaacgacaccacgtgcgttaacggctgaggaagtcgaaaccatgatcaccaagtttggtgatgccgttaaccgcgccatcaaagccggttttgatggtgtggaaatccatggtgcaaatacctatctgattcagcagttttactcccccaattcaaaccaacgcgaggataagtggggcggcagccgcgataaccgtgcccggtttcccttagaagtcctggaaatcacccataaaatggccgcgcgatttgcgcataacggatttattatcggctatcgcttttcccctgaagaaattgaagttccgggtatccgctttgaggataccctgtacttactggaaaagctggcggcacgcgggctggattatgttcacttttccgttggacagctcatgcgcccgtcaatcgtagatacccgcgatccgacgccgctcattgaaaagttcgtcgccatgcgctccgcaaccctggcaaaagtgccggtgattggtgttggcggcgtgataaacaaagaagatgcagagaaagcgctggaaaaaggctacgacctggttgcgatcgggaaagcctgtatcgcttatccagactggacagaccgcatcatcaataatgagcacctcgaactctatatcgacagtaacaaacgtgaagcgttactgatccctgagccgctgtggcgcttctcgctggttgacgcgatgattcgtgacatgagcgaaaccggacgtaaatacaaagccggggtttatcaggagaaagtggaggccgaggcgctgaagctgaaaatcaacgtcacgctggataccgaccgtattacggatatttctctggtgccggacgatacgctcgacgtcgacttcaccaccacgtttgaaagcctgcgtaatcgtattttggtggctaacagcccgcacgtggatgctatcaccggtgcgacaacgcagagtgaggcgctgaaaaaagcggtttcacgtgcgatgaccacatccaataaagcccatgtgattgaggagggcggcaatccgaacgcgccgcagcagtatgatgtcgtggtcgtgggaagtggtggtgccgggctggctgcggctattcaggctcatgatgaaggcgccaaagtggttgtcattgaaaaaatgcccactatcggtggcaacaccattaaagcgtctgtcggaatgaacgcggcagaaacgcgctttcagaaactaaaagggattgaagacagtaaagaactgttttatgaagaaaccctcaagggcggcaaatttaaaaataacccaaccctgttgcgcgaatttgtggatttggcgcccgaggcgattgactggctggctgatcacggtattgaactgaatgacattaccatcaccggtggcatgagtattgaccgtacacaccgtcctgccgaccgctcagcggtagggggcttcctgatcagtggactggtgaaaaatattaataaccgcaacatcgatgtgttgctggaaactgccgtagaggaaatcctgtttgaaaatggggcggtcagcggtgtgaaagtggtggacgaatacaatgacagccgcatcctcaatgcgaaaagtgtcatcgtagcaacaggcggtttcagcgctaaccgggaaatggtggtcaaataccgtcctgagctggatggttttgttaccactaaccataaaggtgccaccggcgcgggcatcgcaatgttgcaaaaaattggcgcagataccgtggacatgggtgaaattcagattcacccaacggttgaacagacaacgtcctatctggtttccgagtccattcgtggcggtggggccattctggtcagccaggcgggacagcgtttctgtaatgaaatggaaacccgcgataaagtctcggcacagattattgcgctgccagagaaaagcgcctggattgtgtttgacgagcaggtccgtatgaataacaaagcggctgatgagtatattgccaaaggttttgtcatcagtgctcccaccgtcggtgaactggcagtgaaactgaatatggagcatcagacgctggaagacacattgcaacgctacaacgggtttgttgtgcaacagaaagacgtcgattttgaccgacagacggcgctgcgccatccgttgaatgaagggcctttccatgccattcgtatcgcccctggcgttcaccatacgatgggcggtgtcaccatcgataccaccacggcggtgcttgacagtgaaaaacaggccatcaacggtgcctgggcgtgcggtgaagtcgtcggcggtattcacggcgcaaaccgtatcggcggtaacgccgttgcggatatcatcatcttcggtattctggccggcgcaaacgcagcggcttttgccaaacgttaagccgtgacatccggcatctgccagcacgcagatgccggttttatttcattcagggccgtgtcgcttatgcaaaccgattcgcaagtttatgcttattctgccgtcctgatgggatcgcccattctgcttaagctgtttgatcataacgaaaagcttgccgctcaggctttcaggttaattaaacagtatgagaatctgctgacggttaaccgggtgcactccgaagtgatggctgttaaccatgctgcaggtctgcatcctgtgagcgtcagtcaacccgtctttgatttgattcagcgcgcattaacggtcagcctgttgccaggcagcagttttaatctggcgattggtccgctggtaaaatgttggaagattggctttcagggcgacagcgttcctgcgcggaagaccttgctggcgacgttgcccttaaccgatccggagaacgtcgagcttgatgctgacagccgggcagtctttctgaaaaaagcggggatggagattgatttaggcgcgatcgccaaaggctacatcgccgatcgggtgcaggcatttttgcagcagcagggtgtggacagtgccctgattaaccttggcggcaacgtgcagacgttgggcgcaccacgcgatgcgccgcagcaaggatgggctatcggtctgaaaactccatttgcagcgcaggatgcactgattggcgtcattcatgtggttaacaaatcagtagtgacgtccggcatctatgagcggtacttcgaacgggacggcgtctgttaccaccatattcttgaccggcataccggctatccgctggataatgaactgcttagcgtgaccattatttcggaccagtcaatcgatggtgatattttcaccacgctgatttatggcatgggcgttgtaaagggcatcgactatctgaaaacctttcctgacattgaagccatctttgtgacgcgcgacaagcaggtcatttgttcgtcacaacgccacttcagcttcaccttactggataatagctatcagcttcatcactgacagtactggcgtaaaagcgcgtggtactcaggttgcagacgatagcgataaaccggtcgacccgttacaccataatggatgctggtaaataaaatattgctctgagccagccaaatcaaatacttacgacaggatacgcgcgatatattcacctcggttgccagctcatcggtcgagaactctgtaccgggatgcgcatcaatccataaacagagggtgcgcagtgtctgcggcgtcagcccttttggcagacgttttgtctcgttggcattggcctgattaccgtgcaacagctgatcgacatcggcttgctgataaaactgatgattatccatcaatcgttttttctggcgccagccggtcagggcttcttcgaagcgcgaaaactgaaacggtttaatcagataatcgacgacaccataattcagagacgttttgatcgtcgccgcatcggcagcagaagagatgataatgacgtcaatcgggcgacctgcactacgcagctcgggtaacaggtccagtccgttttcctgctgcatataaatatccagcaaaataagatcaacggccggatctgtctttaacagtcgctctttggcttgcagtaaggtggacgcagtgccacagcaggtaaaaccgtcaatctgcccgatatagcatcggttcagctcggccaccatggcatcatcgtctacaactaacacattgatcattcgttaatatttcctctttcccacggaagctgaaccaggaactgggtgtacacgcccggctcggattcaacgctgacgttaccgcccaggctttccgtttgttgcttgagtaaaaacagtccaacgccacgatcttcacctttggtagagacgccgcgttcgaaaatagcggctatctgatcggcagtaatcccggggccgtcgtcgctgacctcacatgacagccagccgttttgataatgcagcatgacatggatttccccttccacttccggatcaagcgcttcaagcgcgttttcaatcagattccccagcaccgtgattaatgcggcgacttgctgctcactgccgttgtcgggcagatagctggcttcgctcaggatcaactgatggccttcatcggtcacgcggttaattttgctcagcaggaagcccgcaatgacaggcgacttaatcttctgcagcagcgagccaatctctgtctgatagttattggccgttttaagaatgtactcttccatctgcgcatagtttttcatatgcagcagcccaaggatcacatggagtttgttcatgaactcatgggagcgttcccgcagtgcatcgacatagtttaccatgccatcaagacgctgcatcagctgactgatttctgttttatccctgaaggtacttaccgcgccgataatgctgtcgcggctccgcaccggcacggtgttactgatcagtattttgccccgtacgttcagttcttcgtcatacgaggccttgccatcatgtaatgcttcgcgcaggtgggtcagcatttgtgcgttttccggcacgcggtcgccgctcagaaaggcttcgcgggtggtttcttttaacagctgctgagcggcctggttgataaggctgacgcgggattgatcatcaacggcaatcacgccctctttgatggaatcgagaatagcctgacgctgttcaaacaagctggagatctcataaggttctaatccaagtaagatgcgcttcaggcgtttcactaagattaaaatgccaagcatgccaaccaggccaccaaacagtaccgtccagaggatattccagcggcttttggcgatctgcgccgcgacatcgttaacagaaatccctatcgccaccacaccaatttgctgatgcgcctgattaaaaacaggcgtgaagactctgagtgcttcaaccagtacgccatgattgaccgcgacattttccctgccacgcagcgccggattgatatcgtccccgacgaagtgctgattaaccacttcagggttcgggtgagaaaaacgaatgccgcgcatatcggttaccacgacgaacagcaaatcgttacgtttacgcgttgcctgcgcaatgggctggatgatagcgctgccgtcaggccgggtcagcgcctgctgaatctcagggctgtcagccagggtccgtgccaccgccagcgctttatctttcacatgcgagcgtgtgaaattatcgatttgaatgtagtaaagcagatggacgctgagtaatacggtcatcagcacggctgccatcatcagtgacgataaggtgctgagcttcatcgggcgcttttttgacgaacggtgtggccgggatacattcatagtgagcatcagaagtgttaagggtcgcggtgcaacatacgcgaagtcgtggcaccagtacagtttgagcctgacatccggcaaattaagccggttagcgtgctttcgaccgcgtatgtctggcatgataacgagcaacgcttgtggctcctattgacagcatggcaggtaaatcagcgcgtgctgtgcaaaatgtctgtgtgagtcgacaaattcggtttcgcgcccattccctttacgccaggttgcgatttcagagtcaggaaagatgaagaaaaaaaacacgacgcccacgcctcacgatgcgaccttccgacagtttcttacacagccagagattgcgcgggattttatggaattgcacctgcctgcggaattacgggcggtttgcgacctcagcacgttaaaactcgaatcaggttcattcgttgaagatgacctacgccaatatttcagtgacgtgttgtacagtctgaaaaccacccatggcgacgatggctacgttcatgtgttgatcgaacatcagtcctcacctgataagcacatggcattcagattgctgcgttacgctgtggccgcgatgcagcgccaccttgaagccggccataaaacattaccgctggtgattccggtcttgttctataccggtaaacgtagcccgtatccttattccacgcgctggctggatgagtttaccgatcctgcgctggccagcaggctatacggcgaggcgttcccgctggtggatgtcaccattattcctgacgaggagattgctgagcaccgcagtatggcggcactaaccctgctgcagaagcatattcaccagcgtgatttagccgagttggtggataagctggtcccagtattgctggcgggctatctttcttcatcacaggtcatatcgctgatacactacattgtgcaggcgggcgaaaccgccgatgctgaagcgttggtaagagaactggcacatcgcgtgccgcaacacggagatgcactgatgaccattgcacaacagcttgaacaaaaagggattgaaaaaggcatggaaaaaggcatccagctgggtcgcgaagaaggccgctctgaaggggaacgcgaagcgacactgaaaattgcccgcacaatgctgcaaagcggccttgatcgtgagacggtaatgaaaatgaccgggctgaacgaagacgacctcgcgctgatccgtcactaagtggtgcccgtagcggcaggctattgccagacaatgtaaatagccattcggcgtttattcgcaaacagttgtaaaagcccttcaggctgcctgccaggctaatagtgacgcagagtaaggccggatctgctcttatcattgtttcttagcctcacacagaatatttgtgttaaggcattgaatattgcgaaacgcccgtttattgtgtggttaaaatatatcgataacaaagttaaccttttgtaactaaattaactgcaccatcctgccttttaattttttaactattttcatattaactacgcaataacaatattttaaaatttcgggactttttttaaccagttctccacaaaaatcgtagatcccgaatgattaaatcaactaaatttgtacctgcattgtcgcttgcagcgttactcgtttcttcagttacccacgctgaaaattcaccagaaaaaactgatgtcctgctgattggcggcggtatcatgagcgcctctctgggcaccctgctggaagagctgcagcctggctggaaacagatcatggttgagaagcttgatcgtgttgcgctggaatcctctaatggctggaataatgccggcaccggccactctgccaacatggagctgaactacacgcccgagcgtgcagacggttctatcgacgtgaccaaagcactggaaatcaatgaagcattcatgatttctcgccagttctggagttctcaggttaaagatggcgtgttaaataacccgcgctcgttcattaactcaacgccgcatatgagcttcgtctggggtgataacgttgattacctgaccaaacgctatgctgcgctgcagaaaaccgtgctgttccagggcatgaaattctcaaccgatcacaagcagattgaacagtgggcaccgctggtcatggaagggcgcgatccacaacaaaaagtggcagcaacctggacgccagtgggaaccgatgttaactacggtgaaattacccgtcagttaattggcagcctgaagaagaacgataatttccgtctggaaacctcttcagaagtgaccgatttcaaacgtaacggtgataattcctggcacgttaccatcaaagacgccaaaaacggcggcgaacgtactgtcgacgcgaaatatgtgtttattggtgcaggtggtggtgcgcttaaactgctgcaaaaaaccggtattccggaagccgacaactatgcaggtttcccggtcgggggctctttcctggtcacagagaacactgccattgccgatcgccatttagcgaaagtctatggccaggcgtcggtaggtgcaccaccgatgtcggttccgcatctggatacccgctatcttgatggtaaacgtgtagtgttgtttggaccttttgcaacgttctcaaccaagttcctgaaaaatggttcgctgtttgatttactgagcaccacgaccaccagcaacgttatgccgatgacgcacgtgggcatggataacttcgacctggtgaaatacctgatcggtcaggttatgctgagcgatgatgaccgtttcgccgcgctgaaagagtattatcctgacgcgaagaaagaagactggaaactgattcaggccggtcagcgcgtacagatcatcaagaaagatgcggagaaaggcggcgtgctgaaactgggtacggaaatcgtgaccgatcagcagaaaaccgttgccgccttgttgggcgcatcgcctggcgcgtcgaccgccgcgcccatcgcgatcaatgtgatgcagaaactgttccctgaacaattcaagtcagcagaatggcaggaaaaaatccgtaaaatcgttcctgcctatggtcagaaacttaacgacaatcctgcgctcacgcagcaggtttgggatgaaacagcagcaacgctgcagctgaccaagccaccggttattcagatgggaaatcagccaactgaagcgcctgccgctaacagcgaaaaagcacctgctccagcctcggctaagcacgatatggcgctgtaatgttgtaattgagaaaaacgaagcccgcgtcattgatgacgcgggctttttttacgtctaaacaatgcggtaaaaattatcaggttttatcgccgcgccagttagcccagggatcatcagtggctgggggcgcagaatccggctcagattcactcaatgaagccagatagagcgcttccacttcggcacgcgcccagggcgttcggcgcaaaaacttcaggctggactttacgctgggatcgcttttaaaacagttaatattgatacgcttgctcagttcaggccagccatactgttcgaccaggctgttgacctgcatttcaagcgtaatgccatgcaggggatctttagaggcgtgaacgttcatcgtctttccgcttaatgctgtcaaaccttgatcctgcgggatggcgttgcatggcgcaagtgtttactgaacataaaccctgcttgccctgaagatctgctgcacggatgcggtagagaggttacgtaatgcgctcaaccagacaggaataacatccctgttttgcattgtgcacctggatataacagaccgccgggttggcaaaaaaacgcattatcatctcgtctgcggcgcttccttcacagacgtctgcttgcgtcagataatcatgcccatcaaaaccccgtaacgaaagcagccggtgcgtcatgaccgcaggtatttcatctgtgtaaattccctgctgggtccagttttcccaaagatagatcgcatgagaaccaaaatagggcgtttgggccggctgatagagatgattaatcagcagcgcggtttcgcctgccgggatatcgcgcagggaaattctgtcgggatagccaggatgactatcgaccttttttcttatcaccccatgttgttttaaatagccttcatcctgtccaaaaaaatggatatagggatcggctttcaggcctgagattcggtatttcatttcatcctccgttcattaacagacggacagtatcctctgttggtcggaagtactcgctgttttcggccactgagatcgctgcgtgaagccgttggcggatggcgtttttcgcagtgctataacatgcttcctgcgttaacagaactgtttcaggtgcgtttcagagatgattgacgtcagcgatggtgagcattgacctggcgcgtttttcccgatggcagggcctggaaaggaatacacattatcggcatcttgccggctcttcgctttgaaaaagaccgaggggaagacggtttaccctgcaggacgtccatgagggctgcaatgaaggatgagcgtgttgtctccagagcacacagcagacgacgccacggttgtcagccagtaaaatggaacaggtaccaggggaaatgccgctttaatatcggcgacagttgttaaggcgatgattggagtaggcaggtctggcagaaagcaaccgtccggtgacagtgtcaccggacggttatcgcacttagcgcaatgactcggcggtcttctccagcagcgtcagcaggacagtaatatcctccagcgtgaccgttggattcaacaacgtcattttcaaacaggtcacaccgttgtgctcggttacgccaacgttggcgcgacccgattccagcaacgcatcaccaatacgctgattgaacagggcaacgtctgcatcgctccagcccgttagcggctgtggacgataacggaacagcacgctcgccagctgtggtttcattaccaactccagcgcatcttgctgctcaataaactgagcgacctgctgtgccagggttacgccatgatcgatgatctcggcatactgtttctggccgagggcttccagccccatccacagtttcaacgcatcgaaacggcgggtggtctgcaacgattttgagaccagatttggcacgccctgcgcttcatcaaactcagagttcaggtacgcagcctgatagcgcatcaactcgtagtgacgggcttcttttaacaggaacgccccgcagctgatggtctggaaaaactgtttgtggaagtccagcgtcacggaatccaccagatccaggccatccaggtaatgacgatatttctctgacagcagcagcgcgccgccccaggccgcgtcaacgtgcacccagatttgttgttctgcggccagtttgacgatatcacgcagcggatcgatggcaccggcatcggtggtgcctgccgtcgcgacaatggccagcacctgttcgttgttggccctggcctgtgccagtttctccgccagatcggtcatgtccatgcgtgcaaacgcatcgcatttcaccaacgtcacggactggtagcctaagccgagcagcgccatgttcttttgcactgagaagtgggcattctctgaacaaaagactttgatctttctgagatcgccagtcagaccgtcctgctgtacagaatgaccctgacgggcaaagaacgcgtcacgcgccagcatcaaacccatcagattgctttgggttccgccgctggtgaacacgccggcatcgcccgcctgatagccaacctgggaacgcagccattcgatcagcttcatttcaatgagggtggcagagggtgcctgatcccacgaatccatactctggttcgtggcgttaatcagcacttcagccgcctggctaatcaccagactagggcaatgcaaatgcgcaacacactgcggatgatgcaccgacaggctgtctttcaggaaatactcaatcgcgcgttcgatggcgacctggttgcccaggccctctggattaaagtccagcttgatgcgttcgcgcagttctgcaaccgttttaccctgatacatctcaggctgttccagccacttaacgactgccgcactgctttgtgcgatagcctgctggtaagcctcagtgctttgcactgaggacgccagaattggatttgaccgtgacatcgactttactccactcaaactgcttcgacgccagcggcaagcagggcgctttcaaatttatccaggaagacctgcatttcatcatgattgatcagcagggaaggcagcagacgtaatacgctgccgtggcgtccaccgcgctcaaggatcaggccattttcaaagcatttcttctgaatgagagcggataaatcaccatcagccgggtagcagcccatatgatcctgcgcgtcgtttggcttgaccatttcaataccgagcatcaggccaagaccacgcacgttaccgatggccggatagcgttgctgcagttcgccaagtttgcctttcagccactcacctttttccgcgacgctgtcagcgatattgttttctttcagcagcttcagcgttgtcaggcccgtcgccatcgccagctggttgccacggaacgtgccggtatgatggcccggtgaccaggcatcaaactgctttttgatccccagcacggctaacggtaaaccgccgcctaccgcttttgacatcacgataatatcgggctcaatgccggcatgctcaaacgcgaagaatttaccggtacgggcaaatcctgcctgaacttcatccagaatcagcaggataccgtgctcctgcgtcactttacggatgcgttgcagccattcagccggtgccggattgacgccgccttcaccctgaaccgcttcgagaatcacagcagcaggtttacggacaccactttcaacatcgttgatcaggttttcgaagtagtaggtcagggcttttacaccggcgtcaccaccaatgcccagcgggcagcggtacagatgcgggtaaggcataaactggacttctggcatcatgccattgacggcttctttaggtgacaggttgccggtaacagccagtgcaccgtgcgtcatgccgtgataaccgccggagaagctgatcacacctgaacggccggtgtgtttcttcgccagcttgagcgccgcttcgaccgcatctgcgccggaaggcccagtgaattgcaggcaatattctttgccctgacccggtaacagggagagcagatattctgagaacgcatcttttaatggcgtggtcagatccagagtatgtaacggcaagccgctggtaatgacattttggatgctttgcagtacgtcagggtgattatgacctaacgcaagcgttccggcaccggcaagacagtcaagatactgtttgttctcgacgtctgtgatccagacaccattagctttcgcaatcgctaacggtaatttacgcggataacttcgaacatttgattcaaactcggcctggcgggccagataagtctcattgttaccgtttaatgtattcgcattcaaactatcaatacggactttatccgtcatcatatctctcctacaaccgggcgtggcatcacgctgcagttggataagtgaataaaatttagagctcgtgttaaaaacgcggccaatatagggttttttaacacaggactcaatgattaattttataaggatttgtggatgtatttactttataaaccagcgacttagcccggaaagggaagcgaggtaaaccacttatgttaaaatgcgtaaacaataaagcgcctaaaaacacctgcttaccgcattcccgtgagaatctgccagcgaaaaataaagtgtgttagcaagcatttcaggacagataagcgataaaatttgagattaatcaaccaacaaaatgtaaaacgcacgccatctgaatgacacactaaaaagttaagaatgaatattcgtataacttctatttaacattccattaaagccaatacgcgagaaaaagacgctttgcgtccttcccgctccgttaacgcataaattgtataaagtgattaatgtcggccatgacctgctcaattttttctggcgaagatttaatgctcaacatatcagcatagccattaagcatggcattgagttggcgcgcgctgcgcgcgacatcatccgtatgaaaacaaccctgtgcaacgccagcacgaataatgtcacagagcaacgcatcccagcccgccgtaatcttgtcggctaagtctgcataatcggcgttatgcgctgccatctgccagaaagaagcatagagccgccagaccgaatctgaagtatcaggtatatggccttcaatcatacagtgtagttgctgctcaggttccaggccggccagttcagcggtaaattcatctaactcgcgctgcatgaagtgttccagcgcggttaaggtaagtgtgtgccagtcagggaaatagtgataaatatggctacgcgatatacccagcgattccgttaattcccgcgtcgtggctttctcaatgcctttttcgataaaaagcgcgacggcgcctgtgaggattttttctttcaaggtttccccagatgttgccattggtgctttcatcatcactcccgaattgactttgagcaaacgctcaaatacgatgcgctggtacttgagcattcgctcaattctaaccgtttaagaaaagaaaatcatgtgttctacccgaacgacaccaacggatctcgcaccaccaaacgctattgcgaccttaaagaggttaggtcgacgtcacaataaaaagctcgcgctcactctgcttttagtcatggcagaaaacgtcacctacctgctttatccgctattagccgggtttgccataaacgccattgtcaccgggcaggcgctccatgctgtgctctatgcggtcatggtatttacgatgtgggtcatcggagccgcaagacgcagcgtcgatacccgcaccttcgcccgtatttatgccgaactggcggtgccagttatcgtggcgcagcgtcacgaaaagcataatgcgtcaacggttgccgctcgtgtgacgttgtcacgtgagtttgtggactttttcgaacttcatctgcccatgcttattacttctctggcatcgatcagcggcgcagccatcatgctgctggtgattgaattctggaccggcgtgggctgtgtgatcattttgttggttcttgcctgttttttacccggcttctcacgcaagaatgaggcgttgtttggtcgtctgaataaccggcttgaaaaagaggtgagtctggtgacgatggcgcaggcacccacactggcgaagcactacgctgtgctggcgcgattacgtattggactctccgatcgtgaggcgctgggttttttgaccatcggtacggctgcggcgctgctgtttgcctttacgatcctcgccatgaccagaaaagggattggtgatgcaggacatatctattccgtgatgacctatctgtggatgttcgcaatgagcctggatgacgggccgcgcctgcttgaaaaatactcgcaactcaaggatataggtcagcgcgtgaatacaggaagctaagcgcgaaaggggcaacggcacggcagtaacgtcgcctgtcattgcccacatgctggcgggcattggcaaaggcagccgcgtatcacctgttaactgacgcttgccaccagccatggtgtcagttcgtccagttcatgctgctgcagtgggtattccgcttttaacgcttcaatgtgctgtgccatcacatcaggttgataggctgcaccctgtaagcgcgaggccagcatttccagaggcgcaggattcaggctgtcactgaaaatctggcagcggctaatcgtgccgcgctcaacgtcaaaatggatttccacaccgccccagacgaaacgattatccagtacgtgtgaaaagtccggcgcctgaccaaaattccattcccaactgctttgccgggcaaactgttgttcaaagccgggcaggtctggcagccggtcgggtgagatgtgctcgggttcacagcgcgtggcaaaatgttcaaaacaggcttcagtgatagcgtggcagatatgttcgtagcgaatatcgggaaccagggtttgcagattggttacgcgtgcacgcaccgaggcgatccctttagcctgtaattttttgctatccggattgagataatttgccaggcgtgacagatcggcatccatcaggattgtgccatgatgaaagccacgatcgggggtttcacgataagccgaaccggaaattttgcgcacgccttcctccgtgtcgatcaccaggtcgttgcgtccggacgcctgcgcattcacccccagctttgccagtgcctgcaggatgatggcggttgagacacttttgtcatactcgggtttgcccgccataaatgtaaaacagcagtttcccaggtcatggaataccgctccgcccccgctgctgcgccgcgccagtttgatgccatcctctgccatgcgacgcgtattacactctttccacgggttttgcgcccgaccaatcaccacggtttctgcatttcgccacaaaaacagtacccgctggctcgccggcatctggcgaaaaatacactcctccaccgccaggttgaaccagggatcgttcgattctgataacagtaaacgcaaagggggcattatcgactccgtttccttgagaaattctgccgctacagtaggacagaagagcagtttacttcagccagccccagaggcaattgcctcaggacaggctgacgggctaagcggagatcgtgatgccgtgcagcatggccggttctgcgggtgagttccgctttgtatcaaatttgtttaatatcgatttaatatatttataacccaaacaactatcaggtttatcctctgcagattgttatgatttggttaattaccagtggattattaaaaaagagacgtccatgattcgcaggcatggagagaatcggatgacgtgattctgcaacctcagttgattttctcttacgcgcaggttcaggcgcgaacgcgtcaggctttcgctcttaacccaggcggcgacatgtctgacatcatgggcactaccctcatcataacccgtattccgcagactgatttgctgccagcgacaggcggcttttactggaagatatcatgaatcactattcacgccgacgcgtgctgaagatggtcggactggtggctgtgaccagcgccgccggacatctgctccccctggcccgccttaatgccgcacaaccggacgcccaggctgatgagctggacgttttcatgcaggtttctcagcagctcacacagcgggatgagcttaacgaaaccgtgggcagtgcgctctatgacaccttaagccagacgcaaaagaatttctcagctgcactggtacatttaagtaacctgctgacgcgtcagaccgatctgttgcaacaggaacgtttgcagtttgccgagagcgatgcgggctgtgcgaagctggcgggtgccattcttagcggttggtacaccggggtggtggggaaaggtaaaaatgcgcgatacatcacctacatcaacacccttgcgaatcaggtcgtcaatgacaaactggttccgccgagcttctcatatggcgtctgtggcagttgggcgagtcaaccgtgatcctttttaagagtaatgtcatcaatgaagaagaatgagtcggctgatgtcgtcgtgattggcgcgggcgtgaatggcgcattgctggctacccgattggctaaagccggtaaaaccgttgtattacttgagtccgggccgaaagtcggccgggatgagctggtcgagcgcttccgtagctccgcctttaaatctgactttatgtcgccttatcccttttcgcccatggcgccgcagccgcgatatacgcctgaacccaacgactatctgcagcaattaggcccgcaggcgtttaatgcacagtacatccgcatctttggtggcaccagctggcactgggctgcccaactgtggcgctttgtgcccaatgatttccagcaatacacacgttatggcgtgggaaaagactggccgattggctatcaggatctggaaccctattactatgaggcggaacttatcgctggtgtcgggggatcgccggataacggatcgccacgtagcaagcctttcccgatggagcgcgtaccggcgtcatggctacagcagcgtgtaacggcacggctcgcgccagatttcaccgtgctggatgacagcacggggcgcaacagccgtagttatgatggtcgaccagcctgctgcggcaacaataactgtatgccgttgtgcccgatcgatgcccagtatcatggcgggctggccgcccagcaggcagaagacagcggcgtccaggtcattaccgaggcggtggtttatcagcttgaacacgatgcgcagggcaggattgttgccgcaaactattatgactggaataaaaccagccatcgcatcacggcacagacatttgtcctcgcggccaacgcgattgaaacgccgaagctgttactgatgtccatcagcaataaatttccgcagggaattgccaatgcccgggatactgtcgggcgtcatctctgcgatcatcccgcgattggcgtcaccttcgacgtagatgaggagatctggccgggacgtggccctgtcagcccgtgctcgattggtcagttcagagacggcgaattccgccgcgaacatgcgccattccgtctggatatctccaatgcctcgcaggtggcggcggtgacaaaagaagtgctggaagagggatactttggtaaaaaactccaggagcaagtccgtttccgtgcggcacgccgtcttagcattaaaaatgcgctggagcagctccccaatcctgacaatcgcgtgaccttaagtcgcaataataaagatgcattgggattacccacacctgcgttgttctgggatgtggatgactatgtgcagaaaggcacagaaaaaacgcgtgagtgctatgacgcgatagcggccaagcttggcgcaaccaatatccagcacagcaaaagcggcaaattctccaatcgccaacatatcaccggcaccctgtcgatggggcacgatcccgccaccagcgtgaccgatgcctggggacgggcgcacgatcatgaaaacctgttcatggtcggtaccggcgtgatgccaacggttggtacctgtaatgttacgctcaccgccatggcgcttgcgctgcgcaccgctgacaagattttgcaggagacacagcatgggtaagcgattaagtcggttactgcctttagtggtgctcatgctcactgcaacccagggcagtgtgcaggcagaaagccagactgaccttataaaacggggtgaataccttgctgtcgccggggattgtgccgcctgccacacagatgaaggcaaggcaccctttagcggcggacatgccattggtagcccgttagggatcattttcagcaccaatattacgccatcaaaaacggccggcataggtgactacagtgagaaacagtttgccgatgcgctacgcaggggcatgcgtgccgatggcagccatctttatcccgccatgccttacactgcttatgccaaagtgagcgacagcgatgtttcggcgctttatgcttactttatgcatggcgtcaaagctgttgacacacagccggagaaaactgcgctgccttttccgttcaacctgcgttttagtatggctgcatggaatgtactgttcctcgacaccaaacccttcaggcccgatcccagccagtcagcagaatggaaccgtggcgcttatctggtcgaaggattaacccactgcagcacctgccatacgccgcggaattttttgatggcggagcaacagagcaaatcgctacagggtgcttctttgggaacctggtttgcgccggatatcacggcgaataccttacagagtgacgatcagtggtcacgagaatcgctcgctgcctacctggcgagcggtcacgccgataacggggcgaccgcagcggggccgatgcttgaagccatcgataaaagcttttccaggatgacgccggaagaccggaacgcgattgcgacctatctgatgcctgtcgccgagcaggaagacagcgatgccgacaccgagtcagatgtacaggaaccggccagcgggctcacaccagtaaccggtgatgatacgccagatatgttatcggatatgacggatggcgagcgggtgtaccgcaataattgtgcctcgtgccataacctggaaggacagggcttaacaggattccccgctctgactaaacatccggtattagagaaacctacggcggataacgttgcgatggctgtgcttggcggtgtctggccagcgaaggggcagggtatgattggctttgcccatacgctggatgatacgcaaattgctgacgtcaccaattatgttatgcaggatatcggtaacagtgcggtgcgcatttccccggaccgggtgaaatcactgcgtcagggcggcgagccatcactactcttgccgctagcccgcacaggcatagcggtggctgtgctggcggtcgtactgctgctgttttggtggtggcgtcgccgacgctagtcgctttttctccacgtccccgtggacgtggagaatcgccgtgacatcggtgtagtccccggataagacccggctgcttattacggcagtcagctacatgccttctgaacacatttctgaccgcgcgcaacgctatactgaagcctctcctttactctaaactgaaaacagctgatataagtattccgtcaggatgtgattgataacacgctgtttctgatattttgcattatcccgtagcgagagaatggtaaaccggcatggaattacgtcgaaaaaaagatgttgcaatgatgcgcatttcgccgctgctcagaagtattaccctggcggggagtttattaacgattggcgtgattgttgttaatgtctggacgcttcacctggactggcaaaggacggttcgattagctgaagagcgcgcgatcgatctttctctggcacaggcgcgtcaggcagaagacacgtttctccagacagaactgtcactgcgtgaagtccagcgagaaattgagtcccagactgagaccggcgtggatgtttcagcaatcaataacatcatgcgcaccttacagagccgtctgcctcagatggatggcatcttttattacgacgcgcagggtaaatggatagccagttccttaacgcagacaccttcagcaaataacgccgatcgggaatattttgcctaccatcgcaacaatccccgtaacagcgtgcacgtcgggcccgctttacgtagccgcagttcggaacgctacgtgatccctgtttctttgcgcgtcagcgataactacggtgatttccgtggtgtacttcttgccacggtgagtgtcgattactttcgccattactatgattattttgtcattggccccaaggatttactggcgctgatgctggcagacagcactgtgctttatgctcgccctttgccagacagctacattggtaaaaacctctcatccagcccgcttttccatcagttactcgaaaattcacagcgcggtagtggtcagtggaaggctgaagttgacggtataacgcgcatttttggcttcgctagctcaagccgttatcctttcgtcgttgccgccggctttgataaacaagggcttttcgtgcactgggctgaaagcagggtgcagggagtggtactgagtctggtgttactgatggcgatcatcctgctgtggatgttaatgcggcatgaagcccggcgcagtttacgctaccaaattgaattaacccatctcagggatgaactcaccgccgccaaccactcgctggaaaatctggcgaacgccgatgggctaacgggactggccaaccgtcgttattttgaccactttctgaaaaaaagcctgttgcacggacgcagtagcggaggaccggtatcgttgatacttttcgatatcgattatttcaaacgctacaacgatacctacggtcacgttgcaggtgacgcctgtttacaacaggtgggccgtgtgctgaaaacgttcgcccagcgtcggaccgatattgcggcccgttatggcggtgaagaatttgccatcgtgctagccgatactcgcgccgaggatgcattaaggatggcgttgagtgtggttgaggcggtcagagcgttagctataccgcatacttctacggggctggagacggggtgcgtaacgttaagcgccggcgtggcgtcttcggcgtccggggaaggaccggaaagcgcaggattattgattaaacgcgcggatgaagcgctctatcgtgtcaaacaccagggacgaaacggggccagcatctagctcacgtcgagccgatctggcagggaaaccgcccgggcattgcccgggcgggtaaagattatttgtcgctaccgaatccctgcttgtgtagcgctggcaggacgttggggaaatagatgtgctggtaatatccgctcacgctgtcgctccagctttcgccgtccgcacgcccggttgcttgccagtgctgaaccatttcagcattgtaagccgcgatttgctgctccagaccttcggtgtgatagctttcttcgtgacggaaggtttgcatcggcaggcgtggtttttgaaatgcgggttgatcgacatacccaatcacgacgcccgccaccgggaacgtatattctggcaaattaagcagtgagatcatcgcgtcaggatcgcggcgaatccccccgatgggcacgatgcctaagccttctgcccgggctgctgccatgatacttcccagcgcaatgccgacatcggtagcgccagaaacaatactctcaatactttcctgagcaacctgctctttgcctactgccgccattgccatacgggatttatgcatgtcgagcaccagggtaataaacaccggggccttagcaatccacggctgtccaccggcaatctgggagatcgcctgacgtttcccggcatcccgcgtgacgaccagtgaaacctgctgtgaattaacagaagtcggcgcgcgataggcggtgctgatgatgcgatccaggatggcatcgtcgacgggttggtcggtaaagctgcgttcacttttatggctggtaaacaggttaataatatcgctcatcgttgctccaaaacgttaacctaaaattcagttgcctgaggataacaaatttatgcctgccactctttaaccgcactggccttaacctgtcgattaataacaaatttaacggacaggcaacctggagacgttaagcatgactaatgtgcctgagataacatccggtttgcgtttttaccactctggcgagtgacatgctggtgggaagggtgcggcaggcctcgccaccacacggtaaaggcggatacctgtctgaagggataaacagggtacgggcagctgatgaaggataagcctggatgattaaaagcaggcttatcatttttctgtcatttttcagccataaatcgttcatttttctccgctagcttactgcaattctcatttgcaaagcggcgcatgtatgagccatttggcgcttcataacatcaccaaacgctggggcgagaaaatcgcgctggataatatcaattttgacgccgcagaagggacgtttgttgcactgttgggcccttcaggctgcggtaaatcgaccttactccgcaccattgccgggctggagtcggccgacaacggatcggtcagttttaaccatctggacatcacccacttaccgccctcccagcgcaagctttccatggtgtttcagtcgtatgcgttatttcctcatctgagcgtcaaagagaatttgttgttcggtttaaaagcccgtggcgaggataaactcacgtttgccgatcgtctgcgtcaggtcagtaagctgatggaacttgagacgttgctggatcgcttaccgtcccaactgtccggtggtcaacaacagcgggtggcgttaggccgtgccgttatcgctaacaatacgctgtgcctgatggatgaacccctttctaaccttgatgccaaactgcgccaaagcatgcgtcgtgaaattcgtgccttacagaaaaaactggggctgacgatgctctacgtgacgcacgatcagacagaagcgatgagcatggccgacagcatcatcttgctgaatgaggggcgaattgagcagcatgacacgccagataacctctataacaatccagccagtgtgtttgcggcacagtttataggcgcaccgcccatgaatatcttaccgctgacctttgaccacatgaatcactacctgagcccgcttacgcaacccgtcgttgaaggttttagcaatggcgcgctcagccttgggatcagggcagaagatatccagctcattaacgccgatggcgcggcgctgacggccaacgtcgtgagttatgaatatatgggggcggacaccttattacagtgccagcttgctcacagccatgcgtcgttaaccgtcacggtcccgggaatgaaacggtttatcgagggaagtctgaccgggctgcaatggcctgccgataagcaatacctgttttcaactgatagcggtaaacgctgtttgcacgctgagcagctgatgtctgtgtcatccaaaaaatatgcggtttaacggtctttttacctaagggaaaatcatgtctgccattcgtctgtcacatctgcttcctgcattgcttatcgcaacgagcgcgtcggtatttgccgccgatccggttaagttgcagatgtactatcccatcgcggtgggcggagaaatcagccacaccgtcgaagcactggtcgctgatttcgaaaaaattcatcctgaagtcagtattcagccggtatataccggtgactacgccacgacggtgaccaaagcgttgactgcgtttcgcggcggtaatgcaccgcaaatggcggtcattggtgatatcgaagcctattcactgatggacgcgggtgccattgtggcggccagcgacctggcaaaggacgatgacggtaaaaaatggatcgacagcttctatcctgcttttttgcgtcatatcaacggtaaagtgtggggcattccttttcagcgctcgacggtggtgctgtactggaataagcaggcgtttgaaaaagcgggtctggatgcggatacaccgccggcgaactggcagcaggtggtggactttggtaaaaaactggtcgtgaaagacggtgataacgtcagccagtggggcattgaaatcccgactacgcccaatggctactgggtgtttcaggggtttgctgcgacaaacggcgcgcatcttgataacggcaagggcaccgccgtctattttaatacacctaaaaatagtgaaacgctgcaatggctggccgatttaggccagaaagaaggcgtttcaccgaaaggcgctatcgcctggggcacgacgccgcaggattttctcagtggcaaaactgcgatgatggtgacgaccaccgggaacctgagtgtcgtgcgcaaaaatgccaaattcccgtttggcatcgcaatgcttcctgaaaaaacccagcgcggtagcccaaccggcggcggaaatctttacgtcttcaaaaatgcatcggcagcgcagcagaaagcggcaatggaatttatccgctgggtcaccgcccctgaacaggccgctcgctggagtattgccaccggctacgtggcgacctctcccgccgcatgggaaacaccggcaatggaagcgtatgtgaaacaggtaccccaggcgctggtggctcgtgagcaactcaaatatgcccagccagaactgtcgacctacaacagcgtacaaattcaggaggcgctgaaccacgccattgaagccgccattacccaggctaaaacaccagcagaagctctggaagcggcgcagaaacaggccgatcgtttgctaaaggcttaccagtaaccctatggcgatgcgcattcttacaccggcagcgtcagcctctcgctctggtggcgggtcattacagctgtgtggctatctgctgattttaccggcactggtttttttgctgctctttacccactatcctgcactggcgacggtgtgggaaagtctgttcagcgcctcacgtaatggtcatccggcccagtttgttgggctggataactatgctgcgctgctggatgacgatgtgtttatccgcgcgttgtggaataacctgctgtatgccctgatcactattccgctggcggtcacgctggctttactgatggcgctggccgttaaccgacgactggcagggaatgcggtggttcgtgcggcgttttttattccttctctgctgccaatgattgccattgccaacctgtggctgtttttttacacgccgcagcttggcctgctgaacaagctgctggcgctgttttcctttgcccccattaactggctcggggagccaggcacctcgctgtggtgtctgatggcggtctccgtctggcgtgaagccggattctttatgatcttctatctggccgctctgcagcagattgatccgcgactgagtgaagcggcacaaattgaaggtgcatctcacgggtacttcttccggcgcgtccagtggccattactgatgccgaccacgttatttgtgctaatcaacgcatcaatgaacgcatttcgcattgtcgatcaggtgattgccatgaccaatggcggcccggacaacagcagcagcctgttactgttttacatctaccgcaccgcattcagttactgggatttaccggcagcggcggcaatgaccgtggtgttactgctgattttagcggccattgctgtggttaagtttaggttactggacaagcgagcccattatcaatgaagcctcaatgtgctgttggtcgcctgtgcctgaatgccgttatctggctgatggcagtgctatggttacttcccatcctggtcgcgctgtgggtggcgatacatcccgcggcagagcaggggagctttacgctctttgctcccctgacgctccagaactttattgacgcctggcacgctgcgccctttgcccgctactttctcaacaccattttgctggtgttaatgatcgtcgtatgtcagctggtgctggccaccatggcggcttacgctttggtgcgttttcgcctgaagtattcgggggttttgtttgcgcttatcctgttacagctgatgatcagccccgatgtgttgatcctcaacaattaccaaacgattggcgcgctcgggttgcgcgataccttgaccggcattgccttaccctatttcgcctcggcctttgccatcttcctgctgcgccagacgtttaaaagcattcctgtggtactggaagaagcggctgtcgtggaaggtgccagccggttttatattttacgtaaaatttatatcccgctggccaggccgatttatatcgcctttgcactggtatctgttagcttccactggaatgattttctctggccactggtgattaccgattctgttaaggtgcggccattaacggtcgggctgcagttattttcttcgccggagcagggcgttcagtgggcgcttattggggcggcgacgatcatgacaacgctgccgttactgctgctgtttctgattttccagcgccagtttatccagtcttttatgcgtgctggcatacgttaaggtgtcccgcatgttaatgcctcactcgcttagtctgccacaacgcgcattactggcggaagtcgctcagctttatcaaccgccgtcgctgcgaactgtggcgacaggggataacagggtttgttttggtctgattgccgatccgcaatatgcggatagcgagccggatatcgacaataatctctattatcgcaacggactacaaaagctacagcgggccatcggggtgcttaacgtgcagccgctcgattttgttgtcacgctgggcgatctggtcgatcgcgactggcaaagctatgcggcggtgctgcctgtttatcaaggcttacagcatcctcatgccgtggtgctgggtaatcacgatgcgcagactatagccgcacggcttgagggaaagcttcccttacctaagagctattacgccttccgtttcaacggatggcgtttcattgtctacgatggcaacgatatcagtgtttactgcaatgcactcaacggcacagaccgtgaacaggccgcggcgttgctggcccgactccagcgcgcgcagcaaccccaggcacagccctggaatggcgcagtgggtaaacagcaactggactggattgagcaacagttacaggccgcccaacagtgcggggaaagcgtcgtggtattggggcattatccgctggcacccgagaatacacatatgttgatgaatgccggagagttggtggatttattcactcgctatcgggtacgcgcctgttttgccgggcacgatcatcgtggcggctatgcacgtatcgggcacaccgagtttttcactatgaaaggaatgctggatggtccgtcagatgcgccctttgcgcgggtggaaatagacaataacacactcaggttacatggctttgagggagaggtaagccgctgctcaaggacattaaatcgcgtttaatcaccaccattcctaatcagacctcttttcccctctttttaaagatgatttagttacatcatactgtaagtgaaatcattaaggtgcccgaatcaggcgcagagcggcgggtaagttaaggcgtaatggcgatgtagagaaagatggcgcttagctgagacggcgaaccctgttaagccagcgtgcgctaacgccacccgcttaaccgttcattgatcgattaaatgaatgtggtgtcattcagaccctggctatgtattttccgccgggctcatcgcgctatcagcggctggtgcgacagagatatgttgtcgcgctgaaatattgtctcttgttttcatactcaccaggacagcatgaatatttataaccgagagtaaaaataacgccttaatctgtcagcgcgcctgagcaccgggaaagtgtacttttatcatctggcagagtgaggctgctgcggcagatacgtttttttctgcgtaatgcagcgtgacgccaatgcttcctgcatcaggcaatttttgcccggtaataatccctaacgatgacggcatgcctgtttcagtgcgtagcgtaatgcccagccccgctgcggctgcggcccatataccgctcaggcttctgctggtaaacgcaatacgccacgggatattcatgctgtccagtgcggctgtcgctgcgctacgcatcatacagggtgcatcaaaaaccagtaacggcaacggtcggttctgcaagaaaaatgtgccgatatccagatcctttgcgcctatccagcatagcggtaacgtgccaagcgactggctataagcactgctctctttaccctgccaactcagtgcgatatcgagttcattttggcgaatagcctctaacagaggtttattacgggtgaccgttgctgatatctgcacatcgggatgcgcacgtgaaaattgtccaagaatggtgggaaggagtgactctccaaagtcttcctgcaaacccagacgtagctcgccacggataccaacggccttaacggctgcataagcttcatcgttcaaactcatgagcctgcgcgcgtaagcaagcataatttcaccctgggctgtaagaaccagatgtcgccctgacttttgcaccagcgctgcacctgcctgttgttcgagctttttaagttgggcgctcacggccgatgttgaacgacctaagcgttcagcggcggaagcaaagctacccagctcaatgccggtcacaaaagtgcgtaaggtttccgcatcgaacgtaacgggtcttttagccattatgtgtcctgttttttgggattaggcgtcccattatttctgattttataaattatcaaggcgttttatctttttaccacatccaccagaggaagataaatgaacgctataaaggtgacccgagaaaacatggctgaacttgccccaaagctggcattgctcagtgaagaggtgttgtttggcgatatctggcagcgggaagcgctttccccgcgggacagaagtttagtgacggtcagtgcacttattgcgctgtctcgacatgagcaactggactggcatcttcagttcgcgcggaagaatggggtttctgatgaggaaataacggaagtgataacgcatcttgccttttattgcggatggccaaatgccgtttctgcgttgaccgtcttcaaaaatgcacagcctgagtaaggagcctgtatgcctgtcactcgtatcgctatctcaacaccgcgtttccagcagtggcgagaggctgtttctgatgctttacagcagtcacttgaagcgtcgtttgccgtaccacgcggtgactgctttcagttttttgattgttatgacgaacgtagccgcatttttgatcggcactatctgtgcgacggggaagcgggccgtagcgatgacttccttatgtttactgttaccgccggtaaagcgcgcagcactcaacaaaagcaggctttttatcgcgatctgatcgggcgtcttgaacaagcgactggcataaacccccgcgatgtcatggtcattattcatttcacacaatctgaagactggtctttcagtcatgggaaaatgtttagcctgacggctattccacacgcttaaggagaaaagtatgcttgctatgcaatatcggtttgttcttcctgctgattacgacatgacaatcattaaacgccggattaatgaccatgggcataagatggaaggctttccgggtctcctgtttaaagcctggctttatgcctgcaaatccaacagcccgacatacagtgaagaaaacagctatgcgccattttatctgtggcagaacgcagaaagcctgcaccgttttctgtccggggcaggttttaaaaaacttaccgaggatttcggctggccacaggtgcacacctttccggtcttatcggctgacttagggccagatatctcgcatgctggctttgcatccctggcggtgagtcgcgttcctgcttacagcgaactttccgggcttactcagtgcccagatcaatccggggctgtagcacgcgtctctgctctggatacctttcactggcggcgcatagcattttgcctgtggacaaaagcgcctgcgcaaaatgtactgcacacgcaacactacgaggttggtcgtctctcttttccctaaatgtgccttatttaccgtctgacacaaaattatcggttaaccggatatctaaatgaccggttgtgtggctatcttacagtacatgccagactatttcgtatcaccacgctggcaacgcagtcgcgttatcacatgacgttaatttttccatttttagctaacgaacctagtattaaagtacaagggcacttttgcctgcttgtcgacggagaaaaaaataatgcgtatcaagaatcacctgaaaatattgacgaccgcaacgctcctggcactgagcctgccgatgacctccgcatttgctgcattaccggtcggtgcaaatgcgccagattttaaactggaagccgcactggcaggtaaagaaacaaccttctccttgcagcaggcgctgcaaaaaggcccggtcgtgctttattttttcccagcggcgtttagtgccggttgtacgttagaagcacacgcatttgctgaagccaccgatgaatttaaaaaacagggtgcgacagttatcggcgtgaccgcaggtaacaccgaccagattgagaaattctcaaagcttgaatgccgcgataaattcaccgttgccgccgatccgggtgcaaaagtggccgcggaatataaaagtaccatggagatgaaaggtaaaacgctttccgatcgtacctcctatgttattgcgccagatggcaaaattttactgagctatacggataaaaacccggaatcccatatccagaaaacgctggatgccgtgaaaaaataccgccaggctaacccggcttaatctcagatctggacagataaatcatgctgactgctatcgccgccgcttttctgggtggcatcatacttaatcttatgccatgcgtgtttccggttatttcgctcaaagcgttgagcctgatacggcatcacgcccggccagcccatgctcgcgcagaagggctcgcgtttttggttggcgttgttgtcaccatggttttactggtcagtctgttattgctggcgcgattgggtggggcatccgtgggctggggctttcaactgcaatcacctctggtgattgcagtgttagtcctggtgatgctggcctcggcgctcaatctgttcggcctgtttgaagtgggattatcacttcagcgggtcggcgaagtcgggggcagccagggtgggctgattggttccgcgttgacaggggcattggccatcattgttgccactccctgcagtgcgcccttcatggccagtgcggtaggttatgcgctgacgcagccgccctttatcagttttattattttcctttcgctggcgctgggctttgccgcgcctttcaccttgatttcctttttccccatcgtcgccaggatactgccatcgccgggcgcctggatgatcaccttaaaacatgccctggcatttccgatgttaggtgcggctggctggttaatctgggtgctggagcgccaggcaggctcaaccgcgctggcggcgatactgacctgctgcctgctactgagttttgccgcctggctgtatggactggcacaaaagcggcagatgatgggaaggcggcattgggctttacacatcgctacggctgtcgtgatcgttttgctggttccccctttagtcacgcttaagggctcaacggcggcagcggattcgtcagatgttgttgcggcggcggcggttgcgtggtcacctcagaacgttgatgccattaaagggcagggtaaaccggttctggtgaactttaccgcctcctggtgcatcacctgccaggtaaacgaacgcacctcgctgtctacccaggcggtaaaaacggccatggcacgcacgaacaccatctatatgattgcagactcgacaaagtacaatcctgacgttgaacaggcgctcagtgactttggtcgtggtgggttgccgctttatgtggtttatccggctgatggcggaaaaccggtggtgttgcctcaggtattaacccccggaacggtaattactgccttgcagcaggcaagtgaaaaaggcaaaaaatcttagtggcaaaagcagaacgtgaatgcctgccggacataccctgacggaggcccgctattttcttcgcagcgaattttcttcgcggcgacagcgcacgtccatcgcatgcatagggaatgcctgataaacggccatagcccgttgggctaaggccgctattatcagcagtttcatggctttctagcaaaacccttcacaggataatgatgaaaacgattgggcttattggcggcatgagctgggaatcgacaatcccttattatcgtttaattaatgaggggatcaggtcccggttaggcggcctgcattctgcaaaactgcttctgcacagcgtcgatttccatgagattgaagcctgccaacgcagtggtcactgggatcgggcaggtgagttactggccgaggcagcacaaggtctggcaatggccggagctgatgccatcgtgttgtgcaccaataccatgcataaggttgccggcgcgattgaatctcgctgtgatttgccgtttttacatattgccgacgcgacgggccgtgagatagtgagcaaaggaatgaaccgtgttgccttgcttggcacacgatatacgatggaacaggatttctatctgggtcgcctgactaagtcgttctcaataaacactgtcgtacccgatgcggagcaacgtgaggtcattaaccgcatcatttttgatgaactgtgtatggggatatttacggacgcttcccggcactattatcttgacgtgatacagcaactggctacgcaaggcgcacaaggcattatttttggctgcacggaaataggcttgctgattccagaacagcaaagtgcgttaccggtgttcgataccaccaaaatccatgccagcgatgcggtgaatttcatgctgtcctgattcacccttacagagtgaatcagtgcacaggcgtttaaagcgtgtcgaagataacgtagagcttgcgcatggttgtgtccatcacccaggtgccttcggtattggcttcgaagaacaaggtatcaccgggtttaaaatgctgcggtgcttcgccatctgctgtaaacgaccctgttcctgacaggaaatgcatcatctctgcttgcttaacgccacgacgataacttccaggcgtacattcaaaaatgcccatatcaatgctttcatggcccggaattaccttttgcagtcctgccagtgcgatttcgggtgagccaggcagaccttccacggttccccatggctcaagcgtcttgagtgaagcaggttgttcaagtttttgtactttcattttaggcttcccgagccagccgccacgaatgcggcctgatagtgaatgatgcttcagggtaaacaaaagcagaaaaacaaagcgcgtctttaacgtttcctcatgaaagttatgcgcaaataagatcgccgtaaaagcatgaaatttctgacagccttgggcacagggtttaaacgcacgcggatgttggcattacggtttgaagccacgtttaagactggagccaggcggtaacatcagccttttattccccgttgctctaattgggtttggtacgttattcgcggtgcgttactgagcgtcttcgcagccaggttaaacgacattaatctgatttattatatgattctattgaataattttaatttaagcgtgatgtaaacaggtcacgatctggcaaggaataatctgatttattaggtccgtcttacaatggaaatataaaggatctattttgccactgctgaggagacgccggcacccaatctccctgaaggcatggcgcaggcgctctgcgcggcggccatttcactgggcaaagccgtaaactatcgcagcgctggaacggttgagtttgtctatgacagcgtggcgcagcagttttattttcttgaagtaaatacgcgccttcaggtggagcatggtgtaacggagcaggtctggggcgttgatctggtgcgatggatgattgaactggcggcgggcgatttgcccccactggatgacttatttgccgggctaaaaccacaggggcatgctattcaggcaagaatttatgcggaagatcctggccgacagttccagccttcgcccggcctgttaaccgaagtcgtcttcccgcctgccgatggtgaaacgctacgtattgaccgctgggtcgaagcgggatgcgaagtcccgccgttttttgatcctatgctggcaaaaaccatcgcctggcgtcccagccgcaatgaggctatcgccacgctgacgcaggcgctggcggagacccggttatacggcgtagaaactaatcgcttgtacctgatgcaaattttggcgttcgctccctttgccgcaggcgaaccctggacccgctgtcttgagcaactgtgttatcgagccgccacggttgaggtgctgagtgccggaacccaaaccagcgttcaggactaccctgggcggctgggatactgggcggtgggcgtgccgccgtcgggaccgatggatgaccgcgccctgcgtttcggcaatcggcttttgggcaatgccgaaggggaagccgcgctggaaatcacccttatggggccaactttgaaatttaataccgatgttcaggcggtgatatgtggtgcgcccctggctgccacgctagaggatgttgctgtgccgatggactgtgtttttagcattccggctggcgcaacgctgaagctgggtgcgattagccacgcgggcgtcagaagctatctctgtctgagcggcggcattcaggtgccggattatttgggcagtaaaagcacgtttacgcttggtcagtttggcggtcacgccggacgggcgctgcgcggcggcgatgtgttgcatctggctccgcgagctgccagccagaccagcgcaacgctgcccatcgcgctgcgtacggcactcccgcaggtgcgtacgctgcgggtgatttatggcccgcatggcgcgccggagttcttcgagccagaatatattgcgactttctttgcgacagactgggaagtgcattttaactccagccgtaccggtgtgcgcctgatcggaccaaagccgatctgggcgcgcgacagcgggggagaagcggggttgcatccgtcaaatattcacgataatccttacgccgtcggtgccgtagattttacaggcgatatgccggtgattctggggccggatggccccagcctgggcggttttgtctgtccggtgacagtgatagaagccgacctctggcagttagggcaacttaaagccggcgataaagtgcgttttgtggccgtggatttagctaccgcccgccgactggctgaaggacgacgcaacgagttagcgacactcgaggtgcagaaaatcgcctggcaaccggctcccttgacgtcaccgatcatcatgacctgcggcgaggcagataaacgcctggtggcgcgcctttccggcgacacccatttgctccttgaggcaggcgagccggagctggatctggtgctgcgttttcgtattcacgccttgatgcaggcactggaagcgccatcccgaaagggcgtaattgatatcacgccagggattcgttcactgcaaatccattttcagcctgaaaccctgacgctggcctcgctgctgacctgggtgcgcgatgaatgggcggcagtatgcgttagcgatgacctgcaggtacccacgcgcgtggtgcatttgccgctctcctgggatgatccggcctgccggaaagccatagagaaatatatgaccaccgtacgccatgacgcgccgtggtgcccgagtaaccttgagtttatccgccggataaacgatctgcctgatgaagaagcagtatggaatacggtgtttgaagccagctacctggtgatggggctgggtgatgtgtatctcggtgcgccagtcgcgacgccgcttgatccgcgccatcgtctggtcactaccaaatacaatccggcgcgcacctggacggccgagaactcggttggcattggcggtgcctatctgtgcgtttacggcatggaagggcctggcggctaccagtttgtgggccgcacgcttcagatgtggaatcgatatcacgacgtcgctgattttgccggtcaaccctggctgttgcgttttttcgatcagctacgcttttatcccgtatcggcagaggaacttctgcatattcgtcgtgattttccacttggccgctatccgctgcgtattgaacacagcacgctacggttagcagaatatcagcagttcctcgcacgcgaagcacagagcatcactgcgtttcgcgaccatcagcggcaggcgtttaatgctgaacgcgaccgttggatcgccagcggtcaggcccattttgacagtcaggagattgtggctgatgaagtcggcgatgcgccgctacagccgggtgaacagggggtggaaagccctgtttccggcaatttatggcaagtgcaaaccactgtgggtagccgggtgcgcgcgggcgatgttctggttgtgctggaatcgatgaagatggagattccgcttctggcaccctgcgacggcgtgatccagcaggttaatgtgcaaccgggcagcgcagtacgcgcaggacagtgcgtagcggtgattattgaggataatatttaactggcggggatctgatgtacatctgactatccctggcgacgaactatcgcaaaggtctaaatatcctgcgcctgctgaccaacatccgtcagcgggcgcgggtgcttaagcagagttccatgtgaaaaggtggcaaagtcatgaaccactttaagacggggaacgtcattcattgtaatgcaccccgaatcctaagccgtcatcagttgcgttctcagctgtgaaagcctggaaaaaggacgataatgcagacatctcaatataaccagaggcgaacatctgaatttagccattatcatataggtgcgcataatctatcttatgttaaataaggtgtccagttacgtactcagatggctccccgggatcactggctcctcacctgcgtaccttttcgttctaaagcctgttctgcaccgatcgcgctacgcgaaaactggcccataaatcccctgcgggtttcgcagaattcacatagcgttgtcagccgcgttaatattacgcttaaataagccgtgtagtctggacggagtcagacgcgagctaattatgtctggaaaacagcgagtcccacaaattgtcacgatgacagtagaacgtacgtaacttacttggccgtgcacgtgaggccggaatcaatcttagtaccgcgctgactaccgcgcttgacgccaaactgcgtcaatataaagcacgcaagtgccaggaagaaaacacggaagcgcttgatgcattaaactgttttcacgatgaaaatagttgcttcagtgatgattacaggcgttttaataatttagttcactgtctaccgcaatatgggaaaacgtactctctattccttgctgcgtgataaaatccgcgacttattggccagtgaaatcgcaggattgctatccctcttctgcccgttgaaagtatccagctcgcacccgaccggaaagacttatcccgcttgtgagagtgccagatgagcgtgaatatgcggttatgacccacgagatggcgagtatccccgctcatgcgtcaggcccactgttctgtgacgcatcgccttgtcagacagagattatagcggcgatagattttctttttaatggtatttaacgacctctatttttatgttttgaagggaatgccttaagataaagataaaacccttaaataatttaaacgcctcatcgaagatgactcaaaaattatctgactcaataatagtcgcatcaggatatataaaatgatcaagaagctattcatccgtgtattactcaccctgcccttataattaatcgacaatgtttctcctgttctgaattcagtgcgcctccgattatggcttcagacaatcccgactaaataatattgaaatgaacaggcgtcattttgcatcgggtgcctgccactgcttaaaagatggtggcccaggcgaaaaataatgtagcgggcatcgctggttcagctaacgctgataaaaacagaacccgtctgaattcagagtgtaaaaatgcgcaactgaaatttacatctgatgtggaaccgaacatctgctcatcataaacttcaagcgaaatacatacccgggagactgagggtatttttgtgcaaaaaaccacatttaagcctcctggcgtacaggttccgtcatgtcagaacaatgtcagtgtgtcctctgcagtaaccatccattagtcaatgagataaaataaaaattgatttctccctgctgctggcttgagtgcgaaaggcttagttaatacttaattgagtatttatccttaatgactaagatgtttttttgtttttacactttcaattgtattgaaacttttcaggtagttgacctaaaaagctacaccagctataacaatattgtctctgatattaaaatcgcaaaaaattacgttgaagcaatttgctttggtatagaaatatttcagtcttgcccgcgagaagacaggatttcatccgcaatctcgtggttgagattttttctacgcatacagccaaggtagcctaaaaatggcagattctgacagcgacgccctgccgttgcaaaagtgcatgagacagggcgaccagcaaataagcgctaaagttgattccgccccgggagcgccgggtatcgcaccccgctggacatcaagtgccaagagcggaatcggtacggccctttcaacagattcccctgtctggttctccttaagccatggtgttctcaacgaaatctattatccgcgcgtcgacagcgcctgcacccgtgatttcgttttcgtcatcacggggccggaaggttatttttccgaagaaaagcgcgattgctcgaccgaaatcaatacctgctcgccaggcattccggccttttcaatcagcaacacgtcccgtgacggacgttacaggcttgaaaaggacatcattacagatccggctcgtgcctgcgtgctgcaacgcgtccgtttcaccgctctgaagggtgatatcgaggattacaaggtcaccgcactgcttgcaccccatctggtgaatgcgggacaaatgaacgctgcatggatcggcgaatttgaagacaagcccgtgctttttgccacgggtcgatcttgctacctggcgctcgtctgcgacataccctggacagcagtgagtgcaggttttgtcggtacttcagacggctggcaacagctgaaaaaacacggacgcatcgccaaccaatatcagcgcgcggatgacggcaatgtcgcgcttgctggggaactggtgttcacaagcaactgccgtgaagccacgctggctgttggtttcggccagacggaattcgaggccgcagcggcggcaaccgccagtctgaaagcgggctttgatgcagcgcggaatcactatattggcaactggcaagtgtggcaggacaagctcatgccactcgaccaggaagagtggaacggcgtaaatacataccgggtttcaacagcagttctggcctcgcacagagacgccgattcccccggcgccgttgtcgcaagcctgacaataccctggggattttcgaagggtgatgacgatcttggcggctatcatctggtctggccgcgcgacctggttgaaacggcagggggtttcctggccgctggcgacgccgacgcagcactcgctatcctcgaatatctccggcacgttcaagagccctccgggcgctggccacagaacctgtggctcgatggaaaaccttactggcccggtatccagatggatgagtgcgccttccctattctgcttaccgatatgttgcgtcgactcggtcatctcgacaagaaagcgcagaaacattttatgccgatgctgcgcagcgcggccagctacattctgaccaacggcccgacgaccagcgaggaccgctgggaggaagactcgggctacagcccctttaccctggcggtagaggttaccgcccttcttgctgccgcggacctgctttctgtcgatggagacgaggcggcggcaaatcacctgcgagaaactgcggactgctggaatgaacagattgaaaaatggacctttgcgggagagccaaatttctgcggctcgatcggtatttccggtcactatgtccgcattgctccgtcgggcgtaacagatgaggccagtgcatccggcaataccgagatccgcaaccagacgccggatcgggcgcttctgtcgaccaccgatgtactgagcccggatgctttggcgttagtgcgttttggactgcgcgccgctgacgacccgcacatcgttgatacgataaaggcaatcgaccacagtcttcgtgtcgagctaccccagggtccactatggtatcggtacaccggcgacggctatggcgagcatgaagacggcgtgccgttcgatggtatcggccagggacgtccctggcctttgctggcgggcgaacgtgcgcattacgagctggcagcgggcaggcatgatgtggctgaggcgctattatccacgctggaaaaatcggcaggcccgggcgggctgttaccggaacagatatgggacggccccgatattcccgaaaaggaactgttcttcgggcgaccttccgggagcgctatgccgcttgtctgggcgcattccgaacatatcaaactcctgcgatcgctccacgatggcgcggtcttcgatatgccaccgcaaggcgtcgagcgctatatcagaaataagaccgcatcgcatttgcgcatatggcgctttaacaactgcctgacctctcttcctgtcgggaagcaactgaggctggaaacggaagcgaacgccctggtgcactggagcacggatggctgggctaccgtctctgacacacctgcagtctcttccgggctggaaacctattatgtcgacctgcctttgcagcatgaagacgcaggtaccagcgttgtcttcaccttctactggcctgacgtcggacactgggaacacaccgactttaccgttcacgtcgtgaatgaacaggaagatcaaacacgcatcgataatggagaatgaaatgcagattggaatggtaggtctcgggcgcatgggcgccaacatggtacgccgccttcttaaacagggccacgattgcgtcgtcttcgacgtgaacgccgataacgttgaagcactcatcaaagagggagcaaccggcgcgtcatcgccagcggatcttattgctaagctggagacgccgcgcgcggtctggctcatgcttcctgccgcgatcacaccgaagattgcgcgggacttcgcatcaacgcttaccaagggcgacgccatcattgatggcggcaactccttttaccgtgaggctatcgacctgtccgaggagttttcatctcttggcatcgactatatcgacgtcggcacatcgggtggcgtttggggcctggagcgtggctattcccttatgattgggggcccgcaggcggctgtaaaacgcctggacccgatttttgcatcacttgcgcccggtgcgggtcagagcatcgcggaagacccggccgtgggcacggctccaagaggctatcttcattgcggaccggcaggcgccggacacttcgtcaagatggtacacaatggcattgaatatggtgtgatggctgcctatgccgaaggcctgaacatattgaaagccgctaatgccgggaccgtcgagcgagaggctgatgcggaaactgcacccctttcccacccgcaatattatcgtttcgatgtcgatcttcccgccgttacagaggtgtggagacatggctcggtcattggctcctggctgctggatctcacagccgaggcattgaaacaggacccgcatctcgacaattatgatggccgtgtgtccgattccggcgagggccgctggacattgcaggcggcggtggaaacgggcgtccctgctccggttcttgcatcggccctcttcgggcgcttctcttctcgtggcgaagcacagtttgccgaaaaagttctctcagccatgcggcatgccttcggcggccatttggaaaaaaccaggtaacgtagaggagcacaacaatggcgcagcagcgatcagacgtgctggtggtgtttggtgtcaccggcgaccttgcccacaagatgatcttcccttcgctctacgcaatggtgaagcatggcgcgctcaagacgccgatcatcggtgtggcatttgaggactggacgcgcgatcagttgatcgcgcgggcaagagatgcggttgaaaagcatgtcgatgtcattgatcagacggtctttgccgagctggcggacaggctgtcctacgtttccggcgattatcgtactcagtcaacattcgacgggctgcgggatgcgctggcaggccatcataacccgctctattatcttgccattccgccctcccttttcgaaactgtcgccaacagtctggaagaggcaggtatcgcgaaaggtgcccgcctgatggtggaaaagccgttcggacgcgatctcgcgtcggcaaaacaactgaacaacgtgcttcataaggttttcgatgaggacgcgattttccgcatcgaccactttctgggtaaggaagccattcagaatcttctctactttcgctttgccaacagcttccttgaaccaatatggaatcgcgatcatgtcgaaagcgttcagatcaccatggccgaggacttcggcatcaaggggcgcggcaaattctatgacgaagttggctgcattcgcgacgtgatccagaaccatctggtcaatgtgctgctgttgcttgccatggaacctcccgcgtccggcgcgtccgacgatctggttgatgagaaggtacaggtgctaaaggccatgccgcccctgtcagacgctgacgtagttcgtggtcagtttgaaggctataccgatgaaccaggtgtcgcctctttctctccgacggagaccttcgctgcggttcgcttccacattgcaacatggcgctggagtggcgttcccttttatatccgtgccggcaaaaatttgcctgcacatgcgacggaagtggtcgtgcgcttcaggcgaccgccggttacccttttcgatgacattaccgacgaacctgccaactatatccgctttcgtctcggcccggatattacgatcggcattggcgcgcgacgcaaggcggccggcgaaaagatgcgaggtgaagccgtcgagctaacggcgcttgacgatggtattggcgatatgctgccttatgagcgactgatcggagatgccatggctggcgacaggcagcttttcacccggcaagatgcagcggaactggcctggaagatcgtcgagccgatactggatgagaaaaccgttccagctgcctacaagccagggacatggggacccgccgcgatggcggactttgcgccccccggcggctggtttgaccccgtttgagctgatggataaatataaatgacaaagcatactttaaaaaagaaagagcctatcgttctgtccatcgacatcggcggaagtcatgtgaagatcctctccagcgctggcggtgaagaaaagaaggcagaaagcggaaagaccatgtctgcagctgacatggttgcggcggtcaaggccatggctgaaggcatgacttacgatgtgatcgcgatgggttttcccggtccagtggcgcacgataaaccgctcagtgagcccgccaaccttggtgagggctgggtggggtttaactatgcggacgcatttggctgccctgtccgtgtcgtcaatgacgccctgatgcaagcgctcggctcctatcagggaggacgaatgctgttcctcggtcttggcaccggactgggtgctgccatgatcgtcgagaatgtcgctcaacccatggagattggtcatctaccctaccgcaagggcaacagctacgaacactatgtgagcgaagcctatcgaaaagataagggaaacaaaaaatggcaggagcgggttttcgatgtcgtggagatgctgaccaaagccctggagcctgactacgtggtgctgggtggcggcaatgtggataaactcgcttcacttccgccaaagtgccgcaaaggcgacaacactctggcgttcgaaggtggatttcgactctggaacgatcgcagcctgattacgtaatctctgctttcaggtttattaccgaatagcgttgctgggtttccgactctctgccgcgagcaattgtttgcggcagataaaaacctccagcgaattctaaattcaatgagacgtaatgcgctgtgtggacgcgtcgacatgacattttcaggtacttagaacaatggcaggtttttttcgccgtccatcgacgcgatgagaaaccgtgtcagaacccccaaaagagcctgaaaatcgcgtttttgattatctcttcatactgtctgacatcaccgactttatcccctaacgctttcatcgggactgatgacacgtcggttgtcacaacccggtatttgatgccattaacaagcacttgaggataaagttcacctgtacccttgaactcgctcggacgtgcaagtggtacaaccattaaacggcctggtgtttctattagatagctctgtacttcaacaagataggggtattttattccgtttatgtgcgggtaaacgtcaaattgcatcgttaccagttcctgtacatatcagaaagcgagccctcttctcccacaaagtcagagaaagctttcatgctttcacggttttcttctttccagcgttccgctcggattctgcgggcctcattgatgacaagttcgttaaccattccagagagatttaagccagcagatgaaaaaacctcataggcttctttatcgatggttacgttagttctgtatttcatgcgcacctccagagtatgagttaaaagtatacacttcggacacacactggcaaggctcgttttttgatttatggacggatttcaaggtgcagctggtcgcactcaacctgaaacacgtattcagcttgtcagactgccggatgaccagaaacaggcggtaatgatttgccagatggcgagcatccctgctcgtgatgcaggtgcactgttcgttaaggcagagcgggaaatgctatttatgttaaataatcaacttttaacgtataaaccaaaaactaagcacctttcgaattacatgtttgctgttaccagcggcactgttcacgggctgagcctgtcctcacgacatctgggcataaaaagtcagtgtgcacttctgttgctgttattttattagcaaccctgaaaatttcgacaaagacagttacatattactgagcaaaaattggcgattttgactgttttgcaccttaggtacggccataaagaccgcattttatatataagattcaattgaataagtttagcaatgagtcaccgttaaaactgcatttagctgttaagcattaccttcagtactgttttttaaataaaagtcagaatataacatttcaatttcagtttctgaaaatgcctcttcgacggtgccattatccaaattgaccttcagtcttgataaggggatagaataaatgtcacttacaaatactttggtgggattgtgggagttaaaaatggcataagctacatcagataactgagggtcggtcttgtcttcgatgctggagataaaaatacaggcagcaactatttttttctcattatttcggattccggcaaatttgggtccaggttcaactagttcaatgcctcttgtaaaacctgatgtttctgttaatgaaggtgcagttaaactggctacgtggcatcaccatctggagattaataaagcctgtgacgatccctcacttggtacgggttgtggggaagatgaaaacgcataataactgaaacctgcagacaccgtttacagataaggtgtctgcactgatatggttttattttcggtccgcccatgtaccctgtcgcgcgtcgtaaaagctggcgattctccctgtactgaatgaccagatcgaaaattattcagataaggcatactccattctcctcccggtcaatgcgtcccctgttagagacagagcacatttcttatcttatggagagcctgctccagtacacaaatttcaggaaccagagcgatgcgtatgaattcatgaccgggatttcggccatcaacagtctgggcaagatactcaccgggaagcacacggatgccgctctgtcgccagagctctgttgctgtggcgactccgttacccaccttcagccaggcaaagagaccggccctggggatgacaaaatctgacacatcccccagaaccgaagcgaccagtgcgtatttttcctgacactcctgacgtgccttaattacatgtgcttcatccgcccacgccagggccgatatctcctgcagcacacccggcacaggtgcccccccttttgctctgagattcctcattcgccttatgctttgcactccgcctgcggcgaagcctgagcgtagacccggcagacctgaccttttcgagagcgaattgaatacgactatccgttccggattgtactgggttcctgaaaccagcccgagatagccggctggtggttcaccggcataaagctctgaatagcattcgtcagcaaagatacggaagtcataacgctctgccagggccagcagctcaagaaggtattctgctgatgccactccgccctggggattggagggtgaacatacatatacggcttcaactgagttcaggattctgtcaggcagagccccgtaatccggcatataccctgacgccggatcggcaggcactggcacgggctcagcattaatgatcagagccgcagcacggtaggcctggtaagccggattcggcataagaacccgtgaaccatgccctcctttgcataaagccagcatggcggtgaaaagtccctctctgcttccgttaaggaccagcaggttttcctctgataagcggacttcgtagcggcgggctatccagtcacatattgcatgtaatagattatctgaaccgtaattatccggatacttcgccagaagatgtgaatgttggcacaatgcggcctgaatgaaaggaggaagctgctgctggggttcaccgaggtccagtcgtgtcggatacgcacccggcataacgccatgcaaaagctgtcgaaggcgctcgaaggcagaaaaactttcatcaattttttcaggttgcatcgtatactcccggagctcgaacggatcaggtaatgttgggttttgcgtctcagccttcgccatttcagaccaaactgtgcgcgccaacgtgatggccgcactgcctccctcctcgcggggattaatccggaaagtgttcatacccttcctgagatccggactgatgatattgataaaccgtcctgtcactcatacagggaattcaaaaaagtacgctgttgataaagacggtcggcccctttttcgtttcatggacgacatcaggaaagatgacagctttaagctttaataatttttttcctcagctaaggacgcagaaaaccggtcaaaatcagggattgtggataaatagtgtcgtgtcgtttcggcttcgcgaattaatttcactgtaccgttttgctgaagcagcagttcttttggcctaagacgcccgttgtagttaaaacccatggctgcaccgtgtgcgccggtgtcgtgaatcactatcaaatcgcctcgctgtggttccggaaggaggcgtccggtggcaaatttatcattgttctcacagagtgagccgacgatatcagcggtgacgggaggacgttctacaaagggagcagtgatgtggtggtaggcatcaggatagagagcaggacgcataagggcgctcattcccgcgtcgacaccaataaaagtccgaaacttgtgcatgacagtatttaccgccgttaccagaaccccgtgtgggcccgtcacatacctgccgcattctgtgtagagctgcgtggtatcagcgaagtgtttcccgtgaagttttgccagaccgtcagaaaaaaaagggaaattaaatgcttcttcatcgggcctgtatggtatgccaatgccgccaccgatgttaacgaaatccagagcgacgtcagcactctctgcaacatgtaaggcgtgagtgataactaattcggcgacgtccagcaccctctctgccaatctctggtttgaacacagcattgcatgcaggccgaaacgctttgcgcctaagtcttttgcacgtcgaaaggcctgcaccagttcagaatggggaacgccgaatttactgttttcagccgcccccatgaacgtgcacttttgatcaagagcgcctgcagccatgcgaaagcagacgcgttcagggaatggccgcagggtgtcgaggaaacagatatcgtcaagattgacaactgcaccggctctcacagctgcctcaaattcatcgggtcgcgtattattggaggtgaaaaagatgtcatggcctcgggcaccagccagtaatgctaattcaatttcagggaccgaggcacagtcaaatcccatcccctcttcctgaaggatagccagtatgtaggggtttggcagtgctttaacagcgaagtactgcttaaagggaattgcctttgcgacagacctgaactgtcggcaggtctcgcgaatgcctgtttcatcataaatgtggaaaggcgttccaaactccagcgctatttccctgagttgtggtattaaacgctgatgaaatgttccagacattggcatgagcttatctctcagtggttattgaaaaatgatgggcgatcagtttttcctgtctaactgcctctgttcagagacaacgttccagcaagcaataagaaaaagtgagcagattgccaccaccgttgaaacactgtagtggagcctcgagtcgaataactggaacagccacgtaaatccgggagcacatgcaatgatcaggagtacggtcgttgaaccacaacgctcaagccctttctgcagagcaaaaatcggaacagcgattccgagaaccgcgatgatcccggcaaggatgaaagtaccggacccgggggtcaggtcaccagacatgaaggcagatatacccgacaggcataccagtaaaacaaaacgcgtacgcatcaaatcgaaagcgttgtacccgtgcttataaagtcggcgggagcgggacgtgaccagcgcaattgcagcaccgccaagcccgcacaacaatgcgccagtccagaatgcgccggaatttatatctccaatcgcgctgacccccaggtaggttgaactcagaagaaagaaggcggtaagtgccgaaaaaaacacccggattttaacattacggttattatcgcattctatcccgagcagttgtgagaagagtgggcttatgcctactgtcacagcgctgacaaccgcgggctcaaggtacctgactgcccaaaaaaagcatccccaggccagagcggtctccaggttaagcagcgcaatttccctgaagcttttcgaaaagatcgaccaccctttcctgaacgaccggaagttaaaaataatgtcagcgttaaagattaaggtcactaaaccaaacgatagaaatacaagaagatttgggtctgtatcctgaaccacatgaccaattaccacttctttggccgctgacatcacagaataaataaggacaaatatcgcgcccgtggaggagtaacgtctggccagcgtttcactgacctgtttactgtcattcaacaacatggaaaatttctccggccagctccatttcccttattcgtttatggtcctctgatattgtcgcgtcgtcacccacaagataaataatgcccggggaagtaaaaaggtcgcgggtctttgatatacgagagcctacctgagggagatgaatggctgaatgaaatgaaggcaacgagcggatgtgctgaagtccttgagcgttaacaatgcggccttcctgattcgaaatcaggctgatacatgaaacggaagcgcgccgtggacatgacttaataaataattctgaaaaaacttcgggttgtgagtaacgcagtaccgtcagagagacaacatccgtcccagtacatcgacgaaccgcgctctcatctatcgtgccctgtaaacgggctgcggtttcgatcagaaccggacctctgtccgtatatttgagctccgtgtgactggctccttctctgataccgagtgcgtcaagtacgccggttgtataagaaatgagttcagcctggacatgccccgtcagttccatcaggtcttctttccagcagacgagtgatccgttatggccgggcatgcgatcatctttccagatctcgctaacgtaatgccggccattaacagacgtacagtttacaaaatattgttgcccctgcagatattcctgaatcagtacactggaattcgtttccccaattgcattttgttgcccgaaaagcaggcctgaatgcgcaataacctcttctcgtgagccgcaaattctgaagccatcacctccagcgctgttagccggttttacaacaagagggaatgaaaaatttttaaaatccagatggtgtaagtcttctgcgttcattaccttaacttgcatcggcacatctaatcccgcatctttaactgcttcgatcatggcaaacttatcgcgccggctttcacttttctcgatcgtattgcttggcagcgaaagatgatggcttatcgcttcagccaaaaccacgccagactctgttcctgcaatgacaaagtcgggggcaaaccgtgagattttttctgaagcctgcaagtaatcatcgcccgaaaaaccaaagtcggtttcaaagtcgcccggacgaaacgttttttcataatgaggagacggtgtttcgccggacctgatatgcgtaacggtaaaaccctgctcccgaaacagggatgcgagtttggcaccagtggagtaagcatcacagattacaattttcttcatggacgctccgctacgataacgagattgtctccgggagacttaggcgttaagtcaaaactgccgtagaagcggatgtccttaaatcctgccttaatcagcatttctttaagctcctccttccagtaaagacgtgttttacacgtcagaagctgacctttgtaccggtaatctactgtcagcatcttatcctgaacgatcagagtttccttaacaccgttcttttctctgtgcgtatggccgtcctgttccagaacgcacgatgctctttccatatctgacagttccattataagccgcccgccagtccgcagtgactgaagccatgaagaaaggattttctgatctgcagtctcattttccgcataaccaaaactcgtataaacatttactattgcgtcgaacggtccggcgggcggactggccatatcacaaagctgaaacacagcatcagatttcagatttcttgcaacgtcaagttgctccgaggataaatcaatccccgtgacggtatagccaaggtttgcaagcgcgtgcgacaccctgccgataccacaacaaacgtctaagattttattatatttccctggcggtataattttagatatcgcgatggaatctaaaacagtatggtcatatctcccaagagcttcagacagctcgacaaacaggagaggcatggccccctgtaccgcgctttcgctatgagcggcactgctattatattgggtcatagtaattcacatatttagattttataaaataccaggaggttatgttgtttaacgatttaatattccgacgtaaatcgttcttttgcgaattcctgatattggccggtgatattcaaatatttcagatctcagctcatcaataccaatttttttaaactgctttctgagatattctgatgataaataactgaagttcggcaccgaaccatgtggctcaacatccgctccctcctttatcggggcatcatttgaaacgataattttagcattatcatcaagatgtaatgcctgcaggtggtgtaacgagcgtgtcaggccgctgcaggaatcatataaatgaccaaaaaagccatcagcatatatcgttgctgcatcctttaaaatatggggggaaagctcgaagaagtccgcgcagatgctctccagaccttttcgggtggtgatcgccacagcctcctcgttgcaatcgacgcacactacctgatagccggctttcatcagtcgctcttcgatgaagccgttaccactcccgagggaaactatacgagcccccttgggggtgttagcagtaataatggccattatgcgggaaatgtattgtggtgagaaaccggatggtgtaattgagtcaccgaacgggatccccttttcccataattcgtaaagattctgcccttttctttcctgaaccgggccataataatttggataaatttctgtaggcattgaagtaacctcgatatttaatcctgaatgatgttagagatacctttaaagggaatatatctcttccatcgactcgtgtgacacgacccgatcaatttcatcagcaccggcataggagaaacatacgatgatccttaagtctgcttcttttaaaggtgacacatggtgcaggtttgcggcaccgttaattaaatagaaactaccctgtggcacatattcacggtatacaggtcccttatcaaggtaggcctggatattaggattctctttatcccactccgtgtttggaacaaattcgaccagccccccgttaccttctcttggggccctgacaatgaataacaatgaataccggtaatcatcccagtgccacccgtgttcatcctgaggtaactgctgactgttgataacaatttcctcaggttcgaaaggtactttgattaccttgtcggcagtaatctgctccaggactctgaaaagagcaggatcgctgtaaaaagccggaagaaggcgggccattgcgaaaatatcatgacgactacagctcatgtacttgcgggggctgttgtctgttgatgatactttggtatcccgccgctttgctgtttcagtaagacagttagccacttccagctctatcaggtaacggagctgctcaggaataaaattgtccatactgacaaagccgagctcctgaaatttactgctccatttaactatttccgcctcacagccagcgaaatgggcctcaaggtcaaaagatttagcaaattctgaaatcacacttacctccagacagatgagttcaatcaacgggctctttcatggataacataaaaacacttttcttggtgaggattaagcgaagtccaatctagattaattttttttcatcatcaacaagaattaatggatcacggaaagtaatcaataagaaaggcttaaattttgtcgttacgcttatgtttttaaatgcttttttttaggctttaacgggaatcccttacagataaacagctgataactgaataataatttcatattaatcaattacttaacgttttcagtctttttaaaactgaatttttttcgaaaaaataagaaaaatctcaggagtaaaaatgattagtaaaacggtttacaagatgttttattggtaagatgcaccgcaattaaaatataaactaaatgcatgtttattgtttcgctgttacatgaaatttccatataaaaactctggtttattggaaacctgctacaggaagacagattttgcccgtctggtaatcgaccacgccacatttctctgtctctgtgattaacgccggcagaatgaataccgggtaaaagacctgggaaggtattcacaaccatccggtttgtgagtggctgaggagtatgatttattcacaactacagcttcatagctttatcaggagtctgactacaaacccataagcaaataaaaatgcacttgagcttttacctgaaacctcgtgagtacataacaaacttcaggattattagtgggcttcaaaaagagtcctgttaaatacccgctgcatcactctctttaaacctcacaagggccgccatgccatgttcgcttatgccacaaatagttaagctagtgtccgcatgcaaaatgccgcttaagcggcataaaggcgccagatgacataaaagatggcgcagatgctgaacggcgccgtacggccggcgtagccggttacagacgtataaatcgtgccctaccctacctctccctgaacagctctgcgggctttcagcaatgaagaaactaaggtaaccccttttaaccccggtgagcgggctttacggcgcttgcgacgtgaagagcgtgatttccggggcctaagcgtcagcagcttgttgctgacgcttaggggggtgttcactgtaagcagaagcatatccacttacagcgacaccagagtaattagttacaacacccatcaatcagccacgcctgttccggcccgaagggccgggcgggggcgatgggttttcaggtccggctccggtctctgcctggaggggcactcagggtgcaggactgcgccggtgctgtttatagtgaattattgtatgctgtaactaaagtgctatgcttttggggcccgcgtcagcgggagctacttcagattctgagcggcgcggccgctgcgagcgaaggccttttccacttatccacagcgttgagggtgacggcaccggggtggataaccttttctcccgcctggtttttcaggacgatttcaccgttctcgcgcagttcggccacgcggtactgctcatgcgcggcatgcccggcctgtttctgcgttttgttcagccgcacactgtcgccttcactgagactgatttcacgcttctcgaacacttccacctcggtggcgttcagttcctttggcgagtaatagtgcagccggtcgttctcgtccttcagcgcaataagcccgttactgatgtccacctccgagaccgtcagataacgttcgtttgccagcaccaccaggccttcccgccagtctttcaggcggttaaagtcgtgccgcccgccgttgatgcggtccagcaccggcacagagacgctgtctttaccgagttctccccgctcagccagggcctcgtgaatgccgcggttgatggcccggcggtcatcgtgcagttgaacgaggatcatggtctgatcgcgcgcctcgtccgtgcggctgataaaatctgccacgatcacctccaccggcttactgctctcgatgacggagccggcaggcaccacgctccccggccgcctcggcaccaccgatggcgacactttctgcacgtttttcagggccgtcgcgacgtcactgtcgatgatgttgtacaccgctgctttcaggtccgtgctgcgctgtcgcacgatttctttcatgacagcaacgtcaatcgggctgcgttcctgaatcagccggaatggagccccgctctcgggcgatgtgagctgatcagtgtccccgaccgaaactgcccggccgttgtcggcagcaatggcctggtagaccgccgccgtgtcctggttgcccagcatggatgactcatcgataagaaacagcatgttgtcatagctgaccgtttcgcccgctgcggtgcgctgctgccagtccagcacaaacgatttgacggtctgtgcatcgataccggttgaggccatttccttgaccgagcggtgagtcgggccgaggccgacgatgatcggccgcttttcctccggcagcaggtcaatggcggcgcgaaccgcgctgaactgggtggttttacccacaccggcatagccctgaaccgccgtgaagcggtcagtactctgcagaatgagctccgttgcggaacgctgaccggcggtgagtcccgtcagcacgtccggactgacatgctccatcagcggtgaccgggtattttacccgcgacgacgtggccaatgatggctttttccatttcccaggcggaccgcgcaacgtaccgcggttcgccaagcacctgaacagcaatcagctcaccggctttgacctgacacatgatttcctgccggatatcccccgtcgttaccccgaaagtcaatgcctcctcgatcagttttacgtcagaaaaggtgacgtgacgcatctgcgcgacggcgtgcgccacggatttttctgcgtccgtgaggagattttcattgagggttttcagtgccgcatcaggaacatcctgaccgctggcccgcctgaccagttccaggggagaacggagcgaactcaggcgggaaagcctgtcctccgcacgcgtctgcgcttcgccggtaaaaatttcagccttactgcctgactgcgacagcgcattgatcatgttggcggacaggtcccgggcgcccaggctggccagaaccgtaccctgttcgttatcgcgactccctggggcactgacgtaggcgtgtgtgacgtataacgggcggtcggcaggcacgcggatgggctttttctgcccttcacggttcatcaccagcgccccgtcctcgaatgccgtgaccgtcagacgatcgcgggccttcacgccagcggatttgtcagtggccaccgcaaaaagctgctctccctgcgccacgctcagctgttctcgcgtaaaaagccgccagtcggcggtcaggtcggccagcctgacggtctgcagaacgccgtcactgtcggccagtggcagcatccgggtgtcctcatgagcgcggtcgacggtatagtgacgcacatcctcacggtctgaacggtcttcaagcaccatgcccggccggtagatcaccggcatgcggcgggtctttgcggagacgtaaaccggcgtgcgggcctccaccgtcaacagttccggaccgagcttgcctacctcctgcagggcatcccggatcatgccgctcagctgctgctgctcgcgcggaccggtgacggcagcggtgaccggcatgtccgtgccgtgcagttcagcaaaacgctctgccatggcgctgtagcgctcccgcttgtcctgaatgctgatgacggtcgcctcaagcccggcgggcggcgcattcaggctgtgacgcgtcacgcctgccgacatcagcaccgaaagggcgctggtatttgactgacgtcctccgctgtcaagaaagagcagctgcgcacttttttcttttgcctccccggtaagcaccagcatttctttcaggctgagcttttccgccccctcgataaccagcgtactctgcggagccaggctgaacgtggaatccagcaggcgactgcgggatatcagcctgtcagccagctgccctgagcggccaaaactcacggcccgctcggatgagctgaccagcacgctgacgtcacggccctgtgcgcgtgacattgtcaccagctgttcagtggactcacgcagacgtgaaactgaggccggcgcattaatgaaggcaagcggtgaacgctcaaagactttcagtgctacagggccctctttttccggcaccctgaaccgcaccaccgtattttcactgagaatgtcttttgcgagcgcctgcacagacagttcatccagcaggtgtatctgtgatgtgagcgggcgattttcgcgaatggatgtttttggagcataacggcttgcaaaactgaccatagtgattacctctcagatacgttgttattacgccggggttgtcccggcatcgggcgtttgtcgctcagcgcggtgctgaggaatgcttaccggcgttttccagtgaccaggcgatcagttttcgggtctgcgcgtaattgattgccgtgtagcccaggtcgaattcataaagggcgtatggccagccctcccagacataaattttgcgtggctcaccgtcttctgacgggtcgtgatttctttaaacagcgccagctcctgccaggtcaccccgcccggcccgcaaaacgtgccgttgtcgatgatgaattcgctgagatcctgaaactgatccgctgtcagtccggtgttgacttttgtcccgtcaacccacgtttcggttgcggcggttttgaccttgacgttgtgtgtgttcatgctgcttctcctcttctggttgctgaaaccctgtttcggttggtacggcgcggcgaagggcaaagtggcaccggcaaagggaggacaaccaggggcgaagacaaaaagtttttgcgggggtatgcgaaaagtttttggctgagtgcatttcacccctgtttgtctgagctgacggtggtactgtcagccctccgcgcagaacaaccggaacaggacagccgcacggggatgaaatgagcatgaacacctgcggcacggcgtgacggccttaaagggcgcccgcgcccggtgaacgcaccggcgccagccggttgcagccgttgacctcagccatcagaccttagccgggaggcccgaaacgcggccctttacggttcggcggagacgggcggcagcttttccgccgcctgtcggagtggggctgacgactgcccgccagggcaggagccgaagggggccatgtcccggctgtggctgttgacgttaattcagtaaaggcagcaaccacatactggccagcacaagcggcaccggcatataaacaccagagtgataacggccatcagtgggaggctgtacagaccgcgacgggggaggcgcggtgcgtaagcaccgcctctgccctgccccgcatgggcgcgggggtgatgcggcggtgcaggcggggaacatccctgccgtgggtggcagggttacggcggcgttccggtcaggcgtcttatgcgtccttaccggtctgcgcgtcttctgagaattgggccaggccagggcgcagcatgacgcccgacacatcagtattttcccgcgccttgtgcaggtcgaaagcggcctgcatcgccagccagagacgcgcggcaatgcctaaccccgcctccagccgtaccgccatttcggggctgacggccgccttgccggacgccaccttgctcagcgccgccggagagacgcccaggcctttcgccattttacgcaggctcacgttattgtcttccaggtactccgtaatgaagccaccaggatgcgggggattgtgcatcgccatcagtgatagtcctccaggttgagaatgtaagcgttgccgtcggtaaactcgaaggtgatgcgccagttggcccgcaccgtaatggcatacaggtttttgcgatcacctttgagcggatggaaacgaaaaccgggatagcggctgaactcatccgtcgaaccggcctcatcaatggccagcaggcgcagccggatacgttcagcatcctttgcctgaacgccgctcgtgtcgcctttttcatagagcttctgtaaccctttgtgcttccagcttttgatcatgctccatccccttgtttcccgtcacgaaacattatatcaaagcgtttcgcacaaggaaacactttacccgcactttcccgccctgtgacgggcgactgtgaacggccgcccgcaccgggcggcccgactgcgacggctacgggccagtgtttaccggcccgtcagacagggagcgcataaaatccatcatcgccttaattctgcgctgcgttttcagacgttccccgaagtcactggcgtaatagaccggtgtgtaacgcacgcggctcaacttcaacgtcagcgtgttacctgtgatgacttcggcgggaacacccagcagcgaaagctgaataaacgccatatccgccgccaccggatcaatatcaatacaactggcaaacatctgctccgaggggttcagccctgcctcaagcatgcattcggccaccgcaaccaccatgccgcccgcgccgcaggtcggctctgacagcgtaaaaaa

SEQ ID NO: 17 - DNA, 181185 bp, Pantoea sp. OXWO6B1
cgtggaggaagccgtgaagcgtgagggcttttttacgctgtcagagccgacctgcggcgcgggcggcatggtggttgcggtggccgaatgcatgcttgaggcagggctgaacccctcggagcagatgtttgccagttgtattgatattgatccggtggcggcggatatggcgtttattcagctttcgctgctgggtgttcccgccgaagtcatcacaggtaacacgctgacgttgaagttgagccgcgtgcgttacacaccggtctattacgccagtgacttcggggaacgtctgaaaacgcagcgcagaattaaggcgatgatggattttatgcgctccctgtctgacgggccggtaaacactggcccgtagccgtcgcagtcgggccgcccggtgcgggcggccgttcacagtcgcccgtcacagggcgggaaagtgcgggtaaagtgtttccttgggcgaaacgctttgaattaatgtttcgggacgggaaacaaggggatggagcttgatcaaaagctggaagcccaaagggttacagaagctctatgaaaaaggcgacacgagcggcgttcaggcaaaggatgctgaacgtatccggctgcgcctgctggccattgatgaggccggttcgacggatgagttcagccgctatcccggttttcgtttccatccgctcaaaggtgatcgcaaaaacctgtatgccattacggtgcgggccaactggcgcatcaccttcgagtttaccgacggcaacgcttacattctcaacctggaggactatcactgatggcgatgcacaatcccccgcatcctggtggcttcattacggagtacctggaagacaataacgtgagcctgcgtaaaatggcgaaagacctgggcgtctctccggcggcgctgagcaaggtggcgtccggcaaggcggccgtcagccccgaaatggcggtacggctggaggcggggttaggcattgccgcgcgtctctggctcgcgatgcaggccgctttcgacctgcacaaggcgcgggaaaatactgatgtgtcgggcgtcatgctgcgccctggcctggcccccttcccagaagacgcgcaggccggaaaggacgcataagacgcctgaccggaacgccgccgtaaccctgtcgcccacggcagggacgttccccgcctgcaacgccgcatcacccccgcgcccctccggggcagggcagaagcggtgctgacgcaccgcgcatcccccgccgcgttctgttcatactcctgccggtatccgttattccccatctgtctttatgccggtgccggttctgctggccagtgtgggtatgctgcctttactgacttaacagcaacagcaacagcaacagccgggacatggcccccttcggctcctgccctggcgggcagtcgtcagccctactccgacaggcggcggaaaagcagccgcccgtctccgccgaaccgcaaagggccgcgtttcgggcctcccggctaaggtctgatggctgaggtcaagggctgcaaccggctggcgccggtgcgttcaccgggcgcggccgcgccctgtaaggccgtcacgccgttccgtcgtgccgcaggtgttcatgctcatgttatcccgtgcggctgttctgttccggtggcccatcgcggagggctgacagtcgcacagtccttctccctcccacacaggtccgcttcgccgttcctcacccgttcgcactcgccgaaaaactggctcgcttgcgctgcggcttccgggacgcctgtgttccggtcgccggccggtgccactttgcccttcgccgcgatgaactcaccgaaacatggataacagcaaccgaccgaggagaaccagcatgaacacacacaacgtcaggaccgccgcttctgaatctaccgaaacatgggtgaaacaaaaattcgacgtgcttctgctcctgcgtgcagaccgtctgctcaccctggcgcaactggaaggtaatctgatgacgtaccgcgcgctggatgcggttggtccggatcacctggaagacctgtctgctgatgtccggtacgcggcacaacgcatcacgaccatgcttgatgaaggcgatatcgccaccccgtctgcgtatgagctggcgacgtccgtccggtccctcgccattgaaatagtgccagcagagtgggcctgggtggacgggcctgatctgccatccctggaataccttcaggaaaatgccccgcttcagcgcgaagcgttgcggcagtcgtttatcgaggcggcgcgtccgtttggccttaccgtcagcggtcgcatggagtttcccgacgacgatatctgtcccggcacgtactggtgtgacgcagaagtctccctgggccgtgcggactctctcccggaggcgatggagctgctggtaaaggcaagcctgagcggggactggaagcaggacgaacacggtgggtacggttttgcaccgcacatcgccactgttaccgacattgcacgccgcgtggtgctgcgcggtaatgccgccacgctggagtgggcggtgccggaagccgatccggctgcattcgaacgcattgcggaacagaaacaggcgctgctgaagcaggccgcttacgagtccggctgggataacttcgggacggcgcgccagctacgccagaaggccgacctgctcgacctgaccagcgttcatgccgtctgggtgaaccatccgcacgtggcggaagcgctgcgggaatatcagcatccgtccacgcgcctggacgaaaccgaaatcatggagggcatggaattttaggcgcaaaaaaagcagggtttcccctgctttcttcacggcgggtagctgtaactacccgccacatcaaaatccgagtcgaggtaacgaacatgaattttgacccgcaaatcgtcgcacaggcggcgctgtttgtaaacgcactgcgcaacggtcagtccgcacacgtaccggccatgccgttcagactgtggcccgtttttatccgctgcgtcaggctgatgatgagggccagcgcatgagccagcagaatcaggcagtaaacgccgacctgccacccgtgacgcaggaagacatcacgcgcgttctggggccgtactgttttatccgtctcgataacggagatgaggcgtttttcattaacggtcacttcattggcagtgctgaaggtgcgcagaacgatccgcccgtttacgacattgcatgcctggcggcacgggcagcatggcagtcgctgcgttgctttgaactccccgtaccggcaatgccggactggtgctggggcgatattctggagcagctggcccgcaaagcgccaacgggcgaggtgagcggtacggtcatcgtgacatgcagcgaggtaaagggcaggggtgtgcatttctgtaatcacccacagctgagtggccacaatgaaaacctgtggtttcccgtaggtgaaaaggagagctggtttatcgctgttgaacgcattctggtcatgaacggcctggctgacaagttactggagctgaatccgcttcgtgatggagatttcagtgatttcagggcgacttacagccgcacaatcatcctctgacaagcgcgggccggaggcatccggccccgctgtcgtgaacgtaacaggagtctaccatgctgaataatacccgaccggacgggatggcgtcccccgatgctatgcgccaggaatcactgaaaatagccgacctcgatgacctggccgattacgggctgcatccggttccgtgggacgaacccgacgcgacctgttgtgctgctgcggcagtcgtcaccttcgcccgttgcacagggctggacagtaaaaatgacctagcagaaacggcgataaccgatctgctggcagacctcatgcacctgtgcagcgcaaaggatttgccgttctgcgagctgcttatccgcgcaggttcgcattttcgggatgaagccgcaggctgatcccgtgccgtgcagggcgcaaaccctgcaggccctccgggccgggcaacacccggtgctgacgcaccggctccctcccgccgcgtgctgtgactttgcggggcagcgtgaccaccctgatacgtaatgtgaccattctggccagtattcatgccagaacggttatggacgggcgggtttatggccagcttcctctgtctgatgaaccattttggcatttttaaaagccactgccggagcatggcccccttcggctcctgccctggcgggcagtcgtcagcctcactccgctaaggcggcagagccgcccagctccgccgaacccgcaggcgggttcgtgtagagtctgatggctgaggtcaaggtcaacggctgcaaccggctttgccggtgcgttcaccgggcgcggccgcgccctgtaaggccgtcacaccgttccgccgtgccggaggtgttcatgctcatgttatcccgtgcggctgttctgttccggtggtccaccgcggagggctgacagtcgcacagtccttctccctcccacacaggtccgcttacgccgttcctcacccgttcgcactcgccataaacccggctcgcttgcgctgcggcttccgggacgcctgtgttccggtcgccggccggtgccactttgcccttcgccgcgatgaactcaccgaaacatggttaacagcaaccgagcgaggagaacaagcatgaacacccacaacgtcaacgtcaaaaccgccgcttctgaatctaccgaaacacgggttgaagggacaaaagtcaacaccggactgacggtagcgcagtttcaggatctcagccatttcatcatcgacaacggcaccttctgcgggccgggcggggtgacctggcaggaactggcgctgtttgacgaaatcaccgacccgtccgaagacggtgagccacgcaaaatttatgtctgggagggctggccatacgccctttatgaattcgacctgggctacacggcgatcaattacgcgcagacccgaaaaatgatcgcctggtccctggagaacgcggggaataaatcagcgccgcgctgagaatgcgatatctgatgccgggtgaaaccccggctgtaaatctcaaaataaattaactcacgcagagaggttattattatggtcagttttgcaagccgttatgcacagaaaacatccatccgcgaaaatcgcccgctcaccaatgatgagctgatgcgatacgtcccgagcgccttttccgttgaaaagcatgagtcgcgctcagaccgctatacctatattccgacaattacgctgctcgacaaactccgctccgaagggttcgaacctttctatgcaaaacagtcccgcgtgcgcgaccagaaccgccgggattttaccaaacacatgatccgcctgcgtcgcggaaataacggcagcggcaaagaggtgcctgaaattgttctgctgaacagtcatgacggctccagcagttataaaatgatccccggtatttttcgcgaagtctgcacaaacgggctggtctgctggaaatcatttggcgaaatcagcgtgccgcacaaaggcgatattgtcagccaggtaattgaaggcgcgtattccgttctggatgtgtttgaaaaagtagaaaataacatcggcatgatgaaaggtattcagctggatatggcggaaaggctgctgctgggccagctggcgctggagtacaaatatgaagacaaggcaccgccggtgaccgccgaaaatattattcacccccgccgctggcatgacaaaggcaccgacctgtggacggcctttaatatcgtgcaggagaatcttgtaaaaggtggcctgtcggggcgaactgaaaaagggaagcgtaccaccacgcgcccagttaacggcatcgacggcgacataaaattaaatcaggcgctgtggaagatggcagaggaattcgcgaagctgaaaagctgaaaaaaataaaccccggttcgccggggtttattttttggcggtgccagtatcatttctgctgagcgttaaggggggcgatgtttcaggtggcccgctcttattcattttcgcatacacttcatcccttgccacaagaacgcggtagatgctttttattatcgcggcatattccctgcgctgtttgatcagtttcggattcgggccggtgttatacatgccgaccgtgtcccacgtcctgccatactgcttaaaattcagcgcctctatccacgcgccggtataaatgcagatgcacggatcggccagtagtctttcgcgcgtaatgttaaatttttttaattttggaaagttggcgctgttaatctgcatattgcagacgtccgtgcttttatgcgcgctcctgtcattaatcgcattatttcgcatgcgtgattcctgaatggaatgcgccatgagcaggcgcggatcgattccgaaatcatgtccggcttttgtgaaacacatttcaggctcagcctgaacgctgaacgcggtaaaaaaggcggcggcggttaaccacttcatatttaataagtctcatatgcgcgcgcagaatgcgctgtgatttacccttcaaaaaataccctttcagatcatcccgtgcaagataattcgttacagacgcgcactgtgcgcttgcggatggggttcgaacctggtgcggggttaattcaaatggaggataaggcgattatttcacaagccgcttttacagttttactatcatcacaccccacgcaagattaaatcttgctgttttgttttttaaaaacatggagttatggttttaaattaatgtttttttgaaggtatatccaaaaaggtgtgctaaacaacacacaaagtagtgcctgatagtgtgttaatgcagtgctgaatagtgtgtttaattagtgccgttttgtgtgctgaacaggcactgcaacaggcactgtatggtgtgttaatagtggttaatctttaaattcattagcttagaataaatttcataatacttagtgcctgattaacacacataaaactggcagtgtagtgccgaatcaacacacatcaaaaaccatgaatttagtagttttcaagcccgtcttgtcagttatatacttaaagcaagccgtgaggtgcctgattgacacacacgcctgatgaccttaaaaactattacacagtgccggattgacacacacataaagaaactggatgataatttttaatcatactgcatgatagctgtgaaattaacataaatctatttttagaattttaatttttacacactgaattttacggggaaattatggccagaaggaatgtgtatttcagagaaaaaattttgagagaagtcgacgagcttgtgcagattgaaatccagaatggtgccactcacggtgaagttaatttctcctccgaagtgggtaagcttgttgagataggcctcaggattaaaaaactacaaaaggatggcgacagattcgaccaggaaggctttaaccgtgaactcatacgtaaggtgagcggaagccgtgaaggcatcagcattctgatagctatgatctctgaaatgtacctcaatatgcgtggggataatactgaagaaaggatagttgagatgctggatgaaaatctcaaagctatgaacaaagcggaggttgaggcggaaggacggtattatctgcaggaagacaaataaatcaggggccggtcgcccctggatttaagaatttatcgggatgaatactgtaaaaactgaacctttgcctggttgtgacctgacttttatttttccgttcagtaattttacatggtttttaacaattgcaaggcctaggccaatgccctgccttgtttctgcctttatcccctgattgaatggtcgaaaaaggaaagggagtttattgatatcaaatccggagccattatcactgacccttatcaccagataacggtgcgaccttttcacataaaccctgatggttccctggagagtgttcttattggcattatccagaaaattatggatgattgacgtcagttttcccatgtcagaaaaaatcatgccttcatggggatgtattcgtgttaccagacggttaccgtgctgttcattaaataatgatacagctgctaccataagtgattttagtgtaaatgacgattttttaagagccgtatttccgatttcaattttagaatattccataatttcccgggtctgatggaaaagcttatttgtatggaatatgattttgctgagatatttctgcgtgttgaatacatcgtcacgcgggttaatcatgtctgctgacatctgaattttgtggattgaacctgaaaattcatgatagatggttgagatgaacatattttttttctttatcacttctttgagtgtgaggacgtagtaacacacaaaagcgacgaagaaaaaaataaaaacaggacgcagagcgcatacagctctgctaaacctgtgttgtctgttatgagaaacttcatgccgtggaagttattaatctgaatcctgtaaattacctcctgaatatctttcatggttggcgtcatgacttccatctgatgcagtaatgcattctggcgaactttgcccggcggcattgatgaatagatttctcccagttttttgctctgcgcctcaagcgtttttacgtctgcagaaaagtgtttgctgaaataaaatgaattgctgtctcttgatttaaaattgagaacatttactttcgcgtcaaaaatttccttctgcagcgggaatgcgtcgggttcatccgtttcatatgccgccgtccgcatcctttcaaaacttaaaaagagcacctcgcctgttgagtaattatccagattcgggtcgagctggttgtattgatgcctgatggcattgaagtgtgaaaccgtaagatacatgctcacggccatgagtgaagtcagtaacagacatatcagagtaaactgtttccctttcactggaccgcctttacttcagaaatcatccataccgttttggcattgatgtctgcttttgagagttccggatgctcatcgcgtggaaagatgaccacgtagggacccatatccgaaacaggcaggtttttaccgtttttttggtaggccagtatggcatggtatttcagcaactcattcacgggcacggtgtagctgtactcatccagcgcaaaaaaacgcagtgcttttgctttaacgccgtacttatcaaggaaatcctgaaacggaacgccggtgaatgtggccttcggggtaaagttggttcctgtggtgatgctggccactggcatcttttccaggtcagcggtcgacacagttttaaccgtgttaccgtcaaccagcctgaagctgtctgcgagggccaccggactcagcatgacacttaataccagtgcaaggattttactcgtcatctctgcgattccttttcatgaccagctgaccgaactcatccagaccttccggctgccagccgttctttctgtaaaactcaacagcgcgggaatcactgtcggtggtcagttcaatctggtctgtgcctttatcgaaaaaccattgtgtcacgcgttttatgagttccgtgccgatatgcctgccctggtattcaggcctgacaaacaggccgcctatcagggcgtgggtaatgtaattgatctggtcatcacatgggatgtaaatgccaaatccatagccagcatattcctctccgacgcggcatatccatccccctccctgagcgatatcatccagcgcctgctggcgctgaagatactggatctgatgggcgtgaaccagattctccgtaacggaaaaccggatgtcataaacttctttaagatgttcggcgctgagcttcagatattccattcaggacctccttaatcactaactatcaagaaaaataaaggatgcagtgttttttgtcagttgtttaataacttcaggatcagtgaaacttgataattctgcggggggcttaagcgtgaccacatatcgttacacagatgagtaaatcctgtaatccctgcttaaagccgcgctgtttatgttctcctgattatcagacacaacccgcggctatggcgttacttaacagacctgattatcttcacgtctgaatgttgtatccggtaatcagtaaaagagatgagaaatcaggattgatgaaatgatggtcactcgtgacggcttttcaaggatttctacaccctgtttagcgatgatttcacctatttcattttcatgctgatccagttgagccgttaaaatgattatgggaactgaagcattgttagcgcgaatagttttaatgatttcgcctgcgttttcttcgtaatccagaagccagtccacaatataagcatcataaaagtgccgcttaacatgctcaagcattttgagtttatccctgaagagcgttgcctcaatcccaaaccggtttgataccgatttcatcagatccaggatttcagggtcgttgtcgagaatggctatacgtggagcaggcagcacttccaggtttacgacttttttaagcgatctgtgtatccggttagacgtaggattgactatccagtactcgccatctttatatgcatagtttgcgccagcctctacttgctcagcatcttcactttctacttcaatgttacatcgcatatgcaaatcattgacgatgaaaatgccgttgtactgagggcgtttattgtaggtctcacggaaatattcgtgtatttttagtacttcttcgaaccggatacctctcttgccatccagcttctgtttcgcacttttgtactggatacccagtatcttagccattgtggtggcctgcttccttttctcaatgccttttctttcaaacaactccagtactttctcaagatttttgttgttatcttccacggccatttcccagtcattgtgttcaggctgacagtactttatgcctgcacttgaaaatttgtctttatttgagaaatgatacacgaatgaggaggatttgaggatggtgaaaactctgcaagtcattaaattatatagattttaatatgtcttcataaaaagttaacattaaatcctcaaaaacaactcatcaaggggcttcaaaaaatgtgctgacttaaagtatagttttgtaaacgccacgcaaggcagcaatgacagctcatcgcctaggccggaaaatgctgacttgcacaaaagtcgtaatgctgcgccagcttgttcaggcattacacttaaaaaaacacccactaatgagtatcttttgagtgctttaattggtcgggttttagtactgagattttggtatgtgcttaccgcctgcagacgacatgcatgtagagtctgaatgctcgcagttaaagcggtaactaacgtaattattgccttataaaaatatttaagccaacaccagggcttattgacagaacgacagttcatttttttatacacacagcaggaggtccatcacccggaatctatttctggctttacccgttatatatctgaaaaccgcatatgtaattcagttgcatatgttcttttcgatcgtctcatacaggattaaataaatgcacgctgataaattcgtttccggggaaccggttgacgtggcggtagcattgcctgaacgcccccgagtgcggccaggtaatttcattcagtacaccgcctcccgtcttaaaaacctccgcatcacccgtttcagaccctttaataaaaacaacccccccgcactgcagaacgcgatgcttttcgcgctgatgcttgcggtcgtcattgtcccgcacgtggccagcgccaccgacctgatggcttcgcagaccggtgatgccaccgatacgttcggcctgaacagtaccgttctgcgctggatttatatgggtgaaatcgtgatgtccctcgtgggcttcatcaaaacccgcaacccgctcatcttcgtcggcctggtcatcatgctggtcatctcccgcgccttatacggaatgatcgggacctgaccgatggacgagcgggaatcagccaaataccgcttccccgaaaccctcaaccggcagaaacgctggctgggccttccccccgaggaagcgtgcgtgctgctcacgttcgggttaatcgggttcttctgcaacaactttgtcaccatgctctgcatcagtgcctttttctggatgggtatccgtcacctcaagaaagggcaggggtcctggtggctcctgaatctcctttactggtatctgcccaccctgttcttcagggtgcggcttctacgtatccccgattcctgtaaccgtcactggatgcagtaaatctcatgccgcccttcccgggcggccttttccccgcaagcgggaggaataatgaagctcgaggttaaagaatcacgcgaccgcctgctggccctgcttctgctcacgctcagcggtctgctgattgtcagcgttctggccaactgcataaccggttcgctggcctggtactgttactggcatcagcggaccataaccacgccgatggtctatgaccgtcccttttcatcgaccatggacggcggggacgacaacctgtacagcatgctggcccgatcgctcatcagccttcgcctgagcgttacccctgaaaccgtggacagacagcatgcgcggctgctgagctgggtgccgccggaggagcgttctgcgctgaagaaagcgctggtcgttgaggcaagctacataaagaaaaacggcatctccagcgtttacagtattgaacatgaagccaccgatcctaaaacgggcgacatcatcgtgggcggcacgatacatgccagcaccatgaacggcaccgtggcgctgaaccagcccggcgctgtccggactgccaccgctaacggcgtctcaagaaccgacctgcctgacgagaaaaaagcataccgcctgcacattcagtacgacaacgggctcatccgcctgacggcgttccctgaagtggcctggcctgccattttcaacaacgatgattccgggacaaaaccatgaaaatctccctgactgccgcactggttgccggtgcctgcctgtcgccctgcgccatcgccgccatcaccggaccagcgggcacggtttttgataacaatgcgcatctgcgctcaaagatgagcctcacaagccccaacaaaatcatcatcgacggcgagctcatcaccggcgtgtcgggtccggacggcgcgtttacgcagcaaaatacggccgacggcgcgctgctgattacgccgctcacgccgcacgacttcaccatctttctggagaccgccgacggtatcagcctttcgctcgacgtggtgccggagaagggtaacgggcgcacgctgctgctcataccggcccgcacgcgtctgaaaccgaatccggacgcgaaggcctgggaggaaagccagcctttccagaaaaccctggtggcgctggcgcgcaccgtggtgaacggcggcgtaccggacaactacaccgagatttccgcctcgcaggggccggactacaccccggctgcgggcgtgctgctcacgccggagcgccagttggcgggggcgcatttcaggattatgcgctaccggatgaaaaacaccggctatgtcacccggcccctgacggagaaacagttctggcagaagggagtgcgcgccgtaatgctttccacccgcacgctttatgcgggcggagagggttacgtctgggtgattttttccaccgatgaggggggtgcatcgtgagcaacatcaataccgtcacccgccgtcgtcagtggctgatagccggcggcgcactggccgccatgaccgttaccggcggcggtatctggttttacaaccagcatcaggcggcgctgaagcatcaggcggcgcacaagcctgccgacctgaccggtacaggccttgtcaccccgagctttaccgacgcggtgacgaactccgtactgacgcagcagcagaacaaaacggccgggcttgagcagggactgaaggacctcaacaccaaagtcgacggccaggcggcctcgcttgaccgcaagctggagcagatcacggcggcgctggacaaacttcagtcacagggcagtcattcttctgcgccggctggcgcaaccggcacgcagtctggtcccggttcatcgcagagcgggccggttccgctgggacctgccgggccggcgcagtggcgtatcaccgatccggccggcggtcctgccagcagtcagggcagccgtttttatcccggtcaggctcagggcacgcagcccgcagctgccgcgtcgcagacaggcgggctgatgcgcaaaaccttcacctacgcctcactgagccgcaagtggccgcatctgccctggatttcatccggttcgttttcacaggccgtgatgatcgagggagccgacgccaacgccagcgtaacgggccagcagaacaccacgccggtggtccttactctcataggcgacgtgtctatgcccaacggcaaaacctacaacatggaccagtgtcgcgttaccggtgaaatctacggggatatctccagcgagcgcggtgaggtccgcacgaaaaatatcagctgcaacctgaaaaacggggaccacatcgatatgccgtttgaagggcacgtggcttaccagggcaagcagggcatccgcggcaagccggtgatgcgtaacggacagatactgatgaacgctggcggcgcaggcttcctgtcgggcctcggagacggcttcaagtcggcggccacgcccatggtgggcctgggcggggcgaccacgatcggtgccggcgacatcctgaaacagggctttggcggcggtgccagcaaggcggccgacacgctgagccagtattacatcaagcgcgccgagcagtatcaccctgtcattgatatcggtgccggtaacgccgtcacggtggtgtttcagcagggctttcgcctgaagaccatcgaggagcaggaggccgataaagacaaacagaacgcctcacaggttcaggtacaggaaacggcggccaacacgcctgccgttaacgctaacggcagccgcccggcggtgctcgaccccaatgaagtactgaagcaggccagccagctccggctgggtgacaccatcaactgacaggaacacgccgatgaaacagtggtacgtactgcagacgctttttggtcaggaaaaacgcgcggaagcgcatctggaaaaccagaacgtggagtgctggtttcccctttacaccggccgtcggctggcggacgggaaggtcacttccctgaagcccacgccgctgtttcccggctatggctttgcctgcttcgatccggaaaaaattcacaccacgaccatcaaggccacgcgcggcgtctcgcagattgtgcgctttggggagcgcctggcggtcatgagcgatgctcaaatgaaggcgctgaaggccggggcggggcaggtggcacagacctgcgaaaagccgccggtgcacggtgacacgcttattctcgaaagcggcgtgtttgaagggtttgaggcggtatggcatgagccgaaaggcgcaaagcgggccattatgctgattaccctgatgggcaagattgtcgaactggatatgagaaaagtgcgcaatgaaggtatccggttccggtttaaaaacagcggggaggtgagagtgtgaaccgtaaagcgaaaactctgattaatccatgccggccgtacctgtacccggcctgtgttcctcggacagcctgtgtggttaatcaggcctgttcagcatgagtaaaacggatatgaacaattcgaatgcaagccttatggtttttctgcctatctttcttgtgcttaccctgaatctggttgctgtatacatcatgcttagtatgggggtgggaccgtccgggggaataacgtggcaggtgtggcggatgctgaccctgcttgctgcggccacgctgggcttacaggtgctttctttgggcagcgggttgagcatggcgccggttttctcaggtctcgtcacctggctcatcgtgcctgcgggctggctcgttgaggttgcccgtgccggtcagcttcaggtggccagcaaagcattcctttacatgggcccctgcacaggcgttgtgctttcgttcggcgcggccgtatttgtgcttctgttcgaaaaaagacgccggtaaacgggacggggcagcaatgaaaagattcagtttcaggatgtatgtgccactgctggttaccggcatcgtcatgggcgcagacgtggtgttgtctgcgtactttttcaggatacctgaccatctcttaatcagtagtgcgttactgggtatgacactgccgctggtttttaaggtcatgaaactgacctggcgcataagcaggcacgatttttacagccacatgatggtcatcccgttctttccctggctgtggctggccggaataaagctggcagaactcatcaccaccggaatgtcctccgtccgtttacccgcatccggcctggtcggtgccacagcgatggtgagcatcgccttcaccctgttccaggtctggcgttttcacgcaacggttgtaaaaagtcctgtttgggctggcaggccagagccccgtggagtggaaaagaatgaaactgaagaaaggtaaatgcctggttctgctgtcagtgatgctgctgtgcgcctgtgacagtgaggagtcccgttttgatgccgcccggacccgcgccctgcagaatcctgatccgtggcaggcctatgtgcaactgagcgctgatgctgaaagagactgcccctccggactgcttgagtcagcctgctccggtaagaccctggctgactatcgcggacttgcgcagacgctttatcgcaaagccctcagccgttcctcaccgggtgcttttgcagacctgtttttgcggtccgtgccgcccgggaggctggagccacagatgcccgaactggcaaaaaaactgattgtcatggccggagagtcgcccggagaccgggcgtctgcggcgctgcttctggccgccggtgacgtcctgcagaaaggagaatgggtgcagaaggacagcgtgcaggccgccgcgttttacgcgcgggcatggcttgccggaagtgcaaaagcggcctccagactcagccacctttacagtcttcagcatgacgacgccagtgcactgttatggcagaaccgctgcaccggtgagtgttacccgggacaggagctggttgatgtgccggactcgtggagtcccaggaagattctgcgtattcaggcgctcgcaaaagaccgcagcatcgtcacggtgaacggacaggccgactgggaggataaatgaaacctcttcttaaaggcgcgattttagcgctgtgcctcatgcaggtgccgccggtcatgtcggccagtttcgcttcccgatcatcctttaggtcatctgcgggctttgccgcccgaagcccggcttaccggccatcatcatcgggcagcgcccctgtttaccggagcttcaggccggaaacaggcagcagaacagcgggaggcgccagcggctcagcctcgggcagggttaacagtgcgtcatcagcattccggccgacgcccgcagccccgcggtcgctgctcagcggcagcggcacctggccctctgccagactccagaccattatcagggagaaggaggccagcgggcccggctgggttggaacggccgcactggtgtggttgctgagccggcatgatctgtcatcaggcgatcgggcatggattaacgagcggctgcgtgaagcgaacaataacgccgtcagtgaaccggacgcgcctgtcgctgagcagtccgacgtgcgctttcagtgggctgttccggcacttattgtgagtggtcagccggtgaaaatcgtcgtgacggcggttcgtcacgggaaagcgcttgttcccgcctgcgagctcggcgacatgaaaagcgagcaggaaaacaacgcggccgttctgaactggacgccagaaaacacgttttctgccgtggcgacctgcagggcagagggctgggtggaccagcgtcttctggcggtttctcagaccagtggggggaaactatgaatcagtcccggagagacggtacttttcaggcgcgctggaaacagttttcgcgtatccggcttatgaatcacctgtggatgaaaagacatcctgtacacattgaaacctggtgtgtctggtctgtcacagccgcgcttacgcttatctgtatggctgacattttttcgtctcagctgcgtcccttactgctgacggcagatgtggcagggctgatactgtcattcgggctctggctgcggtggcggagaaaaccacagagctggtgcggcctgatagccgcagagctggcttcatatccgcctgccgatcatgacgcctttacccggttgcagcaaaacgtacggcaggaaggtcaccttgatcaggatgcgctggacaggtggataagaagggagctgcgcgccctgacgcggcaggactttggttttacttcccgcaacacaattcaggagacggaggctcagcaccatgactttgcgcaacgtccgtgaaaaccgtatccgactctgctctctgcgcgtccggtatcgtcaggcgtggcggtcacaggctgacagtaacacgctggctgcgctgctgagggccattgagtcagttcatcagtcactgaaatcccccgaatgcggtgagaaaacccttaactcagatgccagtggcagtaataacggagggcaggctgatgcttaacggccccggaatactgacgcctgaccagaaaaggttctggcacatctttgcagaactgcaacgctggagaaataacgatccgccgccacagggggcaggtccggagtggtgcctcatcctttccttagccgggatcgtcacgggagggctgattctgatggccacgcccggcctgttactgaccggagctgcagcctttaccggctctttgcttgtctggacctacgcctgcaggcgggtccggaaccgtcccacactgcgctggccggagcgcctggacagactgctcagccagtaccggcccgttgattctgaggcctgggcggagctgaaggcagacgtggtctcgaaggatgcgctgacgctcgcggccttacagcgctggatggcaaaggagcgcgtgtactattcgtacccgaaagcgagaaatccggcccggtggcggttcctgcagaatcatgcagacaagcagctgtcagggcatgccggggaggctgagcgttaaggcgattaaatatgtgccgggcaggacggtaactttcttctgttcgccagggaggctttagcctcaccttaaatcccccccggtaaagccagctgacagttaaacattaaggttaataaaatgttgtttcatcacataaatgactggttatgtaccggcctcaatggctgcgtcaatatccggcacagactgccgccactgggcggcatagtcgaatgtgtcatcattattagcatcatgggatggctgctcagcaaaatctacggctggcgtccggttatattcagcgtggtatttgccgtactgataaacctttttatgtatgttcggctcagtgccggtcacttgccgcagggagatgcagccatgtttgcgctgttcagcggattcagtttaatcatctgcttagcctttgaagcgctactgataagagattatccccgtttacgttatggcctgcgattaatgatggccctgttgtccggatgtatgaccctggctatctggttgcaggccggcgttcgggcatgaacctttttatttatgaataaaactgacattttcatttaatgctccttatctgcaggcagcaacccgtttaatccgacaggcctttcttaccgccacttttttattcaaaccttatccgcggcgctgccgcaccagaggacttcaccatgcaaaaactgtttgcgtgcgcactgctgtgcgcggcgcttaccggctgcgccggcatgaacaccgactttgactgcaacaaaacggcaacggaccagtgcctgtccatgagcgaggccagtcatctggccgcgcagcacaaaagcctggatgacctgagcggggaaaatgctgccggcccaaagcctgccgctgagccgctggccgtaccggtgaacgtcaaaagcaccgtcagcccggaccgccatatcagcgtggcaggcacagcgccccgttcgggacgcgggacagcggcaggccagagcatgacgtcaccgctgcctgcctacaggcctgtcagcgcgcccacggcggaggctgacaatggccccggcgaagtggacgcacgccgcacgccggatgtgacgcagcggctgtggatcgcgccctgggtggatgaccaggacagctttcaccagcccgccgtcgtggagtttgtgaaaaaccggtcccgctgggaccaggactaccgcgtgatcagcgggggccagtgatgaaaatttttaacagagacattctttcgggtgcgtgttttcaatcgtcatgtaccgggcatggccggggccgggcggtctggctgacccgccatgcgcccgcaggtatggcgtcggcaagggcgatgttgcatcaggcctgtcgggaaaatctgtatgacattcatttgtctgacccgctctcaaacgcttacgtgacaggccatgccggaaagggctgcctgtgcgatgaaagcgtgctgacgacaaaaggggtaaaggaggagagacagcatggcgaataaatggctcgatcagctcgcgggaatactggaaagcggccgccaggtgagcggtgcaaaagaggcgtcggcggcgctgcagcagaatttcagctatccctcgctcagcagtctgctgccctggcgcatgtacgacgggcagagcgacctctacatcaacggccggtccgtcgggtttatgctggagctctcaccgcttatcggcgccaaccagcaggtggtgcagggcctcgacgcattgctgcgcgaaaagctgccccgcaaaatgccactgaccgtgatgatggtggccagcaagtgcgtgggcgggatgctccagcaggcgctcagcgccgacatgtggaaggggccgatggcaccgcgcctgaacgccattacgcgggcctactgggagcgggccgcgctcaagggcttcaccaaccagcgtgagtatccgctgtacctgcgcaactaccgcgtcttcctggtctacgcccagtccggccggggcggcatcagcggcatggatgaggtcagccgggtgcgtgacagtgtgaccatggccctgaaagggtcttacatggactgccgacgggtccagcccggcgagtttctgtcggtaatgcgcgagcagctgaactaccgcccgggccaggtcacggccagcgacggctactggaacccggaccaggagcttcaccgccaggcggtgcaccccagcaccgagctggaggtgtatcccggctatctgcgcatgctcaccgcgcgccagcccgaagaccgccgcctcgacgaggatgacgattcgctggtgtcagccacgcgcatcgtcagcatgcagctgagcgaagcgccgaagcagttcgcactgtggcagggtgcagacaacctgcagaacatgcgctttcccgagctgggcattccctgtccgtttatcctgagctggacggtggcggtggaggaccagatgcagagccagaatgaggccttccgcaaagagcaggatctggccaagaaggtggccagcacctatgcgcgcctgtttcctgacgttgagcgatcctatcgcgagtggaaggaactccggcagggcctcagcaccaacgaaatttccatgtgtgacatcaatttcaacctgacgctcttcacgccggacagcgacaaggaacagcagttctgcgaggtcaaggccggaaacgtgttcagcaaaaacggcctgcagatttcttcgcccaagatgatgcagctgcgcaactggctcaccacactgccgtttgtggtgcaggaggggctgtgggatgacatgcagcgcatgggggccacgctgcgctgcaagacgttcaacgccgccaacctgatgccggtagtggcggagcggcagatgtccaagaaaggcagtccgctgccgacctaccgcaaccagctgacgttttttgacatgttcgaaaagagaaacggcacgaccaactcgaatattgcggtgaccggcaccaccggggcaggaaaatccttcttcattcaggaactgctgcgccaggtgctcaactccggcggatacggctgggttatcgacatgggggagagctacaaaaacttctgccaccaggcgggcggcgtatatctcgacggcgcgtcgctgcgctttaacccgtttgccaacatcaccgacgtcaacgacatgaaaaggatggccgagcgtgtcaaaggtctgctggccgtgctggccaatccagcaggcgagctggaccagatcagcgagtcggtgctgctcaaggcggtcaacgccgcctgggaggccaaacagaacaaggcacgtattgacgacgtggtctactacctgaagtcggatgtggtgcagcaggagtacgggcagcagccgaccatcatgagccgcattcacgagctggtgctgttgctcgaccagtggtgcacctggggaacgaacggagaatacttcaattccgacaacccgaccctgaacagcgagacacgttttgcggtgctggagatgctgagcctggaaagccagccgcacctgctgtccgccatcctgtactcactgatcctggcgattcaggacaagatgtatcactcgtcgcgcaagatcaaaaaactggcggttatcgacgaggcctggcgcctgttcagcggccacaacccccacgcggcgcgctttatcgaaacggggtaccgcacggtgcgccgccacatgggcgctttcatcaccatcacgcaggggatcagcgacttcaccggcctgccggagcagcctgccccgtcggcagcggcggcggcctggacctgttcgggcaccaaggtgacgctgctgcaggataacaaggcgctgacgacctacctgaacgccaacccggaccagttcagcgaaatggaaacgcagatcatccggggctttgaggcggccggcgataccggcttcagttcggtcatgatgtcaaccggcaagaacacctcgtttcaccgcgtgttcaccgatccggtcacccgggccatgttcagttcagaacccagtgagttccagtacatggcggatgcgcagaaggcgggggccagcagtgaagaagcggcctacatgctggcctctgagccgttcaagttcggcgaggaactgtcaacgctggagctgtgggcgggactgaggaagccggaaagccagaaggaaaaacattatgcatgatgacagacagcctgtgagcgaaacggcaccgacaactgctgcccgtgagggctcaggacgcctgaagacctggattcgggtgtgctgcgcagtgctgctgccggtggcctgtgccggtatcagcgtactggcctcccggctcgcgcagcccgacaccgtggtctttgacatgcggggaacggttaacgcgttcaagcagcagtccgcgcaggtgacgctgacgcctgagcgagccgcctcgctgacgacgcgcttcaataatgccctgcgaagcagcctgactgactggcagcaggcacacaacgcggtgattctggagaagggggccgtggtgagtgaggcacaggacatcacgccggtgatccaggccgatatcgcccggcagatgcacgcggcgcagccggccggtggcgcgccggacctgagcggagagaaaccatgagacgacagctgggtgcgctgctcctggctctggtggtgtggcccgcatgcgcgaaagatctgggcacggtcgggcatctgtttccgatagccgaacccgacctgctcgatttcatcgggcagcggctcaaaaccctgcgtgacagcggtgagctggaccggctgcagcgcgaagccgtggcgcgggtgaaggcccacgcggttcgcccgccgcccgttgcaggcctctcgccggcaacaaaggacagggtgtaccgctacgatccgacctttaccgtgggcgagaccatccgcgacatgagtggccacgtcatcgcccgggccggggaaaaaatcaatccgcttgaccgcgtgccttacagcgaaacgctctacttcattgacggcgacagtccggtgcagatggggtgggtccggcagcagataaaaggcgggcaaaatttcaaggtcatcctggtaaaaggcaacattcacgataccagcattgcgctggatgaaccggtctactttgaccagtacggtacgttaacaacaaagtttggctttgagcacacgccggtccgcatcacgcgcgacggccgggtgctcagggtcgaggaggtggcactgaaatgagacatgaaacgctccctttttcagcagcggtgcgcatgaacgagcaggacaaagaggaactgcgcagcatgaccggcgaaaaccccatgtattccgagtcaaaaattatccgtgctgccatccgcttctttggggcggtcagcgaggatgtccggcgggacatcattatcgcctcgctgaacagagaggatgtgcggcaggttatgcgccggcacggtatttacgcggctgaagacaaggagctgccagagaggggctgagccaaatctgacagcctgagccatcccgccgccgcgtttactgaagcgggtctgaaaggagaatgcgatgagagactggagactgctgtgtgatgcgggtgtgctgtgtgcgctcacatggacggcactgaggcgaaaaaacgcggcccccgggcaacggtcatctggaaaaggctggcatggcggcgtgcctgaatcgacagggcaggaatgcaaagaacgacgtgaagggataagacagcgagatatacacgcaggctgggtccgcgaggcctggccgctgcagcaggtcagcatcatgtgtcagagttcgccgggcacattgaaggcggatataccggacgggctgcggcagcttgcacgcgtgctcaggaaggacagcggcgtatttaccggcggcaggtgcggcggtgaccgtatcctgcgctggcacatggtgtcgcagatagtcacagacggcgtgacttatttcagcccgtaccccagtggaggcaccgcattgccggatgcctacacgcgggcgttcgggccacacactgatctgcctgaccgtgacacggcagtggttctgctgcagggtgactgtcaaaccccatcggagacgctgccgcatttcctgcacaccgtcgcagcggaaattgagcacggggtgtcgcgctacggcatcaacgatcgcggcataggctgggcattcatgacctatccggcaaaaccgctgctcagcagcgcctcacgcggtggcagccaatatcccgaccgccggaccgtattgaaaggagtaagccagtgacaattactaagtgcgtgtctgcactgttgctttccgttgccgtagtgggttacgcccgctttttgtacagatgttatcgtgcagagcgcagggaagcagacagaattctcagagcctataccgacatgaaggcccacctagctcttgaagaggacgcccaaaacaggacggccgaaaggctgggagtggataaacgctggtatcacgaggcgtggccccttgcacaggtcaccctggtcctctcgacgccacccggcggacttaacagcatcgtgcctgacatgctgcgcaagatgagcttacgttatgaaaatcccgagatacagggcatgctggatatttcatccgttaagggcgttcgggaatatcaccggtttcgggtggtccgtcaggaaccctccttttttgtcggcggctgcggaagtggcgtctcacccctcgcctgggaaaacgtaatttttgaccctgaagcagaacctgaacgcgaccatcttcttgtgctggcgcagaggaaccgtcgcgagggggcaagctttttctgtttctgctttgagcaaatagcagatgcgctggaaaaaggtttgcccgcagaggctgaccacgacgatgactgcggctgggcttatcgtgcttaccctgccagcgtgacgtcagccgcgctggagcagggcatcatgtaaaaagcagaaaaacacaccgttggcggctgggcctttcggacgtttccggcccgctgacaaaaccttcttaaaccggagttaagattatggacaggtacagcattgtatttactctggcactgacggtgttttttgccacagctctggccataaagcatttcgcgtgagtgtctgaaacctaccttcccgctgcacgcaggctgttcgttcctcgccctgctgcggtacgcctcagcctgcatttcgcgggcaggcctgattaactgatgcgggcagctccgcagccctgtttccggaatctcatttatgacaaatcatgctgacatatcggcccgtgaggtcgtgcgcgatcgctggggccactggacccatcctttttattattcaccgcctgaaaatggagagtttgcgccgcccggtgcatttaatgactggctgaagacgcacagcctgcagtcagccacctcgtggatggaaaacgacgtggaaaaccggcagatggaacactactggaaaaccggtgactgcagcgactgggtgccggtgagtccgcccggtgagggctggtttaccggcagcatccatgacaccgacgacggtccggtctgcgtctggctccgtccgctgacggcaaaggcggacgaatgaaacgattattactgatgctgtgcctgctgctgtcggtgacggccatcaggcctgccatggcaggcggcagtaacgccggtgacggccggtgggtgaatcccatcagcgacgtctgctggaagtgcctgtttcccatgacgctcggcagtattcagctggcgtcaggcgcgcacccggacacacccaatcccgcgtcacccatacagctgtgcccttacggcattttttaccgtctggggctggccatcggcttctgggagccgctggcgctcaccgacgtcacgcgtgaaccgggcgtgatggtcaacatgggcggattcaaaattgacctggggcgcaccggcaccgggaccggaggacagagtgacaggcccgaaccgggggccttctatcacgttcactggtacaaatacccgctgctgttctggctgaacatcatcaccagtaccggctgtatgcagaccggcgacatggacattgcatacctctcggaagtcgatccgttgtggaacgacagtacgctctcgatgatcatcaatccggaagtggcgctgttcaataacctgcttgcgcagggggcctgtgcggcggactccatttcgtccacggcgggcatgccgctggacccgcttttctggtgcgcaggcgcgcagggctcgatgtacccgttcacgggctataccagcaacgagttttcaccgctggaggcgtccctgctggtgacggaacgtatggccttcaagctgcaccgtgaggggctggtaatggagaccatcggagccgatacggcggtctgctatgaatatccgtccccgatcatcccaaaatcgcgatggcgctatcagatggtcaacatgtaccccgaacccagcgactgccatccgttcgggacctcgacgcagctgtggggcagcacccataacagcccggccacgaaaaagaactttggctatctgctctggcgaaagcgcaactgcgtgtacctctgacggcccgctgaccagcgctcgcccggcagagcatgacttattcagaggaactgccatgaaaactttcctgatgacggtgctggttctcggcaccgcgctctcgttcgcccgtgcggcagaacagccagcagccggtcagaacgacgtagcctggatgaaacagcagcagcgcgacctggagctgttcaaaaagcagcttcagggcacgaatatcgccctgccggatgcgcagcaggggcgggtgacgacgtttcagaatgagatagccgccgctcaggcggagcagaacagcgccagccgcgaaacgcccagggccgtttattttgtgagcctggggattccgcaggaagggctgctgccgatgctggaggatgcgcgccgttttggcatcccggcgaccatccgcgggcttgtagacaatgatttccgcaaaaccgcctcgatgatgtttgacctgtcgaaaaaggacaagcaggccggcgtgcagatcgacccgacactgttcaggcagtacggcattaaggccgtaccggcactggtggtgacctgcggcgctgagttcgacgtgatttacggcagcctggagctgaaacaggcgctgaaagaggtgcagcagcgcggtgactgtgccggtaccgccgctcagctgcttgaggccggggagcgtccgcgatgaaacggttctggctgattatgtttctgctgatgagcggtattcgcggcgcgtatgccgatgccaacagcgatgcctttaacgatgcgagcggttttgctcaggggaataaacatcaggggacatcagcggccagcggaacggacccggcttcggtgctccccggctacacggcaaatccctcccagagcagcaactacggcggtgtgcggggcggtgacggtggcatagcagacaaaggtcagacgtcgctcagtcagaatgaagcggggcagacggtcaatgattccagtaccaggaaccccgctaccaaaatcgatccgaatgcggattttatccagaacggtaaaaacgccgaggcgaacggcggcagcatcgttgacggcaccggttcgcagtgcagtgaaaaggtcgtctccaagtcggtctttgagaactacagctgcgaccgtgacgtgaaccagatacagacctgcgcccgcaccgcaagtatccaggtcaccggctcgaaagagacctacaccacgcagtttgtgatggacgcgaggaacgcatcaggcaatgacgaaggggactggtgggtgcgttatgactttacggcccccgacgacggaacgctgagcagtggcagctggctttttcagcagcccgactcacctgactatcacggtggcggattcactttttccatgcagtctttaggacagtcgatcacattcgacctcaacaattcaggcactttctccattgcgtcacagcatgtcagtaaggggcaggtcatatccatgaggctccggtggaatgcttctggccataacgacagttaccgggatggaatgaagagggcgctggcaaacggaaagtacgttgcaaggatcacgcttcccatgacggccgagcgcgacaccacctcctcacatgtggtctggaccgaaagctgcccctttgacaaatcaacggcaaccagcagcgcgggctcgcagtgcgtagacccgggcgggaaccggacaattacccagaacggccgggattacacccagtacagcgactgctggcagtactcagacgcctatgtcgtgccggtgaactccacgggcaactgcgatcagctcatcaacaaccgcaactgcacgctggccgggcgaagctgctcacagtctgaggcgggggcgtgtatgcatgaaaatgacacctatcagtgccagaccgtgtaccagtcagaggggcagctgtgcggcggtcagtacttctgccgcaccggcgactgcagcgaaacggacggcgcgggggataacggctttgacatgtccgtatcgaaactggccgggctggcttcggcgggcgatgacgtcaaaaagggcagtcagatcgacatccgggccttcaccggtcaggccatgtcgtgccgcaaagccgtcgccggcttctccaactgttgtgtggacaccggctggggtaacagcgcgggactcgccaactgcaatagcgaggagatggccatcggcaaggcgaaggccaaaaaggtcacggtctacgtcggtgacaagtgcgaccacgcggtgctgggcgtctgcgtgcagaaaagccaggtttactgcgtgttcggcagcaagctgagccgcatcattcaggagcagggccgccgcgaccagctgcacatcgacttcggcagcggcgactccccgaactgtcggggtattaccgtgccggaacttcagtccatcagctttgaccggatcaacttccaggacttctacagcgacctcatggccaaccagaaaatcccggatgcgtcagtgatgattcagcaggcgaaagaccggattgcggcgcaggttaaggctcaccagggagacaaaaaatgagaaaactgctgtttgcctttctgctgatgacgggcgcggcggtggcggatgacgggacgcccgccgatgcggtggtcccgcccgccgatccgttcaccggctggcactggtacaacgagccgaaaaagccgccttcgcggccggctccccggccacgggcagcaccgccggcgataccggacttcagccggctgtcgcccactgagcaggccgacgttctgaagggctacacccgggaggcgctggcgaacgccatcctgcatcccacggcggaaaacacggcgacgttcctgcgctggcagaagttctggaccgaccatgcctcgatgttcagccagtccttcgcggtggcggagctggaccatccggacctggactacaacctggagcacccgcactacaacagcaccgcgcccctgcagcaggcagaggaccagaaagcgcaggccaccgccatcagcgagattgccggtcagtacgggctgttttacttctaccggggcaaagacccgatagacgcgcagatggcgggcgtggtggaggacttctgtaagcgtcacaccatccggcttatcccggtcagcgtcgacggcgttgtgtcgccccagctgcctgaaagccgaccggacaccggtcagagtacccgcatggggattacgcactttccggcactgttcctggttgacccggtggccagaacgcagcgccccctggcctacggctttatgacccaggatgacctggcgaagcgttttctcaacgtggccaccggctttaaacccaacttctgaggagttcctgtgatactgatttctcctgtatggcaggcacggctgacggctgtgcaacgtgtcggaaaactgacgctgtggacctttgtggtatggccagcgctgatcttctttttcctctttctcctctccgcgaacaaagccgggagcggggggcagctgcttctgacctgggctgaagaggcgttgcgcgatgcgcctgcgggacaggcatggggctgtcaggtagatcagaccagtcagaatctgacggcggtttcgaccggcgaacctgccacagaccgcaccgcgccgccacagcctccggtagctgagccctgtgtgagggcggcggtcagtcgcgacgtctggatcgaggagaccaacgattcactccggggattctacgaaacctgcgtgctgatttccgggttagcgggtttctccgcgtggtatctccgcagcagagctaaacgaggtaaatgatgcagcgacttccctttattgccacgctgtttatggcgggcatcgtgtttaactgcctgcgtgaactgctggagtattccgtggcgctgacgcaccagatcctcgtcgtcggtacgggagtgtgcctggtgctggccgcgctggtttttatcgtgaccgaaatccggtcgggtcatggagatgaaaaccatgaagcctgaatggattgcgctcctgatggcgctgctgctgccgctgactgcgcaggcatcggtggctgacgaggtcgcggcgcttgagcgggccaaggcgcagcagggcgtgcgcctgcccgacctgggcctgccgggcgggcaggtacgccgcacgacgggcgtccggccaccgcatcccgtgacactggccgacggccggacgtttaacctcaatgattacgcggtggtggtgttcatgcagcgcaactgtccgcacagcgccaaattcgatccgctgctgcgggcctgggctgacaaagagggcgtgaaggtttacccctacacgctggacggctacggcgatgcatcgtttccgtatccgctcatcccgcgcaaggccggtccggatgaacccatcgccggggaaatcctgaccttcttcggcaacggcctgcccatcgccacgccgaccacctttctggtgaacgtgaacaccaacacggcgtatccgctttttcagggtgaaaccgacatgaacaccttcagccagcgcctcgggcagatgatcgaggccgatgccgaccacgtagcccccgatacgctggggccggtcccgaacagcggactggtgaccactcagtagcactgaggcaaaacatcatgaatgaacatcccctgacgctctcaggccttgaggcggcgttgctgattgtctgcgcctcttttctggccgccgccgggctgtatgcctggctcgtctgtgatttcacgcagggcgggctgctcgtgcttcgtgcgtgcgccggggcggggctgctcagcgccgtccgggattttccacttctttttctgctctccctcgcaggcggagcaggcgctggcgcattactcagcatcacgctgcggcgtaacgggtttatgaccgatcgtagcgaagcatgaaggttttcaccccatccgcccgcacgaccgggcaacgcgaaaagacattcagaggctgacgacaacgtgaataacatcaaaaagcagtttaccgggcggctggccatgctgaaggccttcaggcagctgtgcgtctcagtgctgaccgcgctgctgatagccagcccggcgatggccgacgttcagggcgacctgaacgggtatttttcaagcctgggcttcgacggcaacgtgtcgcaggcacaggcctggcagggacaggcggcgggctacatgaccggcggttcggtttatctgcgcaaccaggtcaagcaggtgcagcttatctcaatgcaggttccctcgctgaacgccggctgcggcgggatcgatgcctatctcggggccttttcctacatcaacggggccgaactgcagcgcttcgttaagcagatcatgagcaacgccatgggctacgcctttgacctggcgctgcagacgatggtgccggagctgaagcaggccaaagatttcctgcagaaactggcctcagacgtcaactcggccaacatgagttcctgtcaggccgcgcagggcattataggcgggctgtggccggtgacgcaggtttccagccagaaaatctgccaggacattgccggggaagacaacatcttttccgactgggcggcgtcacgtcagggctgcaccgtgggcgggcagtcagacaacgtgacgagccgtgcgcctgacaacatgaaggaccaggtgctgaagaacaaaaacctcatctgggatgccctgggccgtaatcacctgtttgacggcaacaccgagctgaaagagctggtgatgagcgtcatcggctccatcgtgttcaatccccaggggcaggtcaccatcctgacgccgatggtggataaccgcgacatcattaacgttctgatgcgcggcggctcggcaaaaatatacggctgcgataccacagacctgtgtattgcgccggtcatcaccaccgtcaacgtcagcagcgacagcgcgcttgtggcgcaggtccgcaacatcatgctggccatcgacagtcagctcgacagcgacaccgcgctgacgccgcaggaagaaggcttcattaacaccacctccgtgccggtgctgaagtacctgaccaactctcacagcatgggcatgagtccgacctacctgctgcaggtggcggactttatcgcgcaggacatgatgatccagtatctgcacgaactggtccagcaggcgagcgaatcgctggcgggccggaactatccggaagaggcggcgaaggagcttcgcaacaacatcgccacggcgcagtctctgctggcgcagatgaaactccagtccaccgccgaccagaacgcgctggacggcatcgatcgcaacatgcagtacctgcagcagcaggtgtccaccatcctttcgacctcgtaccagagcaattacaactgggggaccggcaatgactgatatctacaccatctacggcggcggcatgtggcgggaggttttcaacgggctggtcaccatcctgggaacagactcgttcaccacgctgctgcgcatcgtcagtatgttcggggtgctgggcgtactgatcagctttatgaagtcgcgcaatcccctggtgttcctgcagtatctggcggtgttcatgataatcacctcggtgctgctggtgccgaagcgcagcgtgcagattatcgacatcaccgatccggccggcgtgtacgaggtggacaacgtcccggcaggcattgcgatgatcgccggcctgtcgacggcgggcggattcgacatggcccagttgtatgatgaagccctggcgcgcccggactcactgacctataccaaaaccggcatgctgtttggctcaaacgtcgtcgcacagacctcagatttccgcaccgaaaacccgcagttatccgcgctgctgccgcagtacgtggaaaactgcgtcatcggcgacatactgctgaaccataaatacaccgtgtacgatctgctgcacagcagtgacccgctgacgctcatcacccgccagccgagcccgctgcgcggattgtatgaagacaccggcaacggtcgtatgtttgtgacctgccagcaggcggcgtccaccattcaggatcttgtcagccgtgacgcggtgccgggcagcagcacggttcattctctggccacaaaactgttcggcaacaaggccaatgccgactcgctgctgctgaatgccatgaacgagagctacggtttcttctacgcgggcggcctcacggcgtcgcagattatgcgcaacaacatcaccaatgcggccgtccgggacggctggaaggggtttgcgtcccgctcctctgataccgcgaacctggtcacgctggctaccgagtccagtctgaccaaacagcgcctgagctgggcgtcaacgggcgtcatcgtggggcgcgcgctgccgctgatgcagtctctgatgatgcttatcctgatcgggctcttcccgctggttattgcgctgtcgctggttaaccacagcattttcgggctgaacaccctgaagatgtacgcgggcggttttctgtactttcagatgtggccggtaatgtacgccatcctgaattcgctgatgaactattacctgcagaccaaaaccggcagcacggcgctggtgctgtccaacagcgaccaggtggcgctgcagcagtccgacgcggcggcgctcgcgggttacctcagcgcctcaataccggtcatgtcctttttcctgaccaaaggggccggttcggtggcatcacaggtggtgggcggcatcctcagctcgtcggcgttcacaaccagcggtcaggcctccaccgcagcggacggtaactggtcctttaacaacatgtcgatggacaacgtgagcggcaacaaattcgacactaacctggtcgagcggtccggtcagcagtcgttccagaccggcagcggggccatgcacacgcagacggctgacgggcataacgtctatgacacgagcggggcgatatctaacctgccggtgaacctgcgcctcagttcgctcgccagcagcgggttctctgagcagtcccgtcaggcgcagcagcaggcgcagacggcgctggacggctataaccacagcgtcaacagcggtttccagcagatgcaccagatcaccacccagaccggtaacagtgacacgctgacccagggcagcgacagcagcgtggccagcaacatcacgcgcggagccagcaaaatggaatcggcagtggagagctatgcaaaatcacacaatatctctcagcagcaggcaacgcagaaactcatggatatcaccaatcagggaagcatgggggccggagcacgattgtacgccaagctcgactcgggtgatgaactggccggtaaaattgttaagtggggctctggcataagtggcggtgtggaagggaatctgaatactgactggcggcatacctccggtagctcgcacagtacgcaggacagcggttctgaaagccatgatttccgtcacgatcagaacagtcaggcagtaaaagacttccgtgaagggctcgatatggtcacgtcatctcgcgtgagtgagtcgggaagccattcagataatcagtcaaattcactggcagcgcagtttgcggccaccatgaatgaggcgaaaagtcagtaccatcagtacaccgacagcaccactcgcagccaggaatacagccgcatggcctcgcttgcccgaaacgaaagcgccagcctggatgcgaactatacccaggagtttgtggaatgggcatcgaataaatatggcagtgatgctcagaacctacttacccatgcggcatcagcgcaaggggcggccatggaattcatgcatgagcgtctggagcctgaaattatgcaaaactatgcggcgagtacggcgcaggctaattcgttaccacaccgatcttcagttggaactgatggaggcgtgcagggtccgcacgagcacaatctggttgcgcccccgggatcgccgtcgcaggaaatgaaagatgactaccgccataacattgagcgtatcagttctcaggccgataaggctgatatagcctctaatattggaaatcgtgtatcagagaaatacactgaaaattctggaaaaatcggacgaactggcggagaaatagacaaaaataaaaccactgttcaggcatccagtggtatactcaggggagagcatcagaccgctgttttaaatgagcagattagacgtacagaagaagatttaaagcagaccaggttcggtgatgatagtgacaagtacgattattacaaagagaagctggataaaatgcgagctaatcagaaataataactttcttaacgatggagaggggtatgaaaaatctaactgcatcagacattagccgtgatttatctgcgctcatggaggggttctcttcaggggggcggctaataccatctccatcacgttcatttaaattgagcgcagctgtcccttttatagcgacgctccttagtgtcataggtgctacgttagtatacctgacaggttaccattctcaggccggtttggatggcatcttgaactattttgaaagtgatgggtgggtatttgttttaccaacgattgtagtgggggccttctttactttattaacttacaataaattcatattgtatttttcaataccaaaagatgtccgagaaaattcggttgttcttaatcatctgaaaaagactgcaactaaaactgttgttttttttattactttgatgattttctcgactgtattgtctgcttattcaacatggttcgctttttctataacagggttgctatttgccttgttgatgattggtaacttgttaataggacttgaaattaacaggcttggcgctggagtggcgcttgagaaaatatttatttttttaaaaaaaatctaacctcctgcccttgaccatctagcctctcgttcattatgaacaggggcttatcatctgaagtaaatcagaaccaatgtcccgggcgtcaagcccatttctattaaacaaggaaacatcaatgagaaaccgcactgcttcggtggcggcgattgctgctgtctgtcttatgctgtccggctgtggcgcgatgagcaccgccattcaaaaacgcaacctcgatgtcaaaacgcagatgagtcagaccatctggctggagccttccagcaacaaaaccgtctgggtgcaggtgcgcaatacctcagataaagacatgggcgacctgtacggcctgattgggcaggatttgcaggcgaagggatacacgctcacctcaagtccggatgcggccaattactgggtgcaggccaacgtgcttaaggccgacaaaatggacctgcgacaggcgcagggtttcctcagcaacggatacgagggcgcggcaatgggcgcggcgctgggcagcggcattacggcttataacggtaactccggtggtgccgtgctgggtgccggcctggcagcgggcattatcgggatggcagctgacgccatggtgcaggacgtgaattttaccatggtgaccgatctgcagatttccgagcgcagcaaggcggcagtgacgacagataacgtcgcggccctcagccagggtacgtccggcgtgaagctgcagaccagcagcgagcagggcaaccgcctgaagtatcagacccgtgtggtatcaaatgccgacaaggttaacctgaagttcgaaacggccaaaccggtgcttgaagctcagctggccaaatccattgccggcatcatgccataacggtcctgaaggccattttctgttttaacctcccctgattgcgttttctctgtcgtacccgtgcgtacgtgccttatgccatccctgagatattgcgcctcctcgcgccggcaaagcctgaccggcgtctgcggcgggcgctgcgacgtttaatcaggtcgttcaaaaagtgtattcattcttccctgataaggagtctttatgctgcagttcaagggtgcggttcgcactgccattacctggtttactctcttcctgtcctggagtgcgttcattatgtggcggtacggcatgcagctgcatcattacatcgcatcacacagcaacctgtttgcgtatgaactcgccgtccgcacgctgcaaagtgacatgatgccgcagggaatgatccctttcctgacggcactgctgacgctgaccgccggtgccgtgctgtcggttctgacgctgctctgctggaatatcggctattttgtctgcgcccggtcagttctgaccggggaacgactgctgaagcgcacgggccttatccgccagtaagtcgcttacctgtctgattaatcctgcctgaccggcacccggtcctgctcagccttctctgcagtcagcctgcccgtccagtacgggcgggccagtcctgcgcgctcgccggagttgatatgagtttcaaacctaaaaatctcacccagggtggccagataacggcctaccgactgcgcatgttcgggcaggtcaacagctggattttcagctgggttctggtgctttttgttctgtgcgcaggcgtggcgttctgggccatcacgccggaggacacgctgcgtaacggtacgtggtactggttcggctggatgttttcaggccttgtgccgctgatgaacccccgcagccctgccacatgggaggttcactggcactgtgagcccgacaggctctgcaccaccaaaatgaccctgacacagatgctggccgacccgtggatgcagcagcgggccgctgacatgctgcagaatatccggttatgcctgtccgtcttcggcgtcgtggcggtggtactgctctgcctgatcatctggtacgtgggccgcatcggcaggaaggaaagcgaagacgagtttatttcgggcatgacgcttaccgaagacctgaagctggtcaaccggcaacttaaaaaagccggcgaaaagtccgatctgcaggtggccggtctgcacatggtccgcaatgccgagatcatgaattacctcattcacggtacggtgaatgtcgggaaatccaccatcattcgctggctgctcgactacatacgcaagcgcggtgaccgcgccatcatttacgactcgggcggtacctttgtcgaaacgcactacgacgagcggcgggacaagatcctgaacacgcacgacagacggtgcgaaaactgggtgctgtggcgtgaaggccgcgaggtggtggattacgagaacatgacggccgcgctgatgccggtcgagggtgattcggacccgttctgggtgtcttcctcccggaccatcttcagtgacacggccatgcagttcgcgtccgatccgcagcgaaatatcgaaagattcctgaaaaccctgctgtccatcgacctgaaaagcctgcgtgaattcctgaaaaacacgccctcggccaacctggttgaggagaaaattgaaaaaaccgctatctcgatccgctcggtgctgaccaactacgcgaagtcactgcgctacctgcagggactcgataaagagggcaagccggagttcagtatccgggaatggatgacggagaagcagtacgacagcagctggctgtttatttccaccacggcccgtcaccggaaatccgtgcgtccgctgataaccatgtggctctcgctggccacgatattcctgcagagcatgggcgaggacagcaaacgtcgggtgtggattatcggtgatgaaattctgaatctgcagaaactcccggacctgggagagcacatggccgagggccgtaagttcggtgcctgttttgtgctgggtatccagaacatgccccagctgattaacgtttacgggcgtgaaatggccagagccatttttgacctgctgaacacgcgcttttacggccgctcacccagcgccgaggtggcaaaaatggtggaggacgacctgggcaatcagcgccggcgtgaagcccgtgagcagaacagctttggcctggcgcaggagcgtgacggtatttccatcagcaaggacaaggtcagggagccggttgttgattacgaccagataatgaagctgcccaacctgcgcttttatgtccgtctgccgggcgagtatccggtggtgaagctcagcctgaagtaccgcgaacagaagaaataccaccctgcgctcatcgagcgcgacttcagggacaacctgagtcccgaactggaaaacatcatcaggcacaacgagcgggaggcggccggtctggggctgcgttttcctgccggtgagggcgttacggagggcacaactgctcccccccggtcagccggaacagttgcagtgactgaagcacgttcctcagcgccggtgcaaacagcaccaacgcctgtacgcaatgaatcaacagtagaagaccccaaaaaaatcactactcagccagagcctggccttcaggcacacgaaccgctgccggataacgtccgggcttttcccggtcgtgagacaacaggacctgatgcagtacgggccttagtacgtcctcagcctgcagcatcggcagaaaaagtgccgcctgttccggaagtaaaacctgccgtcacatccttctcgcctaaagaaccggtcagaacgaccagcgcgctcgacatcctggcccgccggacgagccggccagccgcctccgacaattctgcggcgtcagaggaaggggcgcagggggaagcgcctgaactggccatggtggcggaaaaagatgatgcaggtcagctcatcgtgaaaacggaaggatacaggaagggcggacatgacagccgggaggatgcctatgccgaccagtaccgacaggcaaactaccgcatggcggatgatgaaaaaaatatcctgcgccaccgtgaagattacgagacctggcaggagatgggcgaacatcatgaacacggagattacgaacgatgatgaccgttgcgccggtggcgtcggccgccgatgctgccagttactacagcagcaaagataactactatttccttgatgacctggaaagtcagtggctgggtgagggcgcgcgtgaactgtgcctggagggtccggttgatctgcagacgtttacggacgtgctgcacggcaaactccccaacggaacggagctgggcaaagaggtccagggcgcgcacgtccaccgtccgggacacgacctgacgttttccgcccccaaaagcatctccatgctgatactggccgggggcgacaaacgcctgctggaggcacaccacgaggcggtgaaagaggcgctgggggtgattgaaaacctgataagcgtgcggaacacccgagacggcattacccgcatcgagccgaccggcaagatggtcgccgcgctgttcacgcatgacacctcgcgcaacctcgatccgcagattcacacccacgccgtagtggtgaacgccaccgaacatgaaggcaaatggaaagccctgtccaccgactatatccacgggaccggtttcattgagacgatttacaaacaccaggtaaagtttggccagatttaccgcagttccctgaagggaaaaaccgaagcgctgggttatgaaacggaactgaccggcgggccgcatggcctctgggaggttaaaggctttacagaatccgtactggaggagttctcttcacgccacagggaaattcgaggcagtgtaggtgaagatgccagcctgaaaagccgtgatgtggccgcgctcgatacgcgacagcgtaaacagtcgcttgaccgctacggtgaaggtgacaccctgactggaaagagtccggaagaggtcacgcggcactggcctggcgaagtttcaccggagcgtgacggcaaggcgaaaggcggggagcagcagccggaatccggaccgacagtagtggccagtggcaaaaacgcggaaatcccggttaagagccgcatgcccgatgccactgaaaggcatccggacgttaagcagaaagccggtccggactcagtttccgccggtaaggctgcaactgaaccggaacgggatatatcctcccctgtcaatgaaccgattgttaaacctgaaaccgaaaggggccgcagtcgcctgcaggcgcgctggcagcgtcagatggacgaaatgggctttgacattaagcaggtcatcagtgacgcccgggcacgtgaggaattgcagtccgctcctgaagctcccctgcgcaccgatgccacggaggccgtccgggaagccatttccgtgctgagcgacagccagacccggtttacgtatggcgatctgctggtaacggccttcagcgcaggacagcacgaagagaaaatccccgatctgaaacgcgccctggataaggtgatcagcagtggcgaactggtgccgctggatgcggacaagggcgtattcacctcccgcatacatctgcttgacgaactgtcactgcagtctgtcgcggccagtacggtcagagaaaacgtggttgccagctttcgtgcgccgaaagagcccgttcccgcacgctttgagaaagcgatgctggcaccggtggccatcctgaatgcgccttcatcagccctgcgtcagcgggaaacggcagagcagctggtgacaacgtcacgcgctcacgggcgtgacgtgatggtcatggccgcctctgccgaacgcgccctgtcgctcggcaaatccgcgattctgaaagacagcctgatgcagcgcagccggatactcggtaacggcttcagcctggcacctcagagtacgctcgtggtcgacggcgcagagaagctgagccttaaggagatgctggtgctgaccggcgaggcgctggagaagaatgcccagttgctgttccttgacggagcgggccgcacggccgcgacgagtgcgctgtctgtcctggagcagtcaggggtcccgcgtctgtcactcagcgagccgtcgcccggactggcagcccgcgttatcagtattgctgacaaacgtgaccgctatcaggcgctggccacgcgctatgccgaactgagcgggccggagacgacgctgagcgcgacggtcgcaggcgaacgtgagcagcagcaactgaacggcctcatccggtcggcgctgaaagacgccggtaaactcggtcaggaagaggtctccgtggaggcccgtattccggttttcaccacggccaaaacccgtcgtctggtaaacacctaccggcccgggcaggttctggaagaccgttctgacaaaaacgagacgcgacattacgttatagatcgtgttcacgaagacacccgccagctgtcgctcatcgatactgacggcgtggtcagcgtacaggatatccggaccctgacgggagactggcgcctgtttgaccgcaagacactgccggtctctgccggtgaaaagctgtttgctgtggccggcgataaagcggctggcctgaaggcacgcgatcgtctgacggtggagtccgtcagtgacggtcagattaccgtcctgcgcgacggacagaaaaagccggtgaccctagaaagcggccgcgcgctctacctgacgcacgcgtacgtcgccgcgcccggcagcctcgataacgatcgcggtgtggtgctggccagcctcaacgggcgggatctgactgcgaacatgatgaacaccctggcgcgcagcggtcatgaggcggaaatcttcacgggcgagccgcaggcccatgcggaagaccgcattgaacggatgcggtcggtccgcacgccgctgtcgctggtccgggaaatgagcggtaaagacgacgccacggaggccgtgacgacgctgaaaagcgccgtacagacggatctgcagaaggcgttcacgcgcgccgtggcccagatgcgtgatgtggcatttaccgaggttgagttgctgaaggaggccatgagctttgtgcccgacactcccggactgcagcagatgctgcgacagcaggtggcggacaaggctctgattcgcgtgtcggttgacggtgagagccgctatgtggcgcgcgccacctgggagatggaaaaggctatcgtggctgaaattgcggcgggtaaaaatgccgtgccgccactcatggagtcccttccggcgtcactcaccgccgggctgaccggcggacagggtgaggcgacgcacctgatcctcgaaagtaaagaccggtttattgccatacaggggtatgcgggcacgggtaaaaccacccagttccgggcggtaacgtcggcgcttaatacgctgcctgaacacgcccgcccgcaggttatcggactggcccccacgcaccgcgcggtgaaggagatgcgcagcgtcggcatcgaggctcagaccatgaagtcattcatcgtggactggcagaaacgcacggcggaaggcgaaagcgtccgttttgaaaacacgttgttcctcattgatgagtcctcgatgctgggtaaccaggacaccgcggcggcttatcaggctatttcatcaggccggggcagggcagtctcggtcggggacgtcgcacagtttacttctccagaaagcggtgcgcctttccggctggtgcaggagcgcagccccattgacgtggccgtgatgaaagagattgtccggcagcgcgatgagaatctgaaatctgcggtatacagcgcgatcgagaacaaggcggccgcggccattgacaaaatcatgcaggtgccgccgtctgtggtcccgcgttcggaacaggtggttctgcccgcccggtctgttgtcgaaacccaaacgcccgtggaggctatcgtggcggactggactggccgcacgcctgccgcacgggaaaagacgctcatcatcgcgcaactgaacgaagaccgtcgtgccattaaccagggcattcatgacaggctgactgaactgaaggaactgggtgagaaggccgttacggtgccggtgttgtcgcgcatcacgggcgggcgtcatgacttcaaccgcacgtcggcgtggagttccggtcaggtggtaaaggtcaacgacagctatctcaccgtgacggcggttgattcggggataaaccggatcgtcctgcgcgacgaaggtggcaggacgcagttttactcccccgccgagctgaacgtgacggaaatcgaggttttcgagcgccagcatattgaactgcgggtgggagacagcgtgcgcatgaacaaaacgcagaaagcgtccggccacgcggcgcatgaacagtaccgggtggaggcgctgcatgagaacggcgaggtggtgctgaagaatgccgccggtgaaaaggtgatagaaccgggtaccgtgacggccgatcagcatctcgactatgcgtgggcggtgaccggctacggtgcacagggggccagtgctgattttgtcattacgctggaagggactgagggcgcgcgtcagcgcatgagcggaatgcgggcattttacatcagcctgtcccgtgcagtcgatcacgtgcagatctacacggacggtctgtcagactggctgggcacgctgcacgacagggaccgggagccggagacggcgcatgacgcgctcgatccgcagcctgaacgcgcccaggcgcggctcatctgggggatgggtaagtcactgtccaaaacggcaatcgggcggacgttcctgcgggagcagggacttaagcacagtcccgttaccgcgcgtatcatcccgcccacgaaaaaatatcctgaaccgcacatcgctctgccggttttcgacggaaacggcaaaacggcaggtatcagtctgtattccttacaggcagagagcggacgtataaggacgggggagggcaggacgctgaccacgggtgacgcgcaggcggcagtcttccgcaagagccggaacggcgaaacgctggtcgtgacgtcactggaccaggggcttgaggcagcccgtagtcatccggaaacgggcgtggttttgcagaccggtcgcaggccgccttcggcacagatgctcagagtggcaggtggtgtgccggagcgggcgattcgcccggatgccgcactcatgagtctggtacgcgcagagctgcaggcactgataaatgttttgcacggagacggacttctcagggattcagctcaccccgggcaggcagacctgcaacgcgcagcagagatgctttccagggagaggcagaatatggccataaagctgccagacacggaggaacagaagaaagcagaggcggaaagcttgcagcggtgggtggcagaaacacttaaagagaaaattcctgccctgccgggtgaaaaggagcctgattacacccgcttcataattcgcgccgcaggcgaactcgctgagaagaaggaagcgctgtcagccgccgcagaaaaaatgctggccagcctcagccagcccggactgccggtcggcccggtattgcaggacaatacattgtcggacatttccgtttcaccgtccgttctgaagcagcttaccgcagaacaggactctgccgctgcgctggccagacgtgcgcccgtcggtttgtcagataaaacactgtcaggcgcagcgcgcgaactccggcgtcaggatgagcctgtgctgccgccggaagggcggggacgtgagcgcgaggagccgcagcgcgaactcacccgcaacatccagaaagagcgttaacttacctgcgggcctgacgatgccgggcccgtatacattcctgactcccgtattcatccgggtgaagtcaataaaccactctgtcgcggtgcgcgacatacggaatcttatgaaaaaaaacgtaacgctggccgccgtgatgctggccatatctgcatcctatgccgtccaggcggcagaagcattaacgcctcctccccagacagcggcaaccactgccattaacggcacggcgaagccggaaagccaggctgctgctgacttcacgccggcccagcaggcgcgcatcggtgaaatcgcggcagactacctggtcgcgcatccggacgtgctgattgaggtcagcaagaagctgcaggcgcgtcaggaagcccgccgtcaggctgcttacacgcaggccgctgtcggtgcccaccggctgctgatgcagctggatgacatccccgtctccgggccgaaaaatgcaaaggtgctggtaacggagttcttcgactacgagtgcatcgcctgcagcatgatggcccccgtaattgaaaacgtgatggccgcaaaccccgacgtgcgctttgcgttccgggactggacgatattcgccccgcgttttcaggaatcgacgctggcctcatgtcgcgggctggacgtctggcggcgacagggtgcacaggcctacatgacctaccacaacgggatttattacacggggcataacgaagggaagctgaccgccgccgacatcgatgaggctgcaaaagccgtcggaataacggacaaaagcggtgcagacgacggtaaatcagacgcggtcatccggaacaacgacgcgctggctgagatgttgggcctgacggggacgccgggcattatcgtcatgccggtggaaaatgccacggaagaaaacaccacggtgataccgggcgttgtcagcgaagcggtgatgcagcaggcaataaaaaaagccagcggtaaatgataaagattttattacaagtaaatcgtcggtcgacaaccttatatataaataatttcaattaactatgatgtcaaaacagcatgtctttaaaaaggcatgctgaaaagatgtctttaacacagtctggagaaggaaaggtgagttcaggccgttcttctttagggtgctacatttctcattatttcaccataaacaatattgtaatcttcatcttttaacatttccagaaccgtaggttcaggaaaacccgcacccaacgtcccatgtttaaagatgtaaactctttcactaatggctatatcatggccataggcttccagccatccaccgctaaaacttcctttttttccacatataatttcaatgtctttatagtttctcatcctcaagtacatatccagtactatacaccagtgatgattgaagttatcttcacttagttcaaattctttcggaataataccccagtctattttttttaatgccatattgaactcttcaacttcaaatgcaaaaaacttaggttgcagacccaatttcatacgatatacatcaaccaggtcatacgcctctcgtaagctccgggtgcctctgagtggatcatccttgtcatcaactaaacgagagtaataatcttttttagctgtctcaaattcatctgcaaggtctgcgtttatagcttcaactatagtggtgcataaggcactgagaaagaaaagctcagaagtggaatttggagagtcagggtttttagtataattacttaataaaacaacgttttctttgtccttatcactcctgaaattatgggcggccaatacatttctatattttctcaaaccctgtacttcttctattctgttaatggctggtttaattttattacatatgccttttaatttatcattgcctttagcattacttctaaaggcattaatttcatccaagaaagcacagacgtcgataatctgttttaaaaacaaggattgctttaagtcacggttaaatttatatagttcgtgatatttttttccgtattttttagtgttatctacggaaaattcgatgaggtacatgtctcgttcaaacttgtttttgaagagatcaaggattattagggaactgtgtaatggtttcatgtctttcatattatttctttcatcgtcagaagtaggttattgaaaattgtcatgctaagggaccaaatagtaacgtgtgttataatcctagttgtgtaaagttgctattgtgaccttaaaaattgctggcagtccggaaaagctgacagccgcaatcaaccagtaccagtttgttgttatagttaagttcgcgtctcattcatatttatcgtctcgcttacaggcagctttaaaactttttggtgagttaactattaatcatcagagcattagaacctctgtttgccatactctcgctgaaatctggagttatgtcattcccacttcacaaagattgctctctctgtccctatacattgtcataaaggaggagtgctgtgagctgataatttcgaggtcgaaaagcgtaacaaaggttaatttcatactggatctgagatttttctgagggtatgattttctgacgatcgtgtggcgcgatcgtaacgatccttttcggcgggctgtggcggtctgcaggagaggagagcacaaacctccgttaccgaacatgcgcggccgcgggggccaccgactatccggatgggacgtatccgtaaaacgtccagggtcagaatccggcgcgcccggattctgaatgcaaaaaccccccggtactgctcaactttggcgggctgacagtatcggggggttaaaagcaggcgctggcctgtgaaggattataacgcatgcatttcataagacaacctctgtccgccataagtccgggacagagtgaatgaccagattttaatcgggttaaactgcccgaccccggatgaagccagacgttgcagcagttacctttctgctgccgacatttgccccccgaccgggtgcggcctggctcctgctacgttgctgaagtctgttttccggctgaacttgtcggaaaggcctcttcacatcaaaactgtattgttcgcgcgtgacaccggctttaatgacggtgggcttccccgcgtcttttttccggctttcctgtttacacgtcaggcggtcagtgaagaccggcgacatacctgtggccagagaactgaacggtctcagtctgccagggcggcgctgtcatgaagcagggcaaaccgtcacggcactggagtcagctcagcaccgaagaacaggtgcgtttctggcagggcgtcgatgccggtgaaacggcctcgtttctcgtgcctgccggaccccgtaaaacccgccgcgtcaggggcgaacactccacgcgggcgaaatgtgaaaatccgcggtggttccggccggcgcgttacaaaccggtgggtggccagatcggctacctttacaaccgcctggtgaaaaccgatccggaaaccggcctcagcgagctgcgcatgcggatgtcgctgcacccttattacctgatgaaccgccagaaggcgggccgtaaaaaccatttcaaaccggaaaaagcccggctgctggataccacctggccggttctgatcagtttctgcgacaggggcaaacattctgtcggcatgtgcacgtcgcggctggctcacgaggtcagtccgaaagacgaacacggcaacgtcattccggagacggccgtcacggtgagccgtatgtcccgcctgattagcgagcaggtccggtatggcgtactcgcagcgtcggaagaaaagatgtgggaccgcgagtccgggcagtggctgccgaagtacgtctgggtaaccgatgccggtttccggatgctgggcgctgacatggccagactcgcaaaagagcaggataaggcgctgcgcaggagcgaggaacgcaggcagatgatagcggaaggactgatgcgtgaggatgaagacatctcgccacaggctgcccgacgtcgctggtacgaccgcaagagggttgagtcgctgaactaccgtcgtcagcagggcgcgatgcgtaagcgggccaagcggctgagcaaccatccacgggacgtgcaggtgtttgagatgatgaagcacctgcgtaaaacgctgcccgcaggcgagttgctgtactgcacggatgaccgtcttgagaagctggctatccggcagctcttccagatgcagctgtttgaggcacacgacacccacgtctgacgcgtaaaacccgacatacaaccatgccccttaaccggggcttttgtcgtggttttttttcaggctccggccgcgtcatcgccataattcccgtttcatggcggccgtgacgtcgctgatgcgccggcaggacgcgcaaaagcccgtcgccgtccttttattcacaaaaatccgcaacgggataacttcagaaagcagcaaacggatatcggataatctgcaaaacattcataaacactgttttaaggtcttccggataaatccggaatgatctctgtcaccctcaacactgtggataagtggataaggccttcgtttgcagcgtccgcgccgctcagaatgggagtagctcccgctgaagcgggccccaaagcgcaattattttagttacagcatacattgattcactgtaaacagcgccagcgcagttctgcacgctgagtgcccctccaggcagggaccggagccggacctgaaaacccatcgcccccactgaccagccgccgccgcccggcccttcgggccggaactgcagtggctgattaattggtgttgtaactaattggtttggtatcgctgtgagtggagttgcttcagggtacagtgaacacgcccgtaagcggcccttacggcccgctgacgcggagatacgccccgactgcggcttcgccttgtcgtgaccactccgacagcgcacaaaagcttctgtatcgcttttagcgggcttatgtctagcagggtgaaggaatggattggcagaacctatcagaactgtaaccggctgcgccgggtcacggtgccattcaacagtaaagctatattcagtatcggctggcacctccatgccgctttgcggcattcaaataactgactgcgcactgctcgacagttttctaccatgataccatgaagggattccattggaattccttcatgaatctaacttagaatttattattgaattccagatgctttctatttagaattcaaacaggattctttttgggattcccttttggtgccaagtggtactaacctatagatagagggtatatgtatgccggtcattgttttcgtatcaccaaagggggggcagggaagacaacttctgccttagccttagctatgcaaatcgcacggcgtgtaccagttaccgttattgatgccgaccctaaccatccgattaaaacctggtctgaaggaggagacactcctcaaaatatgacaattatctcggatgttacggataaaactattggtgaaacgatcgcagaagctgcgacaaaaacccctttcgtaattgttgatttggaagggacagcagcgaccatagtcgcgtatgcgattgctgaatcagactttgtagtcgtgcctacacaaggctcacaacttgatgccgaacaagctagcagagttttcgggttaatacgggcacacgagcgtggtatccagaagcacaaacctgattaccggctaccgtatgctgttttgttcacacgtacttcagcggcgattcaaagtagggatacgaggcatattcgtaagagcttcaaagccggaggtattcctttttttgaaactgaactgaacgaacgggccgcctttaaagcgatgttctcttaccgtcaactacttgaatctcttcccagagatgaagtttcaaatgttgataaggcaattgaaaacgcagaagctttcacccgtgaactgatagcaagaattactccggaagcaatacagcaacaggacaaggtcacattatgagccgcgtagatccgctagatagcttgaagaattttgagccaaaatcagccaaagagcagaaatcaaagcaaagtaacgcagagattgaggaattagcttacgaacacggttttgtcgctagattgtcaacagcgccgacgcccccagtcgaacgctctaagcggaggtttaaaaccggacgtaatgtacagatcaacattaagggggagcaagataccaaagatgaattatatcgagttgctgatatgatcgatgagccattaggtgaaactctcaaacgtgcgttagcagctttgagacgggaacttggtggttaggaaaatgaatcatcgttttaaaaatttcctggccatgaacagcagtgtaaacactgctgttcagtaattgtcgccagtggatcacctccagcggctgaaatctgacccactaaaacgcaaaagccccggcggttagccagggctatgtggttgcatgtatctgagatgccccctataaacaaacttgctggtatgttgatgggaaatcaaagggggttttctaatatttctgaggcgcttcccagcgactccggacatcccttcgtcgctggctgaaaagctttatctggagattcctacaactaaataaagcgccgctttaacacgccagaacagtgtaaattttgtttgatttttttgagcgaaggtgagattatattggttgtgtggtgctgagccccatgaatgtcgattataaatgtcgttacagcgatgatgtaacagccataattctcgtaattcattttaggtttgtttttccataaagcacctaacctctatacccggcaccacacatccattataatcccataattcatacttcatttcaatagcaccttctttttttacgcacattcaacagtaatactgtctgagcagaacgttcatggttaggaaaacatcactagggcggctgtcattgagcaaagcggtcaagcatatcgcgggcacgctgagcatcctgctcactggttgaagcccgaaggtaggcgcgtacaaacatggacatggtactgttagagtcctttagtgataccggtctggttagggttgatgtcatgtagataaacagtaccggattctgccagttcggtatagggatactttaacagtactggaaacaagcttacccgaacggactgaaagttcggggtgataaaaaagccgctgagcggctttctttgatgaaatagacatcgctatgccatgaacacctgtggccctttggcatcgatgatgttgatgatccgcagagcagccttattcggtttgctttcgtttcgctcccatttggagacgctttctacagacatgccggttgttatagccaatgcggcttgcgacatgttgtagcgagtgcggacttcctttatctggctaccggtcataactcggatcgccgggatactacgggctgcgaccgctgcatcaattgcagctacggtttcatcttttaccacgcctagtttgttatagcgttcagccataccttgaatgcgtttcagacgttcagtcatcacaatttacctcgatcagttctttatcagacagaagcttatttatagttgccggactcattgagataaaatcttttgcgatattgcagtaagcatcaatttcatcatcttcaagctcttttcctttcttttttgaaagctcacttttcagatacatatcaaaaaagaagatgttgtcgccatcattgaaaaaaactattgatcgtgctccatctctggctcctactccgggcaagccgaggcgctttttaaaggtgaattttccaagtggatcacccggcagaccagaaaaaatagccttagccgctttgcacaacatggcattgctgatgcgggccttgtgccgctctgtctcaaattcaggtgttaaataaattcccatgacactcaatgcttccatattgccgtaagaattactatagtcttaattacgggtttgtgcaagttgcatggcatacaaacgctggtgaaccccctcctatataatgatttttagagcaaaaatttaagccgagtgtgtccggttcctggtttagcaatggttctcttccgcttcctcgctcactaactcgctacgctcggtcgttcggctgcggcgagcggtgtatgctctatcggaatgagcattgacctgctccccgttgattaatacaccgcgatgtcagtaatgtcttcataagccacatgaggacatccccatgaagaagcgtttttccgacgaacagatcatcagtattctccgcgaggctgaagccggcgtttctgcccgggaactctgccgtaagcacgccatttccgacgccacgttttatacctggcgtaagaagtatggcggcatggaggtgcctgaggttaagcgcctgaagtcacctgaggaagagaacgccagactcaggaagctgctcgccggggccatgccggataaggaggcgcttcaggtggctccttggcgaaagtactgacgacagaccagaagcgcgaactcgtggtgttgatgtgtgatgcgaccggtctgtcgcaacgtcgtgcctgcagactcacaggtttgtccctgtcgacctgccgctatgacgctcagcgtccggcggctgatgcccatttatcagggcgcattactgaactggcactggagcgcaggcgttttggctaccgccgcatatggcagttactgcgccgtgaagggcttctggttaatcacaagcgcgtgtaccgcctttatcatctgaacggactgggcgttaaacgcagacgtcgtcgtaaagggcttgcaacagaacgtctgccgctgctccgcccggcggcgcccaacatgacctggtcgatggatttcgtcatggatgcgctggctactggtcgcaggatcaagtgccttacctgcgtcgatgacttcacaaaggaatgcctgacggtcacttttgccttcgggatttcaggcgtgcaggtcacgcgtattctggacagcattgcgctgtttcgtggatatcctgcgacgataagaaccgatcagggcccggagtttacctgccgcgcgctcgagcagtgggcctttgagcatggcgtggagctgcgacttatccagcctggcaggccgatacagaacggatttattgagagttttaacggacgctttcgcgatgaatgcctgaatgaacacgggttcagcgacgtcagtcatgccaggaaaaccatcagcgaatggcgtcaggattataacgaatgtcgtccgcactccacgctgaattatcaggcgccgtctgaatttgcagcgagctggagaaagggtaattctgagagtgaaggatccgacattactaactgagttttgtatttaatcctgggggcaggtcaccaaacttagattgtcacggaagtgagagtcaggtcgcgtgatggcctttacattacgcaccatccggttcctgatttttcaaccagaaatcaaccgatagcacttttatgtatctattacaatcatcttccttaaaaatacgcataggatttttatctttaaggaggatgattgtgaaagtatggatggttttacttatgtcagcgtacctgacggcctgtgctgcacccggcgctgaaaaatatcagactatcatggacagcgttacggcagaaaaagtacaccagattatccgctcggatgtcatcccttcttcagcagaagaacacggggaaattatcagccttgtgtcatctgcttttcttggtacgccttaccaggctgatacgctcatcggcggtcccactacccccgaagcgcttgtagtgaatttcaacggtgtggactgctttaccctagcagattacgtcgaggccctgacgcgcagcgatgacaagaaatcgttcctgcataatcttgcagaggttcgttacaccggagggaacgttgactacctcagccgccggcacttcttctctgactggtttgccaccgcaccatgcaatgcccgggacgtcacgccggatatcagccctgactatgccactgcgtacaaacagcttaaccgtaaaccggacgggggggagtacattccggggctgggcattcattcccgtaaaataaattacattcccggaaaagccatcagtcagcgggtgctcgactttctgaaaaccggagattatgttggcgtctactctccgcttgaagggctggacgtttcgcatgtgggtattgtggtccgccacgacgggcaggtgtggttcaggaatgcctcctcactggcagcaaacagaaaagtggtggattcgccgtttctggaatacatgcgcgcgaaaccgggcatcgtcgtgctgcgggctgagtgacccgcccattaccggagttgttgtatgaaaagaatccagataccggaaggaataaagcctctttgcctgatggttcccctgctgttatcggcggcatgccacaccgctccgcacaggccgggattaaatgacgtggcgactgccggccatgtgacgtcagactatatcgacccgaccaaatcgctgttcccgctgggaaactacccgcagtccgttgataaatggttccctcccggcccggacaggcatgttcccgttatggataccgcggcacagcagcgccacttttctgacctgaaatcccgttattttggtatgggggcgggcgaaaagtctccctggaacccttattacgtcgcatcagtcctgagtaaagggactgaagccgcccgcgacgccagcatcaggaagtatctgggggagcaaagtgtttcctggggcgagaacttcaggatccacccggacagctggaaacagcaggtaaggaataacgcgacgaccagcgtcgaccatgtttatcgcccttcgggacggggaattgccgtcagggaaacgctggtcagggttcttccgaccgccgatccggcttatgacgatccccgtcaggccgggcagggctacccttttgacaatttacagatgtcatctgtccgtcccggcacccccgtctacgtgctggcggccagccgcgacaggcgctggaaatacgctttatcccccacagtcaccgggtgggtgcgcagcgaagatattgcagcagtggatcagcagtttgttaccgaatggctgacgctggcagataaaaacctgggcgcatttattaaagaaccggtttccgtccatgaaggaggacagtattattttactgcacgtcccggaaccattctgccattcaggaacagacagcccggcttttttgacgttactgtacccgtgcgtaaaagcgatggccgcgcacagattcgccaggtcagacttcagaaagatgagtttgtcgccatgccatgggaaatgacacccggaaatatagctgtactgatgaagtcgatgagcggcaggccctatggctggggaaattataacttctataatgactgctctgccgaaatgcgcagcctcatgatgccctttgggatatttcttcccagaaactcagcggcacagatacagtcagtagccaggattgttgatctcagccaggagaatacccgcgcacggcttcgttatctcactgaacatggcaggccgttctccacgcttgtatatattccggggcatatcatgctgtataccggtaatacggtaattaacggacagaatgtaccgatgacataccagaatatatggggactacgaccggcagattccgacagccggagtattattggcggtgccgtctttttacccctgcttgcctcttatccggagaacccgggtctggtgtcactggccggtaagacgcagtttaagatgggttttattgaatagcgggaactattttctctgctgagtgaatattatggtgaccgccgtggcggtcacttattttaggaacatgcgcatatctgactttttatttccacagcctgtctttgattattttataatgttcatcttttaaatcttcatatttccatataaataaccctccaagattaaaatccagcacctgatcgatgaaataatttaaattccattcattcagtccacgtgttgtgagggccaggatacatttcttgttgtcagctccatgctctaacgtgcgtttcagggcaggaataacgttgccggtaatgtcctctttactccacatcgctgaagcatagcagtaatggataaagcggtcacactgacctgactggatgatacctttaaccttttcgttcagttttttaccgttatctgtagacggatgattgtaagaatatccggcaataaaaccaaaactggtttctttctggcatttttttaactgcttcattgcctcaatgacgagaccggtgttcatattgcattcatcatcaaagtccacgccatcccagccccggctttttgtggcttcagcaatccgcaatacttcatcctgatttgaaggttttccttcaggagagcacccacctccgccatagacccagagcgtcctccctttaaaatcgggagtattatcgggtttatcctgcttttccggactccagccggggctggccggcgtccctgttgtcagtccgtcaaggtttgtcaccatgccatacatcatgacgtcgaattctttaaggggtctgccagacagtgactggctccacccacccgtaataaatttattcataatctgtatctccctatttgtatttttccacaagagcataaaggatcgcggcagtttcagcatccagcttaccgctgtaattacaggggcgaaaatgcagctgcagtgcccgtattaactgagcataaccggtgtcacttctcgaacctgaagtgtcgtagccataccttttcagcatttctgttatgttatctttcgaaggtaacgaatagctaaactgctcagcatatttatgctttgtttcctcatcaaaccatgccccgatgcctgctgcgtaaagctctttccacgggaaagtagcaccggggtcactttttcttccgggggcaatatcactgtgtccgacaacattcatgggcgtaatatccggatagcgctgaaggatatttaatgccagttctttgattgcatcaatctggactggattatagggcggaaatgtaaatactccgttattatcggtagccaaattaaccgtctcaatccctattgaggtatcgtttagattactgcgaccgacccacgaactgacccctgcatgccatgcacgttcattctcatcaaccagattaaaaatgcgcatatctttaaaaccggcacctgcatatgatttatctgaagggtccgggacaaggtaatgggcgctgaccgaagaacctgtcagcgcaataatcgagttttcaaaatcgagtgcggtataatgcattatcagaaaacggacgcgccgattaaaacctttaacggagcgataactattataatcaacctgatacatacagactcctttcatatgttgtaatttattactatccacattgacagatgtcggttcacccggatgagttcataaaaaaatcagctattgtgatttatatcgcaatttaaatcctgaccaccaaaaaatgatgctggtcagagtctcttcttactacttattattcccgttgtcagtaagtctctatggcttaatctattcgactgccgatacgcgcaagcgttcggtaaattgttggtctcgatactgaaaacagctcagccagatcgctgattgaatactcaccggttttatgcatccggcataactccttctgttgtttgtcagacagctttggttgtttcccccgcaatttcccttttgcgcgcgcaatagccattccttcgcgggttcgcagccgtatcaggtcaccttcaaactcagcgaacgtagccagcacgttaaagaacattttccccatcgggtctgccggatcatagaggctggttcccagagcaagcttcacacctctgagttgcagagcgtctgcgatctcccgggcgtcaggaactgaacgggccaggcggtcaagcttgggaacaaccagcgtgtcaccactacgaacagcggccagcgcctggtccaggccaggcctttgccggttcgaaccggttaggcctttatcgatataaattctgtccggggagacgccgagttttaccagcgcttcctgttgtgcggttaaatcttgcttatcagtagaacaacgggcatagccgatccgtatttctgttataaatgtgtacgtttaaggggccatgaaagagattgataccgtaccagctatatgagacaacgtcagcagtgattttttctaaatagctgcgcggaatagtagatcactttgagggaactcagcccggattgtgcgatctgatcaatcgtcaaaccaaccaaaatcaccaaccggactgagcgatgccgatcatagcaccaattccccgtgacgaaagacgcctgatgcagaaagctatccataaaactcacgataaaaattatgcccgcaggctgactgccatgctgatgctgcataggggcgatcgcgtcagcgatgttgccagaacgctctgctgtgcccgttcctccgtcggacgctggattaactggttcacgctgtcgggtgttacaggactgaaatcattgcctgccggacgaacccgtcgctggccgtttgagcatatctgcacgttattacgtgagctggtaaaacatgctcccggcgattttggctaccagcgctcacgctggagtacagaacttctggcaataaaaatcaatgagataaccggttgccagttacatgccggaaccgttcgccgctggttgccgtctgcggggcttgtgtggcgaagggccgcgccaactctgcgtatccgtgacccgcataaggatgaaaagatggcagcaatccacaaagcactggacgaatgcagcgcagagcatccggtcttttatgaagatgaagtggatatccatcttaataccaaaatcggtgcggactggcagctgcgcggacaacaaaaacgcgtagtgacgccagggcagaatgaaaaatattatctggccggagcactgcacagcggaacaggtaaagtcagctacgtgggcggcaacagcaaaagttcggcgctgttcaccagcctgctgaagcggcttaaagcgacgtaccgtcgggcgaaaactatcacgctgatcgtggacaactacattatccacaaaagccgtgaaacacagcgctggctgaagcaaaatccgaagttcagggtgatttatcagccggtgtactcgccatgggtaaatcatgttgaacggctatggcaggcgcttcacgacacgataacacgcaatcatcagtgccgttcgatgtggcaactgttaagaaaagttcatcattttatggaaacggccagcccattccccggaggtaagcatgggctggcgaaagtgtagcggtattcggcgcagctatttagggtacataaatgtattttcactgtccgttgagcgatcctcttacggacatgattaatcggggtaaggatgacaacgcgtgacaaagcgacaggcaaaagttaacggctggcggttttaaatcgtgccgagcaggaagcgctgtatggccttcctgatttcgatgatgcacagcggctggaattcctggctatggatgaatctgaactggcgctggcctgtagtcgtcaggggcttcatgctcaaatttattgcatccttcagatcgcttactttaaagccaaacacctgtttttccgcttcggatggaatgatgttaaggacgacagcaactttgtcctgagccgttatttccagggtgagtcacttcaggatcagcctttcactaagcacgaacgctatgctcagcgcgaaaaaatatgcgcactgtttggttaccgcccgtggtcatcttcgctgtcttcacagcttgaacagcaggccgcccacattgtccaccgggatgtaacccccggttttgttgccacggagctgattatctggctcaacgagcataaaattatccggcccggttataccacgcttcaggagctggtgagccgggttctttctgatgaaaggcagcggctggggcgtattctgacggagcgccttgatgacgccaccattgccgatctggacaagctgattgagcgcgatgatacgctttcccggctcgcgatcctcaggcaagatgcgcgtgactttggctggcgacagatggttcatgaaagggaaaaacgggcaatcctagagccgctgcatcataaagcctgcgacatcctgcctgcactgaatatttcccaacaaaatctgctgcactatgccagcctggcaaatttctacaccgtttacgatctccgcaatctgaagcaggagcaaacccacctttatctgctgtgttatgcctggatccgctatcggcagttcagcgacaacctggtggatgcgatgtttttccatatgaaacagcttgaggatgagagccgcagcgtggctaaacagcttatggctgacgtacaggaaaaacaccggcgagaaacctctaaaattggacgtctgctgtcgctttacgttgacgacagcgttccggaccccaccacctttggcgaagtccgccgtcgcgcctggaaaatcatgccccgggagacgctgaaaaccaccgcacaacgcatgagtgtgaaacccatcagcaaactgtcgctgcagtggcaggccgttgacggtatgacagcgttaatccggcgtcacctgcggccgttatatctgtcacttgacctcaccagtgtggtccaggacagcccgtgggcggaggcgctgagctggctcagaacggtgttcagcaaaaagcagatgcttttgcagcggccacttgaggagtgcccgcaggaaacgttaccagcgcggctgcgcccgtacctgctggaattcggtgaggatggtgagcccacaggcctgaatgccgggcgttatgagttctggctctatcgtcagataagaaagcgttttcaggcgggagaattccacctcaacaatagcctccggcaccgccatctttctgatgaactggtaccggaaggggaacaggccgcagtgctggctgaaatgaacatcccgttcctgcagaagtccattaaaacgcagctaaaagtactggcatccgagctgcaccggcagtggaaggcatttaaccgcgagctaaaacaggggaaactaaaacatctggaatatgataaagaaacgcagaagctgacgtggcataaatcggtggtcagccgtcataaggcgcagaataagcgtttttatgagcaactaccattttgcgatgtgaccgatgtcttccgctttgttaacgggcagtgccggttcctccccgccatgaaaccgctgcaaccccgttacgccaaaaaagaagctgatgcagacagcctgatggcggccatcgttgcccaggcgatgaatcatggtaaccatgtgatggcgcgaaccagcgatatacctttccatgttctggagaccacgtacgaacagtaccttcgtctggcgtctctgctcacggccaatgactgtataaccgatgctatagaagcgctacctgtttttccgctctattcgtttgatccggagacgctttatggcgctgttgacgggcaaaaatttggtgttgaacgtccgacagtgaaagcacggttttcacgtaaatattttggtcgtggtaaaggcatggtggcctacacgctgctgtgcaaccacattccagtcaacggatacctgattggcacaaacgactacgaaggccatcatgtatttgacatctggtaccgcaatacctcagcagtgaaacccacggccattaccggtgacatgcacagcatcaacaaagccaactttgcgatcctgcactggtttggccttcgctttgaaccccattttactgaccttaacaaacaacttcaggaactgtactgcaccagagacacgtcagcatataaaaaatgcctgatccagcctgccggtcagattgacctggaccttatcacccgcgaaaaaagtaatcttaatcgcatcgtcgctacgctggggctaaaagaaatgacgcagggaacgctgatccgtaagttatgtacatatactacggccagcccgacaagacaggcggtatttgaatacgatcggctggttcgcagcatttacacgctgaagtatctgcgtgacccgcaactggaacgcaatatccgtcgttcccagaaccgcattgaatcttatcaccagctgcgtgcagcagtcgccaaagtcggcggcaggaaggagttaataggaaaaaatgacattgaaacggacatcagtaatcagtgcggacggttgatctcaaacgcgattgtttattacaactctgcgatcctgtcacgattactggaacggctggaagccgaaggtaacgaaaggggtattgaggctctgacccggatatcgccggtggcctggcagcacattttgctgaacgggcattatacctttcagaacactaatgaaattattgacctggatgtgctggtcgccgggctgaaactggggcaacggaaatttcggcggttccggcgtagaacccctaggtgtttcattgataaatacctgtttaagttgttcgccaaacagcccctcagtcttgcctaaggtttcaggatttatcaccgtcttacgaactgcagtggcaggccgtggacggtatggctgcattaatccggcgtcacctgcggccattatttttgtaactcgacctcactagcgtggtccacaacagaccatggtctgaagcgctgaactggctcagaatggtaactgccacgataatgcgcttgcagaaagctttttccagttgttgaaacgcgaacggataaagaaaaagatctacggaacgcgggaagaagcccgcagcgatatttttgattacatcgaaatgttttataacagtaagcgtcggcatggttctggcgatcagatgtcaccgacagaatatgaaaaccagtattatcaacggctcggaagtgtctagattatccgtggcgattcaactctcagagtcaggtcaaggttctcgctggcctgttccatcgtctgacgcatgctgttcagctggcggcgtatagacagaatggttttaattgtgaagaagcccagaataagaatgacagccccagagcccgcaatcagtccccacagggtggtatggtaaatgcgggtattggtttccatccagctgggtgccgatatcgatatttatctttaactgcttacggtaactggaggtaagcgtccggatggcttcactgagctttttgctgctttcagcggagtccactgccggagaagactgaggaaagcggttagcctaaaggaacggcgccaacaggtcatgaatgtttttaatcatgacgaacgcatcttttgtaagctgcaggtcttcatcgctggagatatcgttctcaaggtaatgctggttaagcttattaaggcgctcaacagctttgttcatatctgattcgatttgcacctgtcttgcaggctcttttatgccctggtaattgtaaattttaataagaagctcgttgttttcatcaatcagcgttcctaaatcgatgattgaaggtatcgcgttaatctggacatagtggaatcggtactggaaacccgttactaccacgatggcaataataaccatggaaaccaacgaggttgtcagaagagaaaacgtaagggaaagtcgctgtgtaattgtcatggttcaccctgtgtgtgttttgtgaaaaaaaacgactggcctttattaaatcctcgggagaaaggaaaacttgatttttatgtgaaaagcctggggaggttatgaaaatcaggagatgaccagaggaaaaagtgtattgtccggagataaacatgaatatgcgccaggtcagaccgatggatgacaaagcattcataatgctactgtgctaaagatccactttaccctcatagcggccgttgcgacacaaaggtccgctccgtgccaagaacggacgttgctaacatcagtatgtactaacctgctgggagcaggtcatatctgatacggattaaacatacattctttgtatcaaatacctttcaaattgatcaatttttaaatgaaaatattaaaacttctcaactcaactcatcacactaactcaactatacatcaatcaattgatcgccaatgacgatcagtattcgtcaatcgataaataagactgactaatatgattctgatcattttttcaaccgacatgtagttgcatcattttcctgctggctgcaatagataaaggattcattaatgtatcagaagctaattacggagaaaattcagccggagatacttatggcactggcaattgcttacccatatccactcaccggcaagaaatactttgctgcttttggtaagtacagcgaatcagtaatgtgtgaaaacatcaatgcattggtaaaacgtgggctggtaaaaaagacagcagttaaagcatgtggtggtgtcagttttgtatcactggctgagctgacactggatttcggaagtgttggactttgatatcaccgaaaccaaagactgctgagtgcctggaaggtgccgaatatttatacagcatatcagtttaaacctcacgcgagtctgcaccaagggttcaggaatttcatttcaatcaggaggtagtaagttatggccgataaaattttgtcagtaaggttacaggaagacattctcagcgcactgtccgttttctatccagaatcaatgactacaaaacaatatttaagctgcttcgatgacgttgatgaatttgtcatgataatgaatatcagtgaacttattcgtcgaggcctagttcatcagaaagctatacgatattgtgagggagagcccttcttatgcctcggttatctgaagctggagcccaaaagatccgaaatggctatcaaaaaaaattctgacaacataattaaattattttagcacgatttagtaagcgctaagtgagtttgcatagaaatgcagtaatgacttaagaatagcttataaggcgttgatgaatatggtcttagcctttgttacctggtgacagctcttagctaccgtattaactgggaaagatgccatgagaaatttattatctgatgatttgcagtgggatattattgaagctttagaagaatccccccgtcaccttgcccttgatgagttcagggaagattttggtgaggtggatgcttgttaacatcatccagcttattgaggatggaattatcaatcataaagccgttaacaggcgattgaatggaccaacagtaaatatcgtagcgctattactgacgcccttcggctgtcagtctgcctagccataaaattaacctgcgtcgagtagcctgctttcattgatatatcaatttgaaaaccatgcctggactcgtcttcgaagttgacaccaagagcaaattcgacaacaagtttgggcattcttcctgcttagatacaactgtagttgaaaggacgttaccgatagtttcaccatcgacggtcacatctaagcctacaaatacatcaccaccataaattctgacaatctgaataggtttactcattatcgtttacctcgcctgatatggtctcatgatatgcctcagatgaagcctgacactcaggctcaatttcctgaaatgctcgggggctgattaaacggcttcagccgattatgctgcaatgactttatcctgacagttgtcgatgttgtgcttagttactgcagattgtcgacgtaggtttccaccaggccttcgacttaagtcttatccgcatcaatggccgcatccgccagcatctcagctatacccagtgcctgtccgacaaaggctgactgaatcttgttaaagttgttgccgcaggcggtgcggaccgatccttcattgtacagggtcgggtggttaacgaaatccgctgcggcagttgtggaatcgtctttcgtgggacctgtgtagatggcggccagaataccgttgacaatggctttactgcgcaactgggtgatagtggcttttttgatattgccggtgataataatggtgctctccttaaggggattgcgggttaataatactttcagccctgaaggggctctcatggtaaaaaccttaatggaatgacgatagtagttattaaacgaaacaaagttgatttatatcaattcctagacaactccatatttttttgttgttctaaggtttaacttcattagctgataatttatgtcgtggtgattaacgacccgccacttttactgtcgtatataggtgtatcatatttttaccatatattggttgcgcccttttagggcgttttttttgttattactccaactttgaggcgttaacttccttcctgcaggctttgcctcaacagtgccaccttatacaggcgtgacagtggttttttttatgtgccgatcacctgactttcaaatttaaccggcctgactgttcgcatccatgcgcagaactgtacgaaggcattttcaacgctgaaaggcgcctgtgtaaaactttgcccgttaatttcgtcagtgaagatgccagatgtataacccatcttgtatatgccgtcattatcagtacccgttatcgttgtggcccactgaccgccgggtgcattcatgcaactttttatatgagtggtttagcaggtttgcggcctgaaatgtaaaggtgttacttcctccgatcgtaccgggtacggtaccaatcgctaaaacgtgggtatcaaagtattcggacaggttcttgcgcgttgagcacggaaataatgtgtttggatttaactgattacccagcagcatgacgaagccgaccggaaaagggcagggtggcgggttgtttgatgagtaaacacgaacattcccgcccgattaatgaacctccgtcccggcaacaatgttaccaccgcctgcaatggaatctccgtcatgtggcttgaaataccacacctgcgacgtgccgttgtcaccgatgacgtggatataggcctgcgcaaaatccgcgttgcctgaggtcaatgcaccaaaacttatagaggtaccgtaacccagcccctgggccactatttacccttttatgattctggggtaggcgccctcgaagtagatctactcgcgcagccggtgtacccagaacctgattatgtcgtggccactctaatccttcccggcaaacaacgcatcatcaccggcgcccagctcgtgctgatattcagagtcaaacgtgccgtgccgtgaccgtcgcgggcgcggatggtcatcagggcgagcagcgggcgcgagacacaatcggcccactgcgccgaaatgcgtttctggtacattggcgctttcattgcctcggttctgctggcatattctgcgacagtctgcggttcgtggcgcacaaagacgcatccatcacgtcacctgtgctgttggggaggacagtgaggaagactgcaacgcgcagactttgcttgtgcgctatcacccggatgcgcccctgactggcgctgtcccaccggcgtggtgctgatgagcgagtcctcacatccttttctacacttagccggactaccggcagggaaaaagccgttagtggccgggctcagctattgttctgcgaaaaaccctctgccgttataacgctgaaccagttcataaattttttcttccagcgcttcctttagcataacttgtcacctccccaggcaatccattctggctgcatatcctggcaaccggcagatttttctgtaaattcggaaggcgtcatccagcccagtgcagaatgggaacgactccgattatacgctgagtttacagctatcgcaggatccacggcgatcttagtcaagtgtgcagcaaaaccacgttgccaaaattataaggcaaatacagattaataaaagtaaaattctgttaaagcaaccccataattatctcagatttatcattaaaataatgatatttaaatattaaagcattccttattggaatactttacattcaaattattcatttttataataaccaaaatatcaatatattatctgcaacttacaaccattgttaaaagtgtaaattacaaatgtattttagagtaaaaaagcagaaacaagcatatgaaatatgtcagcacttgttgaatgatgcgggagtaaaaataaatggaagcaacccttgggatattaaggtaaaaaacccaaaattttatgaaagatgtttgcaagatgggtcacttggattaggtgaaagttatatggatggatggtgggattgtgataaaattgatgtgttgattagttcattaattgattctaatataaagtcatcgttttcatttaattttaaagatttactcagagttactgccttaaaattgataaacttgcaatctactaaacgagcatggatagtaggaaaacagcactatgaccttggaaatgacttgttctcagaaatgttagacccatggatgcagtattcatgtgcctactggaaaaatgctacggatcttgacatggctcaagagaataaattgcaattgatatgcgaaaaacttcaactcagaaaaggcatgaccttactggatattggttgtggttggggtggtctggcagagtatgcagcaaagaattatcaagtaaaggttacgggtataactatatctaaagagcagaaagaattagctcaagctcgttgtgttggtttgaacgtcgaaatccttttaatggattatcgtgatttggataaaaattttgaccgaattgtatctgtgggtatgtttgaacatgtggggccgaagaattaccaaatctatttcgagatgataaatagatgtctgataaaagacggtatatttttacttcatactatcggatctaataaaagcgatttaaatgtcgacccttggattaataaatacattttcccaaatggatgtattccttcagtagctcagatttctttggctagcgaaagatctctaataatagaggacttgcataattttggctctgattacgacctaacacttatggcttggtacagccgttttaagtcatcttggcccaagttaagtaagaaatacagtgaacgttttaaaagaatgtttacgttctatttaaactcttgtgctggagcctttaggtcaagagaattacaacttcttcaaatttgttttactaaaggtttaaaaggtgggattattgtccctcgatgaaggggggttatttatttttgattatggaattaatcaaaaacattaaattaagcatgcaaaaagtacttgaaataataaattttgcaaaaattaaacattaaataaacccatgctatttagagaactaacacagggcttgggtttaaaaaaacattacaggaaaatgatatgatagtttcatctcccaatgattatcgtgaagcagccagccatcggttaccgaaatttctctttgactatattgatggtggcgcaataactgaaagcacaatgaaagcaaatatgctcgaattagcctcattgtctcttcgtcaacgtgtgctaagcggcgtaggcgatccgaccatgcacactgaaatatttggaagcacatggacgatacctttagctttaggcccggtgggtgcttcaggaatgtatactcgtcgaggagaagtgaaagctgcatgtgcagcatccaaaatgggtataccctatacgctttcaaccgtttccgtatgctctattgaagaggttgcgtctcatgcttcaggggaagtctggtctcagctatatgtattaaaagatcgcggttatatgcgtaatgtgcttgagcgttcatgggcatcaggcgttaaaacactcgttttcaccgtcgatatgcctttaccagcatctcgatatcgtgataaccgttcaggtatgtctggatcacgatccaaaattaaacaatacctgcaggcgtgcacacatcctcgctgggcctttgatgttggtctaaaaggcagacctctaacgtttggaaatattgaagcttacgttggtaacaggatgacgatggatgattacatgggattcataaacaaaaactttgatcccactattacatggcatgacctggagtggatccgcgatgcttggaaagggaatcttgttataaaaggaattcttgatccagaagatgcgaaggttgcggtcaggtttggggccaacggtattgttgtctctaaccatggtggaagacaactcgatggtgcaatccctacagccaaagcattaccgaggatagttgagactgtcggtgatgacattacaattcttgttgactcgggtgttcgttctggcttggacgttattagaatgctcgcattgggcgcgaaaggagttctgctgggacgatcttatatatatgcgttggcagccgctggagaaaaaggggttgctcatttactccacctttatgccgaagacataaaaataacgatgactttaatcggtgcagcatcgatagcaggtattaataccgactgtcttgaccgcttagagaaagaaaggactaaaatactctgaggtatctattaaatctgttgacctgctccccgttgattaatacaccgcgatgtcagtaatgtcttcataagccacatgaggacatccccatgaagaagcgtttttccgacgaacagatcatcagtattctccgcgaggctgaagccggcgtttctgcccgggaactctgccgtaagcacgccatttccgacgccacgttttatacctggcgtaagaagtatggcggcatggaggtgcctgaggttaagcgcctgaagtcacctgaggaagagaacgccagactcaggaagctgctcgccggggccatgccggataaggaggcgcttcaggtggctccttggcgaaagtactgacgacagaccagaagcgcgaactcgtggtgttgatgtgtgatgcgaccggtctgtcgcaacgtcgtgcctgcagactcacaggtttgtccctgtcgacctgccgctatgacgctcagcgtccggcggctgatgcccatttatcagggcgcattactgaactggcactggagcgcaggcgttttggctaccgccgcatatcaatgtctatgcatattgataatgtcaccctggtttaccatttttaaatgtcactttcggctgattctgatgaagagaaaagggtagttagctcattttttcaggctggatttaaacagtgatggttcagccagaaccggattaattgccctgagctgtgcctgaatctgcgcccgtcttttgggcatatgacgactgcgctctctttttcctgcggcttccagtccgtcctgcttttcctgcgccagcttcagcaccgccccaagccttttattgtcaacaatgcgtccctgactgatgcagtccagcttatcgaacacctgatattccagcgttctgctgccgtagcggaatgacagcgtgccgtccgggtagtcaaacgccaggattttttctccggctatgcgtgtgttttcctcagtgggttcaaccagatacaaaatcttatcgtactgaaaagtcagtgattttgagagcgtacgcagcgtctgccaggcgaatatgtcatccagctccgggctgctttctgagacggtgcggtgcaggtttttggggtattttgccggtctggcaaagcggcggttgaagtcgctgatgaacgtttcaatccaggcgttggcgttatcaatgccggtgatgttctccagccgcatctccttaaccagccggtcctgcatcgtcagattggcgcgttcgacacggcctttggcctgcgaactgttggcacagataaggtcaatgttcagatcgtgtagggcgcgtccgaactgcgttatgccagtacgtcgtgtttcgcctgactgactcggaacaccgcatgtttgtcactgtaaaacgccaccggcttgccgtgtttatcgatgtagtcacggggggccaccatgtaatcaaaggctgactcactctgacagaaacgcaggtgcatcagacggtcggtcgcgtcgtcaacataaaccagaaggcagcattttggtgcgcggccttcgaaccagtcatggtgtgagccatcgatctggataagctcgccaaggcaatcccgccgcaggcgcggctgataaatccgggtctgacggcgagcgtgtgggatccagagtccgtccgcagtcatccagcatcgcagcgtctcaacggaaatcgtaatgacggtgaagttctttgttcgacatggtcaccagcatcagcagagatctcccagaaaaggtggtaaacgcgccgcatctgggtgacattatgaaccagctaaaaagtgacattatcaaattggactctcatcaatatacgcataacattcattatgttaaatagattcccatataccgagacctgcaacagcctaaaaatctaatttttttgttacatcacggttcatctccaagcttgcctactgaaacaagcatgaaactccttaattacgtggcgatttacttctttagcattctcagagcttcgataatggcttcatcaatatgtacatttttaccacctgcctctgacttaaaaccctctataactgaagtcaggacctcataagcgtttcttttttcggaaacttcattcaaaccagctaccaagctgctgatcataatttgattaaaaactttatgagtttctaaatcatgctttagcttatcaacttcgatatctagttgactttgcttctgagtattttgttgtggattttccataatagcctgcctccagaggtaatcagccatccctcatttttatttgtatcttttccgaaagggaatatctcttcatagttctatgcattccttggctgactagaaattacatatacatacaataatgcatttatattgaagaaaaaatgatcagcatcatataagttatacttaaaaagtatgtgattaaatagccatatatagcggtaaccgagacgccagtgctaagtgagaaacccccctgtttgccactattcggtcaagcactctcacggcctgttgagccggggatattcaggtcgatttcgatcgccaccgcttcccggttaaaatcatccaccacattttaggtctggaagcgtctgccgcacaccagcgcatcgtgcataaaatcgatggacccgctctggctcaccgcctctggcgttgcaagcggagcaggattacgcaccggcaggcgctgttttcccttacggcgaaaattaagtttcagcaggcagtatatacggtgaactatttttatggttcccgattgtgccctgccagcgaactacttgaaaaagcattttgaatccgtaccgcgaatagtgttcagccgccacggtcagtcccagaatcaccggctcatcacgtcgcgtatccagctgataacgaaataccgtcctgctcagcgacaatgtccagcatgtctggcgtaagctcatggcaaactgcgcggtcagataattgaaaagctcacactttatcgctggttttaaagcttttttcaataacgtcttacagtgcgctgcacttgaaactcaggtccgcaaacatctgtttcaatagacagttttcatccttttgatatcagaggcttcaataccgccaaacttcgctttctgttgtagttcgaggaatccgagatcccggcctcgcggcagacatccttaaacagaaaatttttttgtagcgcagtttaactagctattacaacagaatatttatctaatcaaatggaggtaaccttttcacacatttagaaagaggtttatctatgaaaaatgtaaaaacttttataatttttatgttagttgtattaacttggggcacaacgtggattgcaatgaagattgcagtcacaaccatacctcctcttatcgctacaggtatgagatttctttttgcatctccttttttgattctgctttgcaagctattcaaagagccattaatctatccaaagggagagagaatatatcaaattatagttacattgttctatttctcagcacctttttcgttgatgatttatggggagaaatatgtaaaccctgctgtggcagcaataatattctccaccatgccagcaatgatattaattacatccattatgtttttaggaaaaaaaaccaactgcatgcaagtaatgggattatcttttgcgatgatctctttattttttttaatatgtaaaactactaacatgactacaccaagtcaatttaagggagtgattgcacttttatttgcagcattagcacatgctataatatatacattaacaaaaaaacaaaagaaaaaagtctctgtgttaacttttaatgcaatcccttgtctaacttctggttttttgcttatagctttaggatgggctacagagttagctaatttcagccatttttcaaaaatatcaattatagctaccttttatcttggagctgttgccggtgtgtttggcatcttgtgctatttttacttacaacaaaaacagcgccttttaaagcatcactggctttcttggttttcccattggtagctatagtgcttgactgttatttctatcaccatgaattttctatgaagactggatttctactaattccgctattcttgggagtaatggccacgacatattttgattctatgagtgtaattaagaagaaataaggtttgtgttatgaattataaattgaacgaaaagaataaaaaatataaaatcaataaatcggagttccttagtcgtttagttgattatcgttttaatgaaacaaaagatattgtgaattttttaaattttttttgcgaagaaaatattgatatttgtgattatttatttatacgagccaagttagaattgtgcctcaaaaatcacgataacatgagtgactattttatccctttgaggcaagtagcaacagaacttgattgtcttatatcataaagtttgaaattttagggatttcagccatctgccgcaaatcttcctgcatcaggtaatttaggagatcgtggaggtgatcgccgttatattcatccaaccagtgctagataattttctgtgcataattaagtgttcggaatagataaaaatccagtatttttgtccggtatgtccgtttgaacctttagatcaaggcattctgcattggcttaccgggcctgataaatgatcttactcacgtaacaacttagcagcaaccttttgcgctcatatttcctcgaagattatgctgcttcagcagcgcctgataacctgctgagcagttctgcccaccacgatctgtgtacacgatgccatgttccgggtgtttacgccggcacagcgccatctgaagctcgtcgctggccagctttgctgtcatttcgtgaagacagtgaccagccgataatggcacgtgaccacaggtcgatcagatgcacttgccagcggccgtcggattaagtacaaggcctacgggggtgattagaaatgaaacaaaccaacaatactaaaactatagttttatctaacaccggaggaagatccatctccccaaatccgccttttattattttttttacattttttctgatttaattttttttataggcaattgtgtcgtagctttaaattcttccatcgcaaatatagttttcacatcctttataccgtttgtttcatttattaattttttgtaaaaatcatcgtaacttttcatgtcttcaactgtgacttttaatatgtaatcatattcaccagcagtcctaaaaaagctcacgacttcaggcatgtctttaattgaaataatgaaacttttataccattcaacggtatgactttgtgttttaatcagaacaaaggcaaccaaatctagtccgattaaattcctgtctagaattacaacttttttttgataattcccgacttctcgagtttttttattctcgcccagcatgctgttggagacaaagaaaccatttcagcaagctcaacaacaggagttgctgcattgaactgcaataagttaagtatctctaagtcttttttgtcaagcatttctgataactcctgttagattttaatagaggcgttttctacttagaaaataatcggagatccgttccccttatattttcagccgtaaaattcatttagcagatataactgctataccggaaccactgaattaaccatctttaacagacccttttgacttcagttcactatttataataacgtaaatgcgcatcagccgccgggcgctgcgcttcgtaccggcgggtcgacagggacaaacctgtcagcctgcaggcatgacgttgcggcagaccggtcgcatcacacataaactcaacggcttccccgcttctggcctgtcgtcaggactttcgccccagagccacctgaagtgcctccttatccggcatggcttcgtccagcagcttcttgagccgcgcattctcttcctcagtcgacttcaggcgcttaacctcaggcaactctataccgccatacttcttgcgccaggtgtaaaaggtggcgtcggaaatggcgtgcttacggtagagctcccgggcagaaaccccggcttcagcctcgcggaggatactgataatcttttcgtcagaataacgcttcttcatggggatgtcctcatgtggcttatgaagacattattaacatcgtggtatgttaatcaacagggagcaggtcagtatctctattgcagattaactatgtggcaccagacttgagccgccgcgcaatggggaaatacctgtatgcctagcaatttccacttcatttaagttaatttttaatattcaccaccccctcttctcatagggttaaccctgttaaaaccatcttattctgataaaaaaagacatcaggtttgcctgaaacccctcatctctacttaacttcaaaaaaatttttggatatactgaaaaaatccagccctttaaaggctgggtatttaatgctgttcaatgacaactttcttgatgtcctatgtgtgagcctaccggcatcaatgtatcgatgctggctttggtggtggtgaatttgtcatagaataaaaaactttttgaaagcttattaactttaaataaagttagtataaatctcagatgcaggagaaatactcatacaagatccataactctctatttatggagcttatcaaataaattcagttgtgcataattcaagggtctacataattttatagctaaatagacgttaaatacatcgacagtcattcaagctacaaaccgcagtaaaatacaaaacttcaaatgttcttttacataataaatattactagcgagttttcatttctgaatgtacctctgcagaggctttattaattgcttcctgcaaaagggattgactggctccaccaggaataattgtaatattttcagttgtagcgccactcacaggcatcacaataattgctggtgtgccttggagtccaagcttttgtgccagctcatcggttcttgcaagttcttcaatgaccttgccattcttttcgttacttcctcccgcagcagcaatatccattaacgttaaattgccttcattatgtcctgatgcaaaaatagcattgtgatataatagataagcgtcacccccttttttttgccatgctaacaggccagctttcgccgctgtcagtgaaatcttccagcgctgagcaaagataggccattccttgaatacatatcgaacctgtggattattcttcattaatttttctaatatgggtgactgacgggcacaaactatacattgatagtcaaaaaactcaattaaagcgacctttgctcttttaggaccatatgatggactatcaatgtcgttaagaagaaaattgcggttttgaagtattgcgttgctaatgattttgatttgtcgttgaagttgttcttgctgcagttttttactgacttccaccagtactcctgggttagataacaggtatgctttagctacttcacctatgtgtgcatccaactcaggagagtattttgaagggatgctgtaagcagaaaaggaaattccgctaatcaggcatgaaaataaaatcgcagccaaggtgttttttttcttaaacatttttcccacttaaattaggttgtaattatgttgtcgttaacaaaatctgtttataaatcattttggttagctttaatcattgcttttgagacggatgccttaattacaccgggattcacatatccgggaatcaccgtcatattatctgcccccccccctttggttggcattataataaccgcaggtgtgccggtaaagccgagctgacgtgctaactcttcagttttttgtagttcatcctccacgttggttaaattaacagaactgtaaccaacagcttttgcagttttatggatatcatctactgtcaacataccttcactatggcctgttgcaaataaactgtcatgccatacatgataggcgtccgctccaagatttttccagacgctcaaccctgtccgggcagccagaagagaattaccccaccggtttttaaatatcggccattctttgaaaacaatccgcacttgaggattgttttgacgtaaattttcaagatctttagccatgcgagaacaataaatgcactgatagtcaaaaaattcaactattgttacttttgcatcagtcggaccatatgatggactatttttatctcttataagagactcttgatttatcaaaactttctttactagattaggtcggaacttgaggtacgcatcagcctgctccattattttcatatcctgcactgtctcaccaattgaattcaaatgcgattccgcattgaccaatccagattgacttaaaaaccccatgaatgcgaaccaaacgtataatattttcttcataaaaattctccattcaaaaaactttcatcttcgttatttttttctttaccttattttccatttacataattttaatggttttttcgactctaaagatatagatatagatcttcaaccatcttacttcttaaggtaagattttagtataacttacattcaatctgggccttgtgtaaacccaaatacctcgtcatttatcatccatttacgttttacttaattaaatttaatagacagtaaacaatccatttcgtttgacgggctttccgaagaaaaaaatttccgttattggtcctgtactcataattgcgctacgtattttgatggagatggttaccaagcaaggcctagtgtaccactcccggtcaaaaaactcatttaatataatcagtcagttaactacacgatgcaacttgtaataattaataaatcgataacagaaggtgattacagggccatcatccatttcgaaattaattacttctgatgaaataatgttacggtaatttattttttctgctggtgataacatggacttcaatactggttttttagatctaaaaaagaaaattttttatagcatttttatcatgcgggcgaccagccccagcctcagttacaacgatcagtcagtaatgtcggtttgattaccgtctaatttctgtttctacagcctactgaaaattcagatggtgtctggtaattcttcgaaatatgtgtacgaaaatggttataatcctgccgacagtcattaatgattctcctgaaaagacggccaagtttatgaaaagttcaggcttattatgagctggactgctaatataactaactggtacgaatactgccttatgtagaatgcagattacaatcgctcattccatatgtgtattgtattccactgttctgacctagaaattttctttatactttttttaaaaatatttacacctcccacaaaaagtgcataattttacccgaagttcgggcttgttataaaagaactgcagaattcaggattacactttactttaattcggtaagattattaatcaaaaaagtattactttctaggttaggtatattagcatccataacccgagcatcgtgcaagaaaactttcaaattaacacgaatgcaccggggactctgtgacagtcttttgccgtaaaccagtccctagtcagcgcaatctctccagctaccgataacacgctgaagcgcctcgacgacgcccttccccttcttcctgtttggcattgctattccgcgcagtgccaggcatccagccaagagtgcctggacgcccccgccctgcccgcctttttcagtttctcctttaccggcagggggttagcctcgctgactgtgcgcgaaacggcgcggatgaccggctttttatttgcgtccaaccaggttattctccgtatacgggagtaaagccggaaaaccgatccacagaggatccggcgcggatcgatttattctcatcgaaaaccctttacagatgcgtgaaaatacgttccacacccgcagacaacggagaataaaagtttgggtactttgccccgcgaaatgacgcagatttcacacagcgacgccagtggtcacaatatgaacagttcaggtgctgcacgctattttgactatgaaagtgcggtcgcgctgcgaaacctggcggccgcctacggcaccgacatgccgcgctacctgctcgcccccgaggtggccgtgctgctgttaaaggtgaccgatctccgtaaacgcctgtttattgataccctgtggaacaccggcggccggctcaatgaaatactgccgctgacccggggggattttgcgctggacgatccgctgagcggtgcgccactcgtttcaccgtttgtggtgctccgcacgctcaagcagcgcaggctggaggaatctgccggcagccggtcccgtccccgcgggcgcccgacaaaagaagaacagcaggctgagcaggagacgcaggcgaagatacgcgataacccgccgcgggccgtgccgctcaccgatccggccttcgtccggcggctcagggaatggtttgcgaccgcgcagcccgccgccggcgcacggctctgggatatccggagcgaagacaccgcccgcagctggataagtcaggcggtggaggccgcaaagcgtgacggtgtcacgtttaccatccggccggtcacgcccaagacgttccgggattcgtttgcgatgcaccttgttcagcatcaggtaccgcagaaggtcattcagaccctgatgggccataaggatgcgaagtcgaccgaatggtatacgcgggtctttgcgctggacgtgacgcgccagctcggcgtgcggttcaccatggatgccgatgaggccggtcggctgttaatgcggttatgatccgtggcgggcgattcctgctgcctgaatgaccgcagaagcgtttccggcacaaaccagatatggccacgggcgcgcgagcaggcgacataccgtttgtttcgcgctaacggcggcagatcactcagacggcggcgggtaagaaacggccagtgcgtgctgcccgacacagtgcagacatcattaaagttgtcggggccttaactggtcccccggttcattgaaaaacagccgtagcggtgatgctcacggtaaaacagtttgataatgccgtcatcggcgaaaagcgccgtcgcctgctcatgatcattcacggtttcaatccggtctgacgggatatgtgtgctccgacaggtatatgcagatctgatgagataaactcacctactgtctgtgagcagcgccacgttttgctgagggtttccccgtctggcaacatacccgtctctgtaaaacaggtttctggcaggtgatgttatcgtgtaatgtggcgttggtattcccgtcccggccggtgtcgaatgtgtgctgaaagtcatccccggtcagcaatacggaactaccggcgctgcataattcaggtaaaaaattaacatcgtgaccggcgaagccctgtacttcatcgatcaacaacacgtcaacgttccgttcagggcgtgcacggatgtcagccatcattttcctgtgcatcagcagcagggacagacgccggaggaagactcgtcggcagcctcctgtaaataaagttggtgcgaacacggtactctgagtaaaggagcggcaaagctcagaccgcgaagcggcatctgatgctgcaacaggggccggcagcagaaaccatgaagaaacccgaaccacgtcatcacacgggtcccgcccgggatgaaaccaaaacgcttaatgactctggcacgcaggtgcaatgcgctatttcgtgtgtgcgtcaggagcagcgcccgactgtcttcacgcagactgtttctgagaagtgtggttttacccgaaccctcaactgcgaagactacgcgtttatccacgcaatcgcctctgatatatatgcaggtacggtcatccgtgctcctttctccagcagcagaaaaccgccccgggctttaccggcgagcatgtattcctggacgctaagtcgacggcgggtgccggcaaaaacccgttcgcagcgttcagtattacgcggtacacacagatctcaaaggtgtagcgcgaagcatcttcatccccgtacaccttcctatccggacttgtcatgtcggcaaaatgctcaacacacttccgttgacagtcgccgtcattgtctctcagcgcagcaacgcggttgcccggaatatgcgccagctcaaggtagcagcggtaacgtgtaccgccgatagcgacgatgtgcaccccagcctcttctggcgctctgcccgtaagattgcggtaaaacgcgtcggtcagaatgaatccggcatccccttcagccagaatgacccgcagagccactggccggctctctcccggcaaaatggcactccgaagatcggggcgcgatgagatatggctgctgtgcctggacacaaaacgctgcatctcccgttcgggtgccagcgtgttcataagctttttcaggttcacatgactgaggtgatcctccggttcttccaataaaagggcatcaggctctctgtactgttcgggccggggcagggcaaactccattttcacgaatcaccgcctgcctttaccgcgattgcgaacacaaataccgtcttccgtaatatcaggactggcttcgggacgcgaatgcggacccgaacggatgccgaacgggcagttttcgatgccctcgttaatgtcggacagctgctcttcctgacaaagggttttctgctgacgcgagctattctccagcctgtatctttcagccaccggaacgttaacgctgaagagcgtgcgggtgtactcctgtgcaggatggtcgctgtcagttcaggcgctgcccggcagcacaggatgaacataccggctgaagccggcacagggacgtcctgagaatgtcatgaatttcaaagcataatattcaaacgggaaatgtgtcgaaccctgttccagaatgtgcatcatcacctgaccatacttatccaggactggcgtaatatgcattctcagtccgtcttcatctctctgcataagattcagccgtccattcagagcaagattacctgtatcgctgcgtaaaacgtctgcgatgagtcggggcagtgaatcggcgcgacgtacaccggcctgaaaagccagtgcagcctgacgggaaatcagtgattcgaaccggtgccggcttatactcagggcaggatccagcgcaggcagaaccgggcttttacccgacgcattgtcaccagtcagcatgtttttgccacactggtaactcagctgaagagagggaaatgtccagaagtctctttgcataagatgaagtgatcacgggtatcctttctcctgcagacctgccagaacgttattgtcagcaaccgtcagaccatccgtactccgctgatagctaatcagacccgacaggtattaaaacgcttctgttgcatgcttttatcacaggggcttttactctgtatttggatgaaccgggttcagttcataccgcctttcttgatacacctgatttcaatagtgtgatgctcagccagatttgatatcaacggtaaagagcgaaaagtgataaaggaaggagtgagacgctcacttgtattctggtctgagagagagacgcccggaagcgggtgatccagcctgtatgccttaaatccgtgagaatacccgcttcttcagcaactcaggcgagccggaatagtatccacatcctgatgtacttatgcctgatgataatcccggctctctggtcactgacagaaagccgacgtaacgtcggcattactggataaaaaacggcgggaatttcagtctgaaatagtcttaatttattaaattaaatcaatcacttaaaataatatcgttctgggtaaaaatttattgttaattcctgatactttctcacagaggcatcgtcagcagggtctgatcactggtcgtttacagacttaatcatcatgcgatcaatgacgctccggacggcggcatcaagctcagcctgacaggccgcagaaagacgggagaattcgtaggtgacaagacgtttatcagcatcggttttttttcgggcgaactgctttttatcagtaaactccgccagcttctctgtcacgatttttttgctgcccgcagctttgcggggtccttcgctttcagcacgaaaatagcttattatccggttcttataagcaggctcggccatatcatgagatgcatcctcttccatccggctgcgaacgaaaccgactaaagcgtcagtggtgagttgtcttgcccgtgctttatccgtcacttccagcagggcccggtagtcactgatggaaagctcgctgacagaggggaaaaccgcgatgatttcatctggcaccgcggcagcctgaaaagcccgggttaccttggcggccgacagcccttctgcagcggctatctcagactgattcatgtcttccggatacatgagtctgaggcgttttccgagttcacgcagcgtatgctctttggctgtctgaatgtccacggccagttgtctggcatcagagagagacaaggcatcacgcgtcaccagcacctcaaatgcggttccgttgtaaatgcaggcggcacgacgtcgtgaaccatccagtatctcagttcgaccattaacctcgcgtccgatggcaggaaaaaactgctggagccggatggtccgggaaatatcactgaccgattcgcgcgtcagaaatgcctggtcacggccgtttaccgtggcatcaacgaacgtctgcgtttcgatgtcgtcatgcagtatcttggtcaggacaaaccgggcctgagcaccggacctgagggtaaacacccgctcgctgtctgactcgttcatcatttttgaaaaactggaattacccagctgccggcccagcttgaccatttcctttttcatttcacacctctgatgaattcaatccttttaaatacggcctgagtgaaacgctccgcctcacgcttcgctttcttgagcgcctcagcgcttcctggataggaactgggatcggcactcacaatggtgtcgaagctttctccgcagcgttcaaacccgtcaagcctgggcaatgtcgcgtcaagaatgtaagaggtaaaaacatcacgggcgaggccgtgtgtcatttcatgatcccgcttcgaggtcattttcgacataaagccaatatttccctttatccgcggcgtgatgccctcttcctcaagctgctcaatcatttcaggcagccgcgtgaggtacttaagggtggagtgaaaatcgacctgggcgggcggtgtgggcgtcagcagcaggtcactcgcggcgagtgcattcaacataaaggcatcgagatgaggaccagtatcaataaagatgaaatcgtaatcagaaccgacacgatcaataatcgtccggcgtaacacttcagagggaagtctgtcaggcaaatgctctctgacgagatcattccactgacttgcgataaaaccatcgtcaatagacgcaggaataacatcaacaccggggataatggtgggtttaatgatgtcctctctgagctggccagcatccagatcgttaagcattgcctgtgcagctgtttccattatggaaccaatgctgttttcctggctgagaaacatggtactcgaggcctggggatcgagatcaacaaccagaatacgaagatcgtgctgaagaagatcctgatgaacccgcaggccatgcgccagagtcaccgtactgacggttttcgataccccgcctttcaggttcacaacaaaaataacaaaaggcccatcccccgcgtgcacttcacgatatttaggcactttacggtgagcatagatatctacaatgtcctggatggtcagggcgtaatgccgggtgttaccggcatcttttttgccaaaaatatgtccctgcgattccatttcttcaatagcttgctcaacagcacggcggctgagtttgggaaggttagccacggaattgcgcgtgaacgtctgatagtactgatcaaggccaaactcatttcttctcactgaaatatcgtcactcatgctgcgcagcatcgcgctcgctctgcgggccgtctcgtccacgccaccgtaatgacttttcatttaaccgttccgttgtcaattttgaaactgattgtacatctgaaaaaggttagatcaacttatttcgttaaatcaaaaaaagttgtataaacgcagaatatgctaactgacagttttctgtagtctgtcattcaaaagttatccatgtaatgcagaattttaaaacagccttcatcagtaaaatgcaaactgacaagcacatacccttagttgataatgatttatattactgattttatttataattatacttatatttcagattgaaattcccatatgtattctctgcaaagctcaggtaagcggtatgctatctcaattatcagcccaggattctcaggattgaagtcacgttcattacaccacctgtaataaacgccaaattgttctctcagacaaaactgtcagttaacacacggtttctgtattatgaatttgtgcaggaaataccatacggccgcatatttgcttcaaaattagacgtgtcttctaatgcttattggctgttttcgataatctttaagataaagatgtatgctgacgggatattgaattctcttccggaaacatgtgcgccgtaggggtgatgtataagtaatgaacaactgtgtgtcctggcggatacccatttcgtacataagcacaagcagaatgaccatcatgctttctttaacgggtatcagttcagccagacactatctggcttgggcagcaaattgatggccggacaaaccatttcttcaccaatcacctggatatgtgtgctggagggataattccgttctctgccctaaattacaccgctgcagttttgaatcgccacggataatccagacacttccgagccgttgataatactggttttcatattctgtcggtgacatctgatcgccagaaccatgccgacgcttactgttataaaacatttcgatgtaatcaaaaatatcgctgcgggcttcttcccgcgttccgtagatctttttctttatccgttcgcgtttcaacaactgaaaaaagctttctgcaactgcattatcgtggcagttaccgcgacggctcatgcttccctccaggccgtgtgatttcaggaacgactgccactcatggcttgtgtactgactgtcctgatccgaatgaaccagcacctgtttttggggattacgccgccatacagccatcagcagtgcgttcaggacaatgtcctttgtcatccgggattgcatggaccagccgataattttgcgtgagaacagatcaacaaccacggcaggatacagccagtcttcatgggtcctgatgtaggttatgtccattacccaacactcatccggagcatccggattgaactgtcgctggagcctgttgggcgacacgatactggcctcgcctttacgtgcccgcgggctccggtatccgacctgagcctttatcccgacacgtttcatcagtcgccagactctgttcactccgcactgttgcccgctgtcccgcagatccagatggatcttgcgataaccacagacgcatcccgattccagccagaactgtttaatctgtcctgtcagtctcaggtctgcctgatggcgctgtgaatgcggctgctgaagccaggcgtaaaaaccactgggatgaacatccagcgcccgacagagcaggcgaacaggccagcaacaggtgttgtcacggataaaggcgtacctcagtcgcacagctttgcgaagtacgccgcggctttttttaatatgttccgttcgtcggtaacccgcttcagctctttctggagacggcagacctcggcctgagcatctgactgttctttattagtggaagaatccggaccgtacttctttatccaggcgtaaaggctgtgggtggtgacatcgagacgtgttgcaacgctggaaacagaatggccacgattaacaacctgtttgactgcttcaattttaaactcttcgggataacgcttaccgctcatggacacctctctttatgctatcttaaatgactctgaggtgtctgttaaacccgtggcgattcattaccaactataatgatgcttttggttgaggcttagatgatgtgcaaaaaaagattctttcacgcagggtcatagcctcatgtttagggctttcatttccggttgcagcgagcataactcctctgcctgaatatactgctaaatatgacactcttgtaccaacatctatatcgaacaataatttcactcaatatgtagttgatgcttacatttctgcgctccccggagatacgcttgcaaaaatcatcgacaatggccaaaacgagctaggtttaaaatttagacctagtggaaattctcagaatattgatctgaaaaatatcaatggatttattctggcaggacaaacttcgacaaacaccaatggacaatattcaatcaacgaatcagccaacgggcatgtgcaaaatatcagccactacggcaagtttctttatctaattagggccgacgcggtcatcacgcgctgggagacaaccggtaacggaactgtttccggggccgggcgtgcactctggatagctgatggcgcaaccgtgggaaatgttgtcaattctactacaacgcgttccgattcagtggctttcaccaataacggtaccattacgggcacaatgacgaataccggcgctatcagtggtacggagtcggcgctggatattgaagacaatggtagcctgttcgctctagacaacaaaggaacgctatcgggccgctatgctgtccggaactttggcaacataggtagcatcgttaacgcgggcactatgaccggcggaatactgaatgccggtgcgatcagtaatgatgttacattgaacggggcctcacttatcttggctggtaataccgcctcgcttggcgggcgtgtgactggcacggccggagacggctcaacagtggcagtgggtgataccgccaacaacgctgtgttcagggcgacaaacagtgtgactgtcgacaacgttgtcgttaacacgggcagtatattatctgtttcctcgcaggcaaactggaagacttcaaatggcattaccaataacggattactcattctggaaagcggcagctcactcaatggtgtcctttttaacgacggtaccatacagattagtactgaaaaaaatgccactgcgacgttaactggtaatttatcgagtagcggacggattgtgctgaatcccacgacaatcagtgctggaaacacgctcatcattaacggcaattataacgggctatccggaagcgtcgtgacgctcggcagtgttttagccaacgacagttcgagcacagacaggctggtaataactggcaacacgtcaggagccagtacgttgcttgttgccaatgagaacggcgtgggcggtgcaacacgcgaaggtatcaatctgatcggcataggcggggcttcaaacgcgacattcacacttggaaatcgggtcgtggctggtgcttacgactaccggttgcgtaagggtaatgtgtccgggacggatcataccggatggtacctaactagcttcagtaagaaccctaaccctaaccctaaccctaaccctgtaagcatgtaccggcccgaggctggcgcttatgcagctaatcttctggcagcaaatacgctttttaatttttctctgcatgaccgcagcagtgaaacaagttatttcgatgccgctacaggggaaacacacaagaccagcctatggatgcgtaaccttggcggacatagccgctatataatgcatgacgggcaaaaccagacgcaaatgaatcgctatgtcttgcagttggggggggaccttattcaggcaacatcgaatgatactaatgcgttctatgccggcatcatgggaggctatgcccgagcctctaatagcacacacaacaacctgactaatcatgatgcaaagggcaatttggacggttacagcaccggattttacggcacgtggtaccaggatgcagaaggcaaggctggtgcatgggcggatatgtgggcgcagtataactggttcaataacgaggtatcaggtgacatgctggccactgaacattacaagagccgtggtctcaaggcctcttttgaaagtggatatgcttttttagcgggacgctggagcaatgataatgcaatggaaagtcgactttatattgaaccacatattcagggagtgtggtccgacatcacggcggacaaccatactgaatctgaaggtacacaagtgcaaggtacgggtaatgataatctgatgacacgttttggagtacgtgcttatctgaatacggaaattcaagcgaatcgtggaaccgttattgagtttaaacctttcatagaagtaaactggcttcacagcacgaagcattatggtgtcaaaatgaacgatcatagcgacattatccacggaacggacaatgcagcagagctgaaaacaggtattgaggggcggttgtctaaacatctgtccgtttcacttatatttttgcaacagactggtggtaacagctggcgagacagctcaggagccttacaggtgaattaccaattctgattgaaggcaggaactttaagccggtcttgctaaggcactgataagctcaatcaggtgatattcgcagtgttttttgacgcggcttcgttcgccttgagcatcctgatatttgctctggagaccacttcatctccagcttttccagaacaagcactcgcaacgcacggtttaggtcttttcgccatcctgttggcccgtttattagcatcaacagctttgtaatagcgcctgccccgattacgctgaacttcacgtgatattgtcgaaggactacgattcagcgcaatcgcacgaatgctcattttggctgacaaaccggctcgtatttcctcgcgctcagacagcgtcaggttagctaaagcccgcttgcgctcattgggttttatgccgccagtatctcttaacatagtgaagatttttcctggtttcgaaccaggatattagctatttcactgaagcatgttctgttcttttacagttcaaaaacagatgctttttcctttgctgtaaatgtccgtctcattcaaaaatcttcgcaaccctatgtttcacatgactgtagcgttgaccaattgaatctacagtagcttttttaatatatcgttttccatttcaacccgttgtagtcttttttcaaattcacaaataccaagttgctcaggcgtcattggataggtctatgggtttttcctgcgagctcttctttaagctagcgaacccatttatccatcgtagatttaccgacattcattgctgttacagctgtggcaagggtgtagcgcagatcataggtcattctgcatcttcagaaacaccacgggcttgaacacaatttcatcgggaataaggcagccgtagtgccttatcaacacttgtccctcactgtacccagcggttaaacagcgtttccagcgcacaggtctgccggaacaggtcggtctattcagacagcacgctggtgcacgaactccagaggtagtccagcttgccagcaagctttgcgccgacgccgtactgacgtacctgtttcagcagccattcgatgtcaggagccacttcccgggaaaagcgtagacgcctcaggactgtggccaacgtgtgagaaaaaggttttcctggctggcgagagaacgctactagcctgtctcgccagcgcaaccgctactaaggcgcaccatgccagatggcccagtttttctctcagtgtcactgcgtattcttttcctgtatattctgcccgccatcttcatgaggattcccgtttacagcctgagctcgctacggcttttgagtcaattttacaggcgcttgggtcagtctgcacagccgggacaggctgttgcataaaatgctggtctgatgagccagaataaatggccgattggtttcaccatgcccaaattccgggtaataataaaccggaaagttaacgcgccaagcgaactgttttatcacataccggtaaagtgatttttcttcattactggcattcaggccgtaaaactgaccaaaaataatggcacgtggatggagtgtcctgctgtactctatctgatgcagggtgcggtcaagctgtttaggagttacccccgtatcttccagcatcataattttatctgaatagctgccctcatagactgtggaaaacagagactgaaccaaggtcaagttcccgccatccagttcacccctcactgtgtttgctgcctgacggttcattggttcgatgccggtgtaattaaccccgtgagacagggcctcaaagacttcattcaggctattgttcatgctgagttttttgctgttatcaatctcatgcatttctttgttataagaggccaccacgccatgcacgcttggccagctcagctcatgactgacaaagctgtggatggccgttacgtcactgaatccgattaggattttcggcattgaggctgaaatacgctgccggtttgcatgcagggcagggtaaaggttcagcgctcccgagccgcccctgatgaaccagaggtagtgcacattgcggtcactgagagcattaataagggtctgggcccgcttttcatcagtgttcacgtaccccagacgggtgggcttctggtcaagatatcgtttgtcaactgcgtagcactggcgggaaaatgccgtctcaatctccgatacgacgcgctcatcatattgcgacgagcttgaaatcagaaataccctccccttttgacaggaacagattttttgttcaggctcttcaactgggcgaaccgttgtcttcatcatggtctgtgaggtggcctcacatccggacaggaaaagcacaagaatgaggagcgcggcttctttaaacacgctgtttcttacctgaatcatatttatcgtccttaatgatacgttcgccgatattttcgttacgttgacatctgctgcacggcatacgatcattgtttttatattcgcaatgaataaaaggcacgcggattgaccgcaggccttttattaaagcggtgtaaagagtcagttggtggcaggctcaccgaaaaaaacagttgacgattaccagcttccggcgcagccccgcgactcaggagttctgttccggaaaccagatttgaagtctaactgtcaatgaggcagtatcccgctaattcgaatgtctcctctgcccagacggctataatgttgacgccagtgccgaccgttgtggtatgaatatattcattactaaccactcaaatcacatcccatcgaaggcatttcctttcgcgttttttaccttcagcttcactccgacaccatcggttcccgcgtcagggtgaaaaataatctctcctaagcgctcataggtggcaacaagcctgagcacattcccatgaaagaagctgactgatttaaaactgaattcctcattatttacctcaatgccgtagtcactgagagttttacctgatacaaagtcataatcaacgggtgcaatcatcattttgacgctttcgtttgtgaaaaatacttattaactaaggcataaagaaccgccgctgtttccgcatcaatgacgctgtcatagttatcctggcgaaaatggagctgggaggcccggacaggcagcttaagctctgacgttattgttgcgccagaaacgttatacctgacttaagggttaccattattaacaacaggtattaaaagacgcatgcctggtctgatgacatttggattagtaattacattcgagttggatttgtagataagtccccacatattagctgaaccataatattttctggatatggatgataatgattccccggtggctacagtgtggaaaagtggagtttttaccggttcacttaccggggcagcatccgcatccggtgtattatttccaggaggagaaattcccgtgacacattctaaatctacaaattcagcaccgattatatttatctggtcaataaaagcagaaagaccggatgctgtagtggagtgaatgtcatgcattaacacaagagatttttccctcatttttatttgattaacaccatgtgatatccatccatcaggtttccttttccagtcttcagtatcaacattccacataactgtactatagccaagggaacttacgatgttattaactatttcattcctggcaccataaggaggtcgaatgataagatctagaggagcgcacctcgaaatcagctcttctgttttctttatttcccttataacatcaccttcgtttagagtcgttaaatttcgatggctgtatgtatgatttcctaccctgtgcccctcagatatcattcgctcaagaactcccatgctattttttatcctttcccctaaaacgaaaaaagtagcttttatctgtcgttctttaaggagatcaagaatagaggtcgtattatttgtgtgcggaccatcatcaaaagtaagatgtactgctttcattttttatcccttaaattacacaatattatctatattaaacacgctcacgccattcaaatcttgattcaggtcaagctgcaggttgattctgggctaatctgaatcgccacgggtttaacagacaccccatattcatttaagatgacttgaagagaggtgctcatgagcggtaagcgttatcctgaagagtttaaaattgaagcaatcaaacaggttgttgagcgaagctcattctgtttccagcatcatgtctcggtatcaccactcacagtctttacgcccggataaataagtacggccagactcttccaataataaagaacaattatatgctcaggctgagttctgccgactccatccggttcctgattttttaaccgggcatcaaccgataacgcttttctgtatcaattgcagtcatctcccttaaagatacagaagggatttttatcattaagaaatgatgattgtgaatgtaagagtatggaaagttttacttatgtcagcgtatatgacggcctgttcctcacccggtacagaaaaatatcagaccatctaaggcgcagtttaaactggattttattaaatagtggagatgcttttatcttttgtgttaatttttatggtgaccgcaaaagggtcaccataatttatatgatgcacggatcttgtttttttccacagccgatctttattaaagcagggataacgttgccggtaatgtactccttgctccagatggattaagaatatttgaaggttttcattccggggagcacccaccgcctccataaacacagagtgtcttcactttaaaaccggggatattatcagttttatcctgctttttcggactccaccttgggctggttgctgtcccggttgtcagcccgtcaaggttggtcaccatgccatgcatcattacgtcgaattcctgaagggggttcccagacagtgactagctccacccggccgtaataaatttattcataatctgtatctctttacttgtatttctccacaagagcataaaggatcgcggcagtttcagcatccagcttaccgctgtaattacaggggcgaaaatgcagctgcagtgcccggattaactgagcataaccggtgtcacttctcgaacctgaagtgtcgtagccataccttttcagcatttctgttatgttatctttcgaaggtaacgaatagctaaactgctcaacatatttattctttgtttcctcattaaaccatgctcccacacctgcctcatacagtactttccaagggaatgcggcaccggggtcacttttcctgcccggcgcaatatcagagtgccccacgacattcacagggctgatgtccgggtaccgctggaggatatttattgccagctctttgattgcgtcaatctgagccgggctatagggaggaaaaacaaacgcgccgccattatcactggccagattaactacctcaattccaatggctgtgtcgttaagattgcttcgcccggcccaagagctgacacctgcatgccaggcgcgttcgttttcatcaaccagattaaatatacgcatgtcattaaaaccggctgcaaaatacgttttgtcgtccgggtcagggaccaggtaatgcgcactcacggtgccgtaaccggctagcgcccgcacagatgcggcaaaatcaacggcggtataatgcatgacaagaaaacgcacgcgccggttaaaaccctttacagaacggtagctgtcataatcgacggggtagatttatatctcctcttctttttttgccagatatccgtctgccgaccagcgcgctttcagatactcaacaacctgctgcgtctgcggctctctcagaaacatgtggcgaaacagcatgcaaccgcccacgtcagtcagggagtcattcaggtcaagctggcgggtgatttccggcacgccggcttcaaccgtccagtcaggttcagcggctgagggggtacccactttataaaaagccatgccgatatacagtgcagtacctgtgcccctgacggtatcggcccaccaccgggttatcacatcatactgggcagttttccgggcaaaaggccagtaaacctggggggcaatatagtcaatgatgcctgcgcgtacccactgccgggtgtccgcataccccgaatcaaagttaggcgcgccggcctcgggtgtcggaaccttcagggtcatcagcactgtttcgccatacacctgcaggactgacgccaaatctgactctgggtttaatggccttaatacgatggtgacaggctttcaccagagaataggtattatatcttcgccagtcctctttagtaatgaagccagggttgtacttctgatatgtggcatcgtcattcagtggggaatcagctgattcataatagaaataatcatcgaactgaataccgtcgacatcgtaacgggagacgatttcttcaacgatacctgcaacccacgtctgaacttccgggattcccgggtcaagaacaaagcggttataggcaacgcgggtccattcaggatgagttttgtatatgctaggtgatgaatcggaagatgaataattaagttcatcgacggtggcatcacgagtattcattgagatgcggtacggattcacccaggcatgtagctcaatgtttctggcgtgggtctgctgaaccgcccaggcaagggggtcgaagccgggatttttgcccagcgtcccggtcaggtacttcgaccagggcagtaagtctgacgcataaagcgcatcggcactgggtacgacctgaagtatcacagcgttcatgttcattgccacaatatcgtcaagaataccggtaagttcttctttctgccgtttaatgcgttctgcctcatccttcacggcgagcgttgaggcggagggccaatctaggttaatgacgcttgacacccaagtagcccgcatttctacgttcttcataaaatatccctttttgttgcggttaattcattaaaatctcactcaaagcaaataagaggtaaactgagtgattaacttaaggttatatattttctttcattttcagacacctcactcaaagtgcaacctacacatcgtcttggtcatcccagggtaaggtgctgtacctggttctccagttttgtaaatgaaggcgatatctccttttgcgctccacgatgtgatcgtatccgcatcccaatagaaactgtacttcagcgccgggctgtcacgccactccccaaaaagtttgcctacgaccgaaaccgcaccatcagacatgtctgatgccgattcaagagtcccgctaacgtccacacattgaacctcgcaataatcgcctacttttactgattgctcgagttgggatgggtgataccacttttgtaacgtgaaactgaaagtcagtggagttccgcctgctttcggcgtagcggtaatggtcacctgccgttctgatgcgggcggcgtatcaacaatggtatctcccctatgggtacccttcatggtgacgacgccatcgctgtctacatcgacccatttacggttgctggtccacgtatatttttcgcgaccctctcctgagccattaattaaaaagtacatctgtgccccactaaagccagtctgcgggaaaccctgctcgggagtaaatatgtggtccgtacccctgactccaacacccgtaattgacgatgtgaaggttatatcctgtgtcttaccgccatcgctgctgctgtttttcgctttggcagtgactgttacgttttcggccaccgtgtcactgagcctggtctgcgcctgcccgctgctgtcggtattaatgagtgcagcactcagcttcgcacttcccgttacggtgaacgctacgggagtattcgcaacaactgcgccgctgctgtcctttaccgtggctgtcagggtggattcgtcgctgccgcccactttcacgctcgttgtgctggccgacagagccgtgacggtataggtagtgaacgccgtctgtgccgaggctgttttcccgttactcaaagcagccgtaaccaaaacggtttctgccaccgtgtcggtcagagtaacctggaccagtccatttctgtcggtgattccagacgcagccgagaatttcgcccttccgtcgcctcgtagcatgacatcctggccggcaagggcaatgccgtttttgtcttttaacatgaccgtaaccgtgttggttgcccttccgtccgccagggcaccggtagtagctgtgaccgataacaccgcactgtcgaggtcagttacaaaactactctctttcgtcaggctgctgcctgacgaaagctttgccattacctggacggtttccgccacggtgtcagtcagagtgacaagagcctgtcctttgctgtcggtattgatgatcgcagcattcagtttcgcactgcccgtgacgctaaacgtcactgctgtattcgggaggggattgccgctggcgtcgacgatggtcgccgtagctgtattcttatcgttgcccgatgccttcgccccactgctgacagtcaggtccttgatgcgggcggttatgttatcagctacaaacaggctaggtgcggtggcgctgtagccgttttccaaggtggccaccaaggtcagagactccgcagcggtgtcggtataggatacagaggttttaccactgctgtcggtctgagcagacttagcgaaggttgctgtggatttgtcggccttccatataatgctctggccagaaagtggattgccgttctgatccgttaccatggcttgtgccatattagcggttttcccatccgccgggctaccgtcagtaataacaaccagggtaccgattctggcagtggcgttattccctgtgaagtgcaccatcccttcagccttgaggttattcgtggtggcgctgatagccgcgctgccagcagctgttgcggtgagatggaccgtggccttcccgctgctgtccgatgtggacgaggtttcattcattgagatcttatcgggtagggtccaggtgactttttgtcctgccgcaggccggccgttactgtctgtcagcgtggccaccaccatgtccgtgctgttgccatccgccacggcattatcctgcaagacatcaagcgtgattttgctgactgcaactgtcacaaagtggctgttctgtttcgcgctaatgctgttgctctgcgccgttaccgttaccgtctgtgcctgggtgctggttagcgtaatcgtcgccagaccgttctcatcggttacggaagaagtcggagccaagttgacgctggcgtcgaatgatgaggcaaaccagtttatggtggcgttcctcaccggctggccgctggtatttgtggccagaacttgcaaaatgttccggctgataccgtccgcagggctgttatccgtgaccggcgtgagcataaggtgggctacattttgcttcggatttttacggtactgcagaacaatctcgttgttgcggttaaccaggtcatagcggctgcccgccagagtgcgcatggtctgtacgttttctggggcaagttgccaccgccagtcgtgaccgaagctccagttcaagccgaggccaatctgagtatcatgctggcctcgcccctggcgctgctcagcacccagggttatcagcggcactggggtatactctaaggctgctgtgaaggcgtgtggggtttgttgcagatggtctttatcaaaaagggccacctgcttaccagaatactgttcccacacaagcttgccacccagctgcggataagtaggcagccaaccttcaacccgaacatcgcagccgttagcgggcttttcctgccaactgccgtcaaattcgcgtgatttgtgccagtttgtggttccgaggtagacattagcagagagcctgaggtagtcccgccaggcctccacgccaacaccaatacggcggttatggccggtaaaatcattgtcatagaaggcgttaccgccgaacatccagccgttctgccagaaggtccttacaccgtaacccagattgccagtgagacggtcagatggttttcgaatacccccttgcatgaagagcagagactggcagtcatcgtacagaggaaccagcaggtcgccataggtgtggctccagttgccacgtcgatccatattaagttgtacgcgtgctgtaccaaaatggctcagccactgctggagtgcagctccggcttgacttgtagccatactctgggccctaagtccggctgcgtcgcggttcgccccattggtcaggaaacttccggtctgtgacgcatattctgcaatctttttagcctgctcaccttcttccgatccagcctctgatgcagtgggtgaagctgcttttttgtcctcccatgagatcagtggcacatccactttatcaccgggctgcaggtcgttaaggccatgcacgaaagtgcgggacttattaagttgatgtaactggtcatgggtaagatggtattttttttcgactgaggcgaccgtttcgccagctctcagggtataaacttgcgtgcgctgtgcgaacgatgtgggcatgggttcagcaccgaccatcaaagaagtgaaagctactgccagtgttatcagaaaagcgaaatgggagccgacatcacaccagaaataatgacaaacgtgcggtgaaacgttttttttcactgatgagtttggtaagttagtgcgtatttttctcattttatcatatcccttatgcaaatcgcatatccacttattcgaatttttcgtgttacttgatctattactgctttaatgcatccttcacaacaattagtggaaaaatgaaataacccccttgagttaggataaggtgatttaataacattaaatagcgtttaagactaaattggaaatgtttttctttctttttatctcacatggctccgtggaagtttttctttttcatttacagggtgatatgagttgccgactccactatgctatttttgttaatttaatgcccctattgttgccagaaggttatttaaatttttcataaatttaatgccacaaaaaaactcacctcgactgtttagattttatttaaaattctaataaaaaataaagatatagaattttagattacttaaaagcattttaaataaatgcaattccctggattccgtgtgggccaaaaaagtggtagctatcggtaaaaacaagtgctttgggtttaacagcgaatgtcaatgttgaatgcccgctgagatggtgtcggctgattagtaaagacagtgctgccggatgtattcctgaagcccatctatctgctgtcgggctgtttcgatacgttttctgagggtgtaataatcccgctcagcggcgttagtaagtctggtgcgggctgcatcatccaggctggcggcggaggggattttaaccgctggcatggctgcgggatagatgacatggagctgcagctgcttgcggccactggcaacatcatgctgaagagtatcaatctgaattttggcatcggcgagttccttagtgcgtttcctgtccatttcagccactgattgctgacgttcctcaagagtggtaatggtggctgactgctgacgggtaagttgtaaacttacccgataagcctgatgccaacgttcagcaagatttttgtaacggtcagtagaccagccaagcagaagcacaaaaattacaagaattatcgtgagatatatgtgcgcctacatgataaaaataatgccttttccgcagcacgacgcaaaataagcccagaaagctcccgcccccctgcttttgtccatatttcaaactcagcaccagcgccgacataatcgccactattgagtttgataagtaacgtggacctgacaaaatttcgagtaccaagattaaaaatgaatgataccagcgcatcgaactggttttgcgtcagaggcacctcaataattgcagcgatagcttcttcagcaacctgacagttatccatgagctttaccatcgcctcgtctggcgtacaattgtcaccttctttcacacccagttgtgtggccatagccaatggtcagcacacctgctggacagcgataagcagtggttttaagtccttcaaattttcttatcaggtcgagacctgttttagtaaccttcatttaaaccccttaaaaggtagatagcacgaaattataaatactttaccgctgtcagatattaatactggcaggtattttagaaggcagtagcgtttcgtagggatgcaggcgagaagcatttttttgttgaatggcgatctcgatactctgcaattccttcctgaaagattcaactatatttaacacatcataattcttcgcatcaaaaattgcattgccatcgcgatcaacatactctccgagataaccattataaagattacctaacgcagtatagatatcgattttcttcattgctcgttctaacatgggcaacatatctaaccactcatcacgagttgcatcgctaatcgcggtaggtttgtgatagctaagtgttcctaccatgcccggtgcgtacatcatccagcctggctgagtgaaattcaccgcagcatgttgagcggaacatgtaaagataatcattgttagaacctgagcaagttcatctcgggtagttactcttctgaatccttttatttttccgtgttcaataagatcttccatccagttatttaacgatttatccgctgctatctgtgcgctggtgatataaaaatgattcacataacgggtcacaaatttaagaatggcattccagatcaataacccatcgtcccggtacggatagtcaggtagtgcgttcacgtcatctacaccacgaattgccagctcggtgggcaggaagtggtcgtaaaagttatagttcagtctgatattaatagatgtcttcgccaaatcgccaagtggagccgccatcaacgtatctacgaactgacccggccccagcagtgccagtgtcgcgttatgattgattcggttggtcccttcaaaatgcgagattaagagatcgtaaatagggtgaccgcttttcaggttgcgtatggtggcgatagcaaacgcctcgcacagcaaatgtgtcagaccaagatgactggcaagctggtgctcagttttatctgcagcctggataacaagcttcgccctttcccatccccaataatgttcagtatcatgtaaagcaaggaacataggattattgttatcagcatcttgtccacactggatcgctacaggtttcagacgcctttccgttctcgatacaacaaacagtgccatagctgcgtaggaatagccaatcacaggattgctgtcagtatccgttgcgggtttggtgttacctttttctgctgtagcactacttatattgttgtaatccagcatatagatgcgtttttcttttaatgctagggataagctatcttcggttcccatcacctgttgatactgagcttcagtcagtgaaaaatgagcaggtaacactgtgataccatgcagagagacgggattacttcccgcaagtcgcccccatgcaaagtaatcatcatcgtgcatatgtgcagcactggcaggaatggctattgttttatactgtgcgtcatatttcttcagccctggttccgttaagcaagacgtggaccagatattaatcatcgctttcaatgctgaaattttcgcatttctctgaacagtatattcaggcaattcattatggaaaaatgcttcaaacttctgctgctcaagagcgacaaggtgagtgatgacggcgtgctgttcctccgtcaggctagaaataagagacgaatagtattgctcgtggttactttgaataagtttacccaacgcagtaagcttaacagtataagaatcacgcggatgtaattcttctggcagatcctgcccaacaggaatatccaacatcggtacgccaatcattggtgagagattttcggtccagttatagctcataaattacctcttaagaaagactatcattcaatttcagaaaaattatttttagttaccaatgataaaactgtaataatgcgctacaagaaatgttccggaagtattaccagttccgctctgtaaatcgtagactttgacgccgccaaagacttcatcggatgtccagtagacatcatccactttccagccctggctggtataggcactcatatccccccattcagcataaagctgcttgtagatatccaggctgactaatgaatcgggatgatttttttttgcgtcattatgagaaacccttttatcacattctggttgtaataaagtttctacttcaagaatatactggtcactttccccagtaatagtatcagtagcggtaatgatacatggctggtaggttctggctttaatggtcacacctgcagtgcgatcaagatcgttaccttctacaacaatctcttgggttgcccccgaccatttccattcgatttttccattactgccccctactgtgtttagggtgaaggatgctcccgcccacgccgtcttaggttgctctgtcgtgaaggtatgattagaattggctgcactgcttatataaaatcggtccgaggtgggtttgaatgtcaacttaacactattactattactattactattactattactattactattactatcactatcactatcactatcaccggaaataaaaaaagtagaaacggtaatatcttcatgaactgtatctgtaatgttagagacaactttaccattgccatcagtaactgttttaaaaattgacgagttactttctttaattacagagctgccattcgtctttataacaaccggcagtgctactgcaggttcataagatgttgcattaataaatgagaattcaacagcgttagtcgcgccgccgtttgcctgcgcattatcagtaataatacgatgtttaatgatgtgatttgaatgaaatttgaatgtcataactattacccatgcaatatttaattaataaagatcatatattaatatgaaagaccatgtggaaaacgtttaaaccaaagagcgcaagaaataaatcctgcgcttttttactttttaatcgttgcgctgacttaacttggcatatccatgagaacttacggaaggcacaagatctacgtgctcttcattattaataatattcactacggttgctttaagtaaaaaatcaaaagaattcgtccaatagactgccgttttatccgtccatcccgagtaatttgacataaccccccactgagcataaaggttatgtaattgtgcaggagaaggaagataatgcgtatcgccagctaaagctaaggattcaatcaattctgaagaaccaaatgcgacatagaagtcttccagcaaaaatctgtatgtgataatttcttttgtatgtttgtcagtaccggtaaccgtatacctgatgccagcatcagcataatcatcaaatttaagaataacacctccccgcagattagactgcacggcaagtcctgaattatccaccgtccagtcaacttcaccgctgcctccgctgaacataatcctgaactccgcaccaatccacgctactgttggatttccaagagaaaattgcttatcggttaacgttgaaacttcggtaattattagtggatctccccccgtaaacgtaatcgcctgcgtcctagtctgattaccagggatggttacaacaaccgcaacagattcaggagtggtgtcagtgagataggcgttgcacacacccgttgtgtcagtctgagccgtgtaaactttactgccattatcaaactttgcgcttcctccagtcgctgaaaaggagcaggtaacacctgatacaggttgcattgttgtcttggaacgtactaccgcctgcaactgatttttcgcaactccatttgctttagccttatcgacaattacattaagatccagctcattatcagcaggagtagcattggaaaacgtagattgcgccatttgcaatacgctggcatcggactcaacaaccgcaacgattgtaaccgattcagtaatcagatcagtgaaggagacactcacgataccagtagagcctgttactaaagtatttttttgctgaccattatcgaattttgcactccctgaaatactgaagacaatgcgtacgccggaagcataagtatttcctgacataagttttgccatggctgtatttacggccacaccatcagcctgagcaccagatgttgcagttaatgttaattggtagttcatttttcgcccctcgatttaggccctatttaacactttctcagtattgagattagttaaattaagatcataacaattaatttttctaacattcatcatattatataaaataatcccaagccaataggttacatgcacatcatgattgaatgtatttaaatttcaaacagaaataagtatttttatttatgccacctgattatgcaatgctgaaaattacacattactttatttccacaaataagaatcaagattttttgattcgtgccccataatttgggagtgacctgaatgccagataaagtcggttaattgaacctgatgattcgggcagcgacagttcaacacccacggtttccgaagcgttgtttatgatatcaatttcggcagatttgtccgagttcagtaaaatatcagcagaattgctatgataaccatcaataatagcattgccgctaacgctaacccgaacgcgcgttatagtggcaccgagacccgatacttcggctgttttgagatatattgagcaaggtgttatcccattggccggcgcacccgtagagtagttaagatactggatattaccgattcccttaaagtatggcccaaaacgaacaacctgctgaacggtaacaccagggttacacattatttcagcgctgattacatcattaccttgttcagcagagcggactttaaaactgctctctgctgattcattcaatatgaactgataagttcctgtgcccgactcatcaaaaacagcatcgcctactgccgataaaatgacagcggatccgggaggacctttaaccaccccatgattaaacggattaagatgaatggcttcataatctgtatttgcggcccctgttgaaattatcatactgggttgcctgtcaatgtcggtcaaattaagaatcgctttgccaatttctgatacgcccagtacggctccttttcgccttacctgataacttgccgtcacaactgctttgtccataagatgttcgagttttttttgcggaattaaaaatgtaactcccgcactgatatccgtggccagtattgtgtaactatcgataccaccttctgtaatatcaccgtcagcactcacccccttccagaacaggaggacgctatcatttatcattatgccgttatatggggcaacatgaacgtgggtgcccgcatttgctgtaatgctactctggtttattaaaccaccgatagcatcagcaaaaactggtgccggatatattacatccggttcgccgtcaataattttgacattgagcccgatagaaatccccttattaccagcattgtccgaaacggtaaaattaacgcagtggaaaccgagccctaaattgacggttattactccaatagcggggaaatccttggataaattatcaatgagtgcttctaaaacaggttcatcatcccagaacacggttaaataatcaccgcgtgcagcgtcctcatattgatgaatacgaaagaacaccccgcctgcgactttcaggtcattcagactgatggaatagtctgacgtcatctgaggtaagtccggtggcggaagcagattggcaatatttaccatacatactccttttagtcaggatataaattcctatttatatcctgactctttcttaaaccttgttgaaatgaggtgggaccgtatcaataatcaatgatttgctaaaagatgagccggataccgatacggacccttctcctttaacggtaaaccaaaaataaccgcggacatcatcgaaggtatccttgttatcagtaaccatattttttggtagagtcagggaaatcttgcggttttcaatatctttttgtacaaccacacaggtggcgacagattttgttgcgataatttcggtctgatgattcttgtcaaatacccgcatgtaaagggtgatggtatttcctgcaaaaatattggctccctctgactccctgctctgtggtaataaaatttccaccttaacgcccttgtcagctacgtcttcatagtttattgtattgtccgtaatttcggggaatcctggaacatcataaattgggttgacatatgttcctccggttacggttattgcaagaggttgagaataggaaacgtttcgtgcaaggtcagttactgtgtaataaattgtataattaccatctgccaacacttcggtttctgcaaaaacgtttttaacgttgattatccatggaaatgtgtcgcttgtaccatcatcaacacgtgaaatagaatcctttccccaataaaaattatagtaatctccggaagatgggtcatcggtgtggcgtaaaaccatcgcctgaactaagcctttaacatctttttcattcaaaattccatttttagcctgtggtacagtaggagcatttagttcagaggagtaaaaaccgacgttaattttggttgacatttcgctgccgtcatccagggtggcggtaataattacagatgccttatcgacgctggtcactgtattttgagcgtaaccttcagcagacgtagtgctggttttttctccaagtttagttgtggtgctggaagactggaaagtccagttgatcttcacaccctcttttaatttaccatcatcgacgtcaaagacttttgcgaccagattaatagtttcacctggggcaacgaccggaactttagaatcaagcgtaattttattagtcataatatatttttaccttatataaaaatttcaactaacactttgggattttaacccctactgaaaagatgctcactgacgacaagtctgtgaataaatctttattctctgtagcctgttttccagtgtggtgcgtgggaaacaggtaagccgggtttcaggagtacagttagctatatttatttcccgatacttttcagatgtcaatatttcaaattcttttttccagcgatgaatgctgtgacctgtaggattgttcaggcctgaatgttttccatgccagtgaaggcctttttcaatcgagcaatcaaaacctaagagaataatgtctacagcccctaagcttatggctagaaagattgccatcattccggagttgaaggttccctcaatagttctttcaaaataacttatgccatatttctgcgctgcatttttactacatgtccatctctgcgcttgagagttaataagattatagttattagcccaccacgcatcatcgcctgcaaaaatgtactgacattctgggtatatcatccaactggaattaactgtgattaccgggattttatgatcgcgcaggcgataaatatcatcacaacacagcgaaggtcctgatgcacatacagcaataattccttctgacatgattcatttccgttactcgttagtaccatgatgagtccgtcggcagaaagcataactgcctataccatcgcggccgagctcactctcccccatattaaactcaacacagtcgaatccctgaacgctaaaccagcgcattagcccatcatgtgtccagtaccagatatgttcgtctcgacgataatgacgggataaaagaatatgctcggcattttcaaatatggggagcgaaacaaaaacccactttgctgcatgaagtacagcgagatcaggttgatctatatgctcaagggagtcccagaaagagagtgccgggtagtaaccagagtacagttcagcccataacccatttctaatcagccactcaactgctgctggattgatgtcatagccgaatgtatcaggcctggacgacacaaactgaccagagccaatgccaatatccagtaaagtcccctgataatgccgcgagattaaatctatgcgagcatctgtaagactatgccccattgaagtattactcatggcctgataccttgtaaaatagccctcgtcatagggtctttcaggagggacggggaagtgtcctattcctagttcaggaagccagaccaggccggaatgaagttcattattaaaatattccacagttattatccttttctatcgaggcttcaacccgttcaatgaacggcgtcacccgggcgggcaaattactgataaatttattacagttatgcttcatagcctgacagcggcagtagttatcaggataaataaaagccatctgggataaatccatgcaactattgtcagtcactttagaatggtgattattacctccgcacccaccctgaaggcatattgtaggacgcttgtatgcaatagcagccagcataacaactccgacgcctgtaactacaatatcggcacgctgaacaagagcaaacatctgagaaatggttagctcgccgtggtgcagtttctgatgagcgaaaggttcagcgtccgttatccactcaagaccgacttctgtatccgcaatactaatgacatgccagccccgaaaagcgagaatcttggcaacacagtcaacgtactcattgagaggtccccgtgctgagttatgccattcaatccgctcagtagtaggtcggatgagtgcgataggtttattatgagaaagtccaatatcgggcaaaaaaaaatttggcaaataaatcctcgcgggtggaatgccgaagcggcgttccatcgcattaaaaatactgccatgctttaggtctaagtcaccataaaaaatacgccgacattgtatttcataaggtactgactcaaatgtcacctccgtaatattttcatttttattttgagtacgcaacttggagtacgctcggacataatgaatattacttaaaccctcgtaaatttctggtaaaggtgtttttatccagaccccttggcctttttgtgttaactgttttataaaacagcgctgaataatgttgtctccaatgccggacattccctctatatatagattagacataatttctctaaagtaacttgaatacggcgcagtaatctactgccaatctgaacataacgcacttttgaaactcgttaacggcaactgctaaagaataaaatttcaccagttcctctgcgtaaaaacagttgaccctctcacacctcggaataatttatccagtcttttttagagaaggtggtaagtaatttgagattagaggtcaaaaaccttgaagctcaacaggtaatctagatacttttgttgaccatattgtttgagtaaaaaccctcaaaaaatcatataaaatatattattaatagttgatggtagctggctttgaacaaaaacccatcgcactccgtctttccaaaatactatggttaacacacggtaaatttaaatttcagtagcctgatcaatcatctttttgctgtattttattttcaactactaaatttattcgggccataatattaacaataaccgtaacaatgagagcgctgcataaaaaagcgccgataacacggttatcacagaacacgcccggaaaaaatatctttattaactcaagtgttgcatccccaccgactatccccatggcaaaggaaataaaaaaagccaccgactgccggaagcggtcaaagtgacgctgcgtaataatgtacgccagtgcaccagaaagtgaagcaactattacacttaggtcgtcatgaatactgagagctaaagacatccttctgcccctgtaaaatgattgcagtatccggggcgttccggtaatacccgcccgtcctcattaagtatgcatgctgtctctgaaatatactgtacgcgcattaaccatactaaaccaatggatattatcgatcatttaacccatcttgataggtaaaagctattgaatatttattaaagatcgttgtaaacgattagtttttgtcatggatttaataagaactggttaactgtaccctgaagcgagactactcaccgcagtgcaaaagccataagttacaacacccatttcaaccacgcctgttccatccttcttcgcttggcggccggggcaactcaagtgcggctaaattcaccttaaagattgcgggtaaatgtggataaaaaatctggcggtcgcgattctggcctcgaccgccataacatgcgcagaaaagtggaagttcaggcatgaaaaagagccgaaccggacgcttggaacaagcgactttaccgccagtgaaggcggttaattgaggaacggtgtgtcagtgaaaaacgtcgggcggtgccagctcacaaccgaggcccaggatccagctggttaagatagtaccagaccatgcgttcgaagccgtcaccatcgatgttcatcagctcgtgattcggacgtgtcaggattagccagctggccatcgcctgccgccgctcgtccagcgtaagtctgctgaggagttttctgtgcttctcctttaccgcttttcactacggtggagcagcgtggtcatgcgcatcttctcgtaccagcgctttcgcgtctcacgaacggagtcatacgtgccaggctaaatgatgccgtcagccagggcctgcagtcggacattacgctgctgaagcagtctgtccatgttgacgccgcacagtttccagaagcgatcggtgaggaggatgtgccggtgcatccagtaattttcaaccgtgtcacactcaaaattcggcagctcaataaagccataacgcgccagctcctcaaacagacgggacaatcggcacggctcaacccgggtttgacggactctgtcgcatgacaaaaaggtaagtggcggaaggaccactatctgcacttacaacgatgcatcgccagtttccgcttctgtcaccctgccgtcaggaaaaaaatagcatatacttatatccctgaactgggtaacgtcgtcagcagtataacgtcgaagggagtaagccagacattcagctatgaaacgctgacgggccagctggttttggcgaagaagtgagggacggaaaacatgttgagatggaatagatccggcattctgaaggcggaaaccttcacttagtgcaagactatgcacggtacatcttatacccgtacattagcaggtgtaatagcctcatacacggacgtaactggcaaagaaacatcgtatcagcgggacacgtttgggcgggtttgaccacctccatccgaaatcggtgcagactggcagagccgatgtctgcagaaaggctttgtcacaccggggcataccgaaaaatactatctggcaggagcacgccacagcggcactggcctggtcagttatgtgggcagcagcattaaaatttcgttgctgttcatctcgcggttaaaacacctaaaagcgatttactggcgagaaaaaaccagcatgttaatcgtgggtaactccatcattcacaagtgcaaagaaacgctgcgctggctgaattcacccccgaagttcagaataatttaccagctggtttactcgacgtgagtgaatcacgttgagcgtttatggcatgtactgcacgaaaccatcacacggaatcatcagtgtcgattaatgtcgcggctattaaaaagtacgccactctatgaaaactatcagtaccttcacgggtggcaactacggacttgcaaaagtgtagctatattatgttcacttatttaggattactgcggcggtttagtcgtacgtcagcgtgaactccgtgtcggcatctgcagtgccgggtctgacgccattatctccagtggagacataattcgcccggaaattcaaagtgacattaccgcttccgtctactatgccgcgtggtgccttgcttcccatggggatacgctgaccgctgccgtccataatctgtacggcaacgccggtcgcatcttcttcactaccagtccttagcgccagcagctccggatttacggaatcttttttcccggtaaattttgtcgtcactccgcttgctgtacagccggtgagatgaatgctgaaagcaacgggtaatgtcttctgaccagctttcttgagctgtttcgttgcccatgagccaagctcaatgggtttatcaatgtcgtcggggtcaacggtacagcccagcgccaccaccgtacctgtcatccggatattgatctccccgactgtgccatcagctttcgctggtgttgaactaatcaggcagcacaaagctgccatcgcagcaaaggtccgacatttgaatcctgcagtcctgactgccgttttagtcaaaatcgacacgcagatagccctccgaggtgaaccggccttccgcaggtttgttccccgtcacgctgacgggccatgcgctaatcggcactgtagccgcagcattattattcagccggaacggaattttgctgtctacattgttaggcgtaagaggattctgcttaccgtccgcaaccacaaagcccaagtctgcgttatcagaaacgatggcgttaccagagacattatttgcctcaatacgcagagaaagcagagtctgtgcgtcaatgtttttgcactgaatgccaatgcttcgtgtctgaggatttactccagcgggctttttaccagcacccgcctgtgaaaaggcagaggaaccaatattaccaaagtccatactgataacctgcccggcattcagctcgcagccttgagggacaataatgtttcctgaaaggtataaaacagtaaggggtttggtacttatgccttctttaaacgtattagcatagatctcgagtatttcttttttaaaaggcgacatgccgataaaggcacggtcaattctgatcgataccctgcctttaccgcctgtatgccaacttgtttcagtaccattttgctcattgtattcattactttcgtgttccattggattgtctatataggcttctcggccagcatcaatccatgtttgacttttcactgaaagataatcattaattctataccatccatcgtccttacccgaccgactcagtggcacttttgtggtcaaaaatataggagttaacgcacttttgtcattatcacacgaagctctgtacggcaggccagaggcaaaaaatgggaaatctttgacaattatctttccgggaacattacttgaagagtcgtcaatgttgaacgcgcctatgtcagccgaaagcgtatttgttcctccgtctggcataaggcactgtcccgtataacccaaggcaaagtaaggaaggcaagtcaaaaataaaagaccttttgttatagaacctttttttatcactttttcacctatgaatttttgcaattcttctttatcgtgatgatgggtaatttttcgctttcggctggcaggctgtaaggcacctgacatcgattttgctgaccgttaccccataccatctccagtacccctttctgtggcacgccgaccatataaacttcccctgtatcgtctgcgatacctgtcgtgccggagcttttttccgtcaccgtcgtgccgaacggaaccggactaccgccatgagtcaggctgaacatggctcttaatcctacatgcgtccggtattcagcccgcactatagccccttgggttggcacgacatcctgcactgagtcatccaggtctgtatgcatgtctaggctcttaacgtcaagcgcaacgcggttacggcggtacaccgtggcatacggcatcacggcatagccccgccagtccgtgctgacccccgtttcattctccacgtgaacgcccttcgctcctggcgccttaatcagtacgttagtgtcaccaagagactggctgaaggtgacaccgtccgcatgcgccaccactccacccgacaggtcccagttccaggcgtgttcgttacggctgtagttgtagccgccgctgacgcggcctgcagccgcctgccagattgcgctcaggctgccactgttaccgctgcggctgctgcgtccctgcatgaggctgtaattcaggttatttcccgcaagcagagtgccgctgaccccgctctgcatctgagtaattccgtcctggtcccggctcatctgggtcgtggcatacaggctgttaaggcgttcatgctctgccatgttatgacccagccagctgccaaacggtacagagatattcaacgacacgaggcgatccgttcccggcatgccgttgctccggctcaaagaataagaaatgttatagttgacaccgttccagccgctggaaaaacctacctgataccagttgtcgctgccggtgctgttccagtagtcctgtcgcgtggcggtaaggttcagggagccgatatctgccacctgctgcgagagactcacctgcaatcgcccctttttgctgttacgcaggtcatggtagcttacgggctcctgctgcggcccttggccatcgctctcgtctttccatgcgtactgatagccgttcatctcgctccatgcggcctcgtctagggtataaaatcccctggtggagtagcgatagccaagcagctgaaaaatggtaccgtagttgttcagagatttggcatataggaagcgcaacgactgcccgttgtgtgagctgctgtcagagagttcgctgtgtgccgtggtcaggtcagctgacacagccccccacgttcccagattcatacccgcgccggccacggcagaggtataacgcttcgctatctggcttccgccgtacagcgttataccgccggtaaatccgcgcgcaagtgtaccctgtacaaaaacgggtgcattcttagcagacagtccgctccggtactgcccggccacgacgtcatacttcagacgtccctcacgctgaagcaggggaaccgttgagtaaggaacaataaacttttgtacggtacccgattcgtttttaactgtaacctctaggtcgccacttgatgatgccgggttgaggtcagtaatttcaaacgcgccggactgaacggtattctggtaaaccacataaccgttctgtctgatggtcacctgagaacgacccgaggcaataccacgaatagtgggggcaaatccctgctggctgtccggatacatagggtcagaggtgtagatccttaccccgcgaaatcccagactgtcataaatgtctcccgcgctgctgctgttaccaagaatcagctcacttttcagcggaattagcgtgcgctcagcatacgtggagatattctgccatttctgctgccggtctctgcccgcataatctgagtacgtccatgccccgttattacgcaaacgccaagcccccagattcagaccgctggtaatgttaaggtagtaattgctgctgttattgcctttactgcccgtcagcgtgtagtccagcaggccagcattaatcccctcatcccactcttccggcggaatatatcccctcacgctattcagtacatacgcctgaggaaaaaacagcttcagacgctgtgccgaaaaatcataataagaggacgcgccgggaaagagatgcataaagtccacacactggccgtcatctttcagtttcctgagttctccagcggccatatttactccaagccgcttcagccatttaagggacaggcatggaaccagccccgtaccgtcatcttttgaccgctctgtgacagtagctgcactgcggccgccttttattgcctcaaaccgcaggggggaagttgtcacgaactcatcatttacccagatatcgaccctatagataccgggcagctgacctgccccattttcaaaacgggacaggtcagccacttcaccgccgtctctggaaagaaaagccgggttaaaccagtcctgtgcgtgggcaatccccgtcagggcaaggagcactgccatggcgcaataccggaggctgggaaggcgatgaaggtacctgcagggataacagtaggactgaagcataacgtaactctcaggttttcacgaacagaagcaatgcagaaaaaacgaccacctaaatctttaagcgggttttccagttttttctgtagtgatggcaccatagtcgttaaccgtctgataatgtaccggccctgtaatgcctgagggtagcttcagcacgcgctgaccaaagggctcaaccataatgttttcaagcttccggccaccaacgtaaatgttgaccagcgactggtaatagggcgtcggatttttaacgacaacctgccctgccgtctgctgaaaacgaagctgctctgcagattcaggttcgctcatcttcagtccgtccgggcgcatgaacagcttcattcttgaaagtatggcaagctgaagtgtgtttgcccctttaagagcagatttatccactgcgggtatggctttaatattcatccagtagaccgcctcccggtccccgggaaggggcttgccggtataaacgatgcgcagggtattttcacttttgggtgcggccgcaaacagggggggggtaacaatgaaatcatggtcacgctggcccttatcgttttccacccaagcctggataagatagcgttcatggctgtcactgttggtgacggcaagcgaagcctggctgtcactttccgggtaaatcacgcgtgtggcacctggtgcgatgccacctgcggtggcaggctgaaacacacaaagcgtcaggaaagccagaggcaataaaagaactcttttctgcatgatgagtaacctgtttttaaatcagcaattattacgggtaggcaatatcaaagcgcacttcactttgcagtttaccgggccagacacttcgggacgtagtccgataacgggcaacgtaatgaagagacatatcgctcccgtccggcccgaaaaactcctcaggtaagcctccgggaatgacctggtgtcccttcgggtcagtaatcaataatccaagaccggtgtagccgtcatgtccgaatacgccggtgggcctagtatcagaggcctcaaccagaaagacatccggctctttaggggctgttttaccggaaaacgtaatgccaacgccgctctgtattccggggccacagtcagtgagattaatggtaaaggggattcccggcgcagaaatgtcaccgacccgctcaaaggagtgagttgtatactcgcccatatcgacatgcaaatcctgactgtcagcactgacgacacatgccccactcgtgagctgcccgcgcatatgcacctcgcctcccgggatgatgacacgcacgttgcgggcctcagcagatccggaatgaatgaacaaaacgagaagaaccggcatcaggtatcgtgaagatttcataaaggcgccttggattaatgtgcgggacggcgtaagtatgccgtcccgcaagtgccggtgaatcagttgtactgcatgatgaagttagcgtctgcgttcgcatcacctgcagtggcgacgcccgtagacttatactgcgcagcgaacttcaggatgttctcgccgtcaatcaaggtggtcgaattaacaaacgtggttccatcaaatttcacgggggcggacttgttgtccagaacctgaatgccaatgttggttgctgtaccggcgttgcctgaagacagatcctgatctacagccagtagagaactgtctttactggaactgtcagtccgtcctgaaaatgcaactgaggcggtttttgcaatcgaagtgtcgcagtcttccagtttgatctggaacggcactattgaacccagcgttcctgcctttttaaagtgatgggtagtgtattcaccgagcttaacttcctgatcgctagtatccgtgctgacggtgcagggagcagcaaccagcttacctttaaaatgtacggtgccgccgttaactgtcacggttttatccggctgcggctgcggctgcggctgcggatctggaccatcacccgcatttgcagcgcctgccaaaacagccattcccatacccaatgccagcacaatagtattcagtttcactaaaaaaactccattaattatcaaaataaacgcattaaaaaatctataacagccatatttatcagcatacaatgctactgataaatatgacggcaccatattttattttttgtggacagttcaatttacatgtgattttttatttaggtagtcgagttcagttacaaattctcttggcggtataaagtaatcatctccgttgtcgtttactctcaggcaggtatgtattttttaatgtacgctaattcactatcgcctagttcagtagcactgcaaaaaatcaaaataatagcggccatctcaggaaagccacaatattgaattgctctttatatttttaacgagagaaaaggtgaaagcagtacatcctttctaataataatgcgtaacgtgcattgtattttcctaggttacgttttaattgcaattataatgcaccatctcttctcgatcggcaagaacgaaaaattcaacataaatgatagtcacaaactattataatcagattaatgatcgcccataccaattacattgatgtccaatcaaattttaaaatcttaaaaaaatcaacaaattacagagcattcaaatgaattaattaagatgagttatttttaggaatgaaatttaacacggaacaaataaccagaatgaaaagaataaactatactggatgttgaggtgttgtttaaaatacacccataatttatcaacaggaaaaaaacggaaaaatttaaagagttttttcttttacagaaaaacatccgggttcaatttctaaaagctaaaaattgatttatatcaaaatcatgcagctggggtagacaattaatcagatggctttccaaagaaattttcaacgtctctctttagtgaaaaactgaaattcatcttcagccaaaatgtcacttttacaaagatagcagtgcttataaaactcgctggatttttaatcaccacctgtattcatgaacgtattagaatgactaaatcttcaacggaagataatccttttggcggtacgctaatactgcaaatacggttctgtcgcatcaacagagtagattcagtaaaattttcgctgcagacataaatcgcaggccgtagatttggtatgctttaacggcgtcccgcctctatgcgcggcagtttttctttaaaatggaggcagtacctcaaggtgttatgcccgatatttcacgcgatagtacctattagaaatgaatggacactattttccaggaaccggagtctgatgcacagatggtctaattgaggtgcttatgtgtcagagactctttcattcgtggatttatgaatttcgccctgtttgttggcgcagtaaacattatctttacccccttcatcggcctgcaggccggaatcgccgtctggcccgctacgacaggatttttgctgacgggcatgggccttacggtcgttacggctgttgcgatggcaagatccggcggctcaatggcggccctaacccggccgacagctcgcctgtgcgatatcctgcagaccgtttatctgctacctctgcgtcagaccgctgttcgctactcccaaaacggctacggtttcgtacgagctggtgctgccggtattaaccggcagctcagtccggaacaatttgaaaaccagaatctcgcttaggacggtgtccacattacgtgggtaggatcataatttaaccttaaagcaaaaggctcagcaagatgaaccgagcaacttcatggttaatttggcaggagccaatgatattatcatgcatagaaaaacaaatgcgtattaggtcattttgtatacttatcaaagtctaatctcagtaaaaccagtttttgaaagttaacacccccacaaataccaatagctgtctttgataccaaaccaccttggataagagcatcaatgttttcgttcaaaatatactcactatacataccaaaagcagaaaagtattgtctcccagtgattggatctgggtaggcttttgctaatgctatgagtatttcacgctgaattttttcagaaatcaaatttcgcttcacggttcaacattctccatggtcgaaaaaaactagcatacaatgagatgtttacgttgcggaaaaaatgatcaaaatcatataaataaaacttaactaatagttatttttttcgatattcaggaaattatgttgacgtagttattatgattctaagtcaaattttcaacttcgctgtagtcaaaactagtgccggtttactctattaatcatttttccatagaaaagagctctatcctgatccgccaacaacctaaataggaaaaatttctacaaaacgtagcatataggtattaaaaatatttatctaatagcgcggagaaaaatttttcttgttggataaggggtttgtatacaaaagttatattttattattatcttcgtaataaagatggttgaatttttagcctgataaaaaataatcagatactgcgattttctaactcgggggctaaatagctgcgcggaatagtagatcactttgagggaactcagcccggattgtgcgatctgatcaatcgtcaaaccaaccaaaatcaccaaccggactgagcgatgccgatcatagcaccaattccccgtgacgaaagacgcctgatgcagaaagctatccataaaactcacgataaaaattatgcccgcaggctgactgccatgctgatgctgcataggggcgatcgcgtcagcgatgttgccagaacgctctgctgtgcccgttcctccgtcggacgctggattaactggttcacgctgtcgggtgttacaggactgaaatcattgcctgccggacgaacccgtcgctggccgtttgagcatatctgcacgttattacgtgagctggtaaaacatgctcccggcgattttggctaccagcgctcacgctggagtacagaacttctggcaataaaaatcaatgagataaccggttgccagttacatgccggaaccgttcgccgctggttgccgtctgcggggcttgtgtggcgaagggccgcgccaactctgcgtatccgtgacccgcataaggatgaaaagatggcagcaatccacaaagcactggacgaatgcagcgcagagcatccggtcttttatgaagatgaagtggatatccatcttaataccaaaatcggtgcggactggcagctgcgcggacaacaaaaacgcgtagtgacgccagggcagaatgaaaaatattatctggccggagcactgcacagcggaacaggtaaagtcagctacgtgggcggcaacagcaaaagttcggcgctgttcaccagcctgctgaagcggcttaaagcgacgtaccgtcgggcgaaaactatcacgctgatcgtggacaactacattatccacaaaagccgtgaaacacagcgctggctgaagcaaaatccgaagttcagggtgatttatcagccggtgtactcgccatgggtaaatcatgttgaacggctatggcaggcgcttcacgacacgataacacgcaatcatcagtgccgttcgatgtggcaactgttaagaaaagttcatcattttatggaaacggccagcccattccccggaggtaagcatgggctggcgaaagtgtagcggtattcggcgcagctatttagcatcgtttaaagcataactagttttccaagtttcatattggttgttattagactttagttcaaacgctggctgattactcagcccattttttggagagatgtaaagtacaaattttatattatagtgtacgaaaagggaaggtcctatttatgaaatataaacttaacaaaaaataaaaatcataaaaccactaaaactgagattctaaataatttatcttattatcgctttattgaaacggcaaatgttttaaatttttttaataatctttgtaacctgctccccgttaattaacacacgacgatgtcagtaatgtcttcatcagcaacgtgaggacatccccatgaagaagcgtttttctgacgaacagatcatcagtattctccgcgaggccgaggctggcatttccgcccgtgagctctgccgtaagcatgctatttctgacgcaaccttttacacctggcgtaagaagtttgggggcaggtcacttcctctcaagcttaatctttttcactgaatagatataacagctataccggcccctctaaactctccggcattaacagagcctgatgaaattagctcactatttatgacaacattttgaggagcatttgccttcattttcatttcaatacctgtacttgaagtatcttttccgtccacggtaagtttagaagatattgacttatcatctctcaagtatataacattcgaactcttagttgaattttttacttttatttctactgttgcatctccattgcaaattaactctgtagtagcagatttttttagcccattaatttcatcatcctttacaacaccataattaatattaacttgtttagtaagcttgcaataaactttattcggaacaggaggtataggttttccgttacaagcgaagggaagtccagaaaataccgtactataagggctgacactatcttcaaataagcatgcgtacacatttgttcctccttcgattggaaattccttaccaactaaagaatttacactatccaatactactggtgtgtcgcttgctatgctcctgtttgaattaaataccatgaccatcttattattgtttacgttgttatgtaaggacggatcaccaagtaatatgctacatttatacttatgaaaaagaccacttttccactcagtacttcctgcgcatgggccccctgctccagcacccatgtaggcatgtgccttaatactcaacacttttccagtgtgatcatctaactttgtccaactaaattgatctaatatcaaggtttgtgataatgaaaatttagaaaatgcaaataaaataaaaaatataaagggcataaaaaagtatttttgcatttttttctttcctattagggggcaataaaataaattaatcgattgatttttttgcatagctactcactttttcatataatttaacaaaaacaagacattgtaacaagaatgagggaaatcaagcgcgctaaaatctaagtaaattttaataatagtctattttcatagtagcagatgcattgaaagaaccagaactaacatttctctttttaattctttcaggatcggcttttaggtaggctttgaataatatctcgttatcgcctccggttatattatacattgaatttttttgatttatcttaatttgtcgacctgcgtcattttctaatcctatggctatccctgatgcttcggaatttttatttatagcaagaaagccaagaagatttttatcctcacccccttcaaaagtgatgctaagtttattagctacattaggatcacagtctcgaagatgcagtaaaaaaggtacacgcggcataagttggtctagataaatcttgtgtaattctattaccccaagacttacttttatttttttatcactttcagggatattacatggtaaagcaaccagtgtaccatgaaaatttaaattactttctgcatttgcggctttaaaaagtaaaagaaacaacatgattattataattttgatattcattttcgaccctcattggtaagaagcaatcagtgtcgctccggcactaaattcaccagatgctaaagaattaccacttttttttacaggtacagctattagttcaggtagcttgccaggctctaatttaattcttgttcctaatacaaacggttgtccatcccgtcgtatttcgatagcaaggttatcggaagatgtcttaactgccgccgcatcccaacttacaccctccccatccattgaaaggtaaagattttcgtcaacatctccgtcacatgatatagtgtagtctattttctttgcataatttacaccgttgactttattaactcctacattgttaaattccacttggatagtttccccgttgttaatatgacaatctggagtattaattagtgttccatgaaacctcatattttcgacagcattagcataaaaaacgcacaaaggaaaatataatataataaaaaaaagattacgtttcattagtcatccctactgccattccactatcatggttgcgcccacatcaaattctccagttttaagatgagcacccgctttcttaaccggtacagcctgtagtttgggcaaatcgggccaagtaaatttaattttttggccaatatttagttttttacctccgctctgaagttcaataccgagtccgtcgtgtccggcatctaatgcagccccaccatcaaagttagccgtattacctttgattaaaatactcattgtattacttgttgtgccatcacacttcaaggtataattaatgtccttgatgtaacgtctaccgtctattctattcacatctaaagaattgccaaagttaacatcaacagtattgttatcatttacaatacatggaggcggttttattaccaccccagtgacagtaacttcatttaattgtccgaaattttcaccataatcaaaccctgcagcaccaaatgctgtcttgaagaaaaaaataaagagtcccgcttgtacgtagattgataacttctgaatggctaaatagcacttattcataacttagcctcatattaaccacgctgtgccatgccccttcatgtaaaggagccactgttcgctgtgcaaatagccagaagatgagctcgtcactatttccatctatcaccattggttctcctatttggtttagctgaacaggatgatgcgcagcatcttccagaagaaggccaaaccctttcgcgcctgataccgcaatcagctttgaattatcttcatctaatttacttacaaagctgatacggactacaggctcatccattattcctagtgagttggatgtggtaattttctcatcttcagtactatttgtaacacagtcgcgtaggcgtagatgaaacgatttaccatgggctttgacccctggtcgagagagctctccactattgatagttcccatagctaaagtttgccatcgtgaagaagtttcaatattgcatgctccatgtgttagctccccaccaacatacagaaccccactatcaccgttagcaatattatcatcagcgtatacataaccaatgaacaattccaatgcgataaaagtcattaatattaagcgtttgaaatatgtcatcggcttctcatgttgcctgcagttatgtcaaagttcaattcttaaagtcctcatccccagataccttgcactgactctcattgcacttaaaggtcagaactcgcgtgccaccataatcattgatgtaggaaatcgttggtttcgatccgagactggcggcagacacaccaagtgatgcatttcctttaggagcaaccattaaaggtttgaatttttttgagcgagccgcatcgctgttcttagaacctgcagaaaccaaactaataaagtatggcgttgaattaatcaccttatagtcatcaccttcgcgggataatgttaaactgtcctgccatggcgtcatcatttgtgcatgtgatggcaaaatgctttttggacggtagaacaattttatacgcgtctgaagcgcaagttgaagagtgtttggctcattgcttctaggcggtatttcacgcagattgaagtaaaaaaccgactctctatcttgtggtaaagactttacatcaggtaaggctttaatttggagttgagaagcggagcccgcttcgacacgctgtaaaggaggtacgacgactaacggtgaggaaattttattacctttttcgtcctcaacccaagattgtgctaaatagggaagcgaggtgttttcattatgtatattaacggtgacggatttccccccccccgggaaaatgactcgtgtacgatccagcgcaagcgcagcattggcttgttgagtatttagcatggttactaaaataccaactgacattgtcataaatcgggctttcttcatttcgattccttatatcttatttggaggtaatatttcaattaacgtggttaccactgcgtatacagggcagaaaaagagctggtacatctagccttttaggaagcttaaaagtacattgcacttttccatcccattcgacgctcatggtttctgaaggtctcatcccagacagccaagtatttccgctatccccaaccaagccagtttgctgacctttcgcatttcttactgtagcgccaaagggtgccatctgaccatctttgagaccaataactgccattgcctgtctacctgcaacaacactgaatcggcggtaaccaattgcaccctctgttagcgtatctgctacaaccgaagagcttgctgtaacgtcatctggcaagtggtccatatctatacttgcctcattatgatagtaactggttatgtcactaataacagctataccgatagcgttggtatttgtagtacttccataaccatggactggcacaccagaaacgccctcagtatcaagcatcagtcgtgttccgccagcctgagaagtacggtgcattgcagcaccgcaggcagttatagtcatcccaccccgtagtgtaaggcctccagaaacatagtttccttcctgccaccccgcgctcgcatcaatttctgaactactaccttcgtgagagaaagatgcgcttcctgttgacccagtattcccattacccgcactaacctgataactattgtgttcgtcgattgtcgtaaaataagtagcatcgtgctccagaacaccgttcgacatgctttcagaatacgaaatagtatccgcattacccagaggaagagagatggaaaaatacccacctctgtcccaagcactattaaatttgttacgatatgcagatagagaaaaactgatatttttgaatcgtcctatatcgaaatatttagacagggagaaagaatagcgaacgtctgctggtgtatcgttccagtaggtttgtcgactaatattaaaattactgctaagtccaatactactgaattgtttattaagtgagacagtatatatttgcttattgccaatcggtctaataccctgatcgagcgcatcaagaaaatcgttcaaactcacgaatgttcgctgagaaaagcggtagcctgcgaaggttacttggctatcaattgagtcgaacgttttcgaataactaagcttataagattttccaaatgttcttttgctatcaggcaggtctgctctggctgcagacacatccgcagccaaagcaccaaaaatcataagatcacgcccaataccaccagacaatgtctgatatccatttccaaaaagactccccccatataaggaccaaccattgtttattccccatgaaaattcgcctgtagatagtaatggaccatttacacggtggcgcatatcatcgggcctgcccatggccagcttatatcttattaatcccggacgactgagataaggtacagtagcagtgttaatttgatattttttaatctttccatcctgctctgtcacttttacatcaagagtaccattagttgtatcactaagtgtttgtatccgaaacggacctggcgcaacctgactttcgtaaattatacgtccttggtcgctaattgtaacttttgcatgtgtacgagctatgccagtaacttcgggagcatagccacgaagatttggtggtagttgattatcatcagatacaagtcttagccccgccaatcggggagagtcaaaaaggtctgagtcgaggtagtcctcacccaaaattaatttagcccccaaacttcggatagcgcgaaaaagataatatcggttccactcccactgttgatggactggagtatcaccgtatcggctatggttagcttgccagtcggctctcagacgccatgcgccaatattcatgccaaccgttccgtttccgctcaagtttgagctggatgaaccgctttttaatccatgtaccttcattaggttgaggttatagtccgagattaaaccagatacaccgtcgtcccagcgtgaagggggatcccatgtagcactagtatattcaaggtaggcttgaggtatagtgaccactagtctcgacttagcaatatctcctttgacaactatacccttaaccacatcggcatgaacgttcagacacttaccgcctcttagccatgaaagtttttggtatatttcatctttaaaaccaaacttctttacaagctgtggtgaaaggcatgctacagtttcatccggcttgttatctagcttgataaactcaatgttttcctcttgcagactgctatcgtttacatttaccgacatgctgtattcacctggcattatatagcctgcatgggaaaactgattcaaattaatattatttctatctttaacatccagcacatcggtgttgaaatcaacgccaaggtcatctgcatgaactaaacttactcccatgagaaaaagaagagaatataaagtaaatttgggatagttgaaccacatataaataacctcaattacaactggcaaaccacaaaatcagaagtaagtaatcccaaaacgtacgactgctcgaaaattaccttttagtaaaggcttgtggttcgcaacgagttgcagactgaaattcagcgtttgatcaccttgcacaagttgctctttaggaagcgatttacctggtactacgcgcttaccgtctgtatctaatattcggagcgaaacgccactcgcatttccactaacggcgaagtcattaccttcagatactccattcatcgtgattgtaaaaccttgccagtctgccaaccgtctatccaggcgctgaagcgtacagtcattaagttttacgacaaatggaacaaccccaccaacaccgtttcgttttattaattcagttggagttgctcccatccatatagtttgctctttgctaccgggatctatagaacatggagtgtcaagaatattgccctcaactgtgagccgtgtatgatcagttgatatacgagctaacacagatccgttatatatgcagcttaataaaagaatacatcgcaacataagtttcaggcaggtatatttgtaaaacacttatgtttttccgccttcaaaaaggggggcatgccccctaaaaatttattgatacgtaaaagttacgttggaaactgcagaaaattctcctgttgtaactgaatcactgtcgcctttaagttgtgcagcgaacgtcagcgtgttgtcaccttcagtaaggttctgcttctcagttggctgatccagttttacaggtttgccatcagcaagaatctgaatgccagcacctgaagcttcgccgctacctaaagcaagaagagacttgtctttaggatcagacgctccgccaaaggttactgagactgagctaccaactgggcagttaatcaggtcaaaatggaatggttctgcatcagaagtaccaccattctttaaaacgtgagcggcaatactacccatcttgacgtgttggtcgcgtgaagcgtttgggattgagcaaggggcgttagtaatagttccatcgaaataaacatgtgtactgtcagtagttggtgtcggtgtcggtgtcggtgtcggtgtcggtggatcatcggccatagccgcactcgcaacaataattaatcccatacctaatactgctgagattgatttcattttcacttaaaaactcccttgcttaataattaaaaacttaagttgctaccatgcaataacattaatacacacgtcatgataagtatatgcagcagctaataaaatataaaatcaagcatgaatttttgcatactcacagttcctacttaaacgatatcctttaagaagcaaataacattaactgtaagttaaaaaacaaataacttgcttgatgcggataattatatattcataattctcttaatcaaccgcggcactttcttcgattttaatagtaactccctatcaaaaaacctcaataaatagatataaacattaaaaaaaccaagtcgaaaacgcaaataactataaaaaacaaaatgttacatacttacttcaatctcctcactccccattgttttagtattaaattttaaagaaaataaaattaacaacaaaatataaacataaatattacacgccttgttgtggatgcatttcggatatgcacttcaattctaaacgccccactaacagtacaattaaaaaatcacaccttttctttcacgtttaggagaaattattgaccttgcttgtgttttttatatgaaccatgtgaaaataaacacataaattgcgcacttcttgaaaaccataaaaatattacattaaagatatttatactaatagtaagcacacccgttttagttccacggactttttgaaatttccgcattttcggccatcagcctgtattatttcggcgtcaggttattcagcgattcatgaggtcgctcgctgttatattccatcagccagcgttctgtgatttcccgtacttcgttcagggttctgaacaggtaaaatccagtatttttgtccggtacatccggttaaaccgttcgataaaggcattctgcgtcggcttacccggtttgataaagtccagcattacgtcatgctcttcagcacactgcgcaagggtcagtgatatcaattccggcccattgtccatccgcatcttcagtggataaccacggtttgccacgatcctgtccagtaccctgaccacccactgtgtcgggatattcaggtcgatttctgtcgtcagtgcttcccggttaaaatcatccaccacattgaaggttctgaagcgccagcctcacaccagcgcatcgttcataaaatcgatagaccagctctggtttaacgcccccggcgtggccagtggtgccgggttgcgcactggcagacgttgctttcccctgcgacgaaagttcagtttcagcagacagtaaatccggtgcaggcgcttgtgattccaggcattaccctgtctgcgcagcgtctggaacagcttcttaaaaccgtaccggggataacgttcagccgcttctgtcatcgccaggatcacgggctcatcccggcggagatcgggcttgtaaaaatacaccgtcctgctcagcgataatgtcctgcatgcctggcgtaaactcatagaaaattgcaccgtcagatagctgacaagctcacgcttcatcgttgattttaaagctttttttcgatgacatattttaacgcacgattttccagactcaggctggcaaacatctgcttcagacgacgattttcgtcctcagggtcttttatttttttgatatcagctgcttccatcccgccgtatttcgccttacagttgtaatagctggcttcagagataccggcttcactgcagacatccttaacagtttgaccctgacccaaaatcctgctccattcagaaacagaatttctgcatgattaatactccccccgagcggaggttgagccgatgaaaaagtcacgattcactgaagaacagattgtctttgccctcaggcaggctgaactgggtacatcagtaccggaggtctgtcgcaagctgggtatctccgatgccacattctatacgtggcgcaagaaatacggcgggatttccccatctgaactgaagcacatgcgacagcttgaggaagagaatctcaggctgaagaagctggttgccgttctgagccccgacaaggccatgctgcaggatgtgctggcaaaaaagaactgacgctggcgcgactgcgcgaatgggtccaggatctgcaggcacgctacggagccagcgaaaggcaaatatgctttgccctgcgggtcagtcgcagctcgttcaggtatcgttctgtggcagcagacgacagtgcgctacgcctgcgcatcagggagatcagcgaaacccggctccactatggctaccgcagagttcacgtcatgctcaggcgtgaaggctggcgggataaccataaacgcatctgtcgactctacagcgaacaggatctgtccctgcgtctcaaacgtccacgtcgtaacaaatcggcactgcgccgacaaccccagcctcagggatttatctggggcatggactttgtctctgacgcattatttgacgggcgtcggttacgcctgctgacggtaattgatctctacacgcgtgaatgtctggggatctgcgtgggccagaatctgcgctcaacggaggttgcggagatgcttgacagtattgcgttcagacgtcctttaccacagttgctgaaaaccgataacggttctgagtttgcaggaaaaatgctggacaagtgggggtatgaacgagggatccgtatagacttctcacgcccgggaaccccaacggacaatgcgacggtggagtcgttcaacggcaggctgcgggaggaaggcctgaatgaaaacgggttcatgtcgctggaagatgcccggtccaaaattgaggcctggcgcatacactataaccagagacgtccccattctgcactgggctggatgacgccgtcagaatttgccgggaaatctgccggttgccagaatattcagccagactgaagccggatattactggttatgaatggatcacatacggggagcgggtcattatgaatgacattactaacatcggggtgtgttaatcaacgaggagctggtcaattattcagcaacgaaagctccgtaatttcccttctgtgcttcgagccttaaacgaaggtaatacggcttgtattactgatgtctgcgcagatgcggcttaactacagatctccttacagagcgcgcagctcagccggcaccggtaccacggccgccagaaaacccgcccccagcgccaaatattcttccgtcgtcatggcaatgtgcgtaccgtccaccgtccagcccgagaactgccctgctgccttcgccccgggataccaagctttcccgggcgctacacgcgcccgtgcttccctgccagacgcgtgcatgcatgtagtggaccagcgcactgaacacctcccagccgagtgccagcgacaacccgccctgcggtcacgaacaggctgaactgcggcgcctgccaggctttcccgctggttgacgttactgttattctgtatgatgaaatgaccagccaccgcagcatggccgccctgaccctgctgcagaaacacatccatcagcgggacttggcagaactgaccgaccggctggccccaattatgctggccggctatttgtcttcatcacaggtgatatcgctggtacactatatttgtacaggcaggcgaatcagccgaggccgaagcctttgtacgcgaactggtacagcgtgtgccgcaacacggagacgcacttatgaccatcgcacaacagcttgaacaaaagggtattgaaaaaggccgaaacgaaggcaagctggaagttgcccgtaccatgctgcagaacggtcttgaccgcaataccgtcatggaaatgaccggcctgaccgaagacgatttagcataaatccaccactgacttattcagcggcctctccggtcgcactgctgagccgccaagtacagcctccgataattcactgccccaacgttcggcgatgcacagataattctgcaccttcagaaacatcacgggcttcagcacgatttcgtcggggatgaggcagccatagtaccttatcagcaacctcccctccgtgtaccccgaacagtacgggtgcggtgaaagacccggatgcagttgtccggatgcgccctgagtgccagccgtatcgcttcacgttccatcattcactcctttgtttcagacatccactatagtcagtaagcgccgttattcctgtcagctgaagagagcagctgctgtactgattttatatatgattctgttaactgatgattttctgccgtcattgcataaaggccgtacggaccttcaccggtaatccgccatccacagcggttaaacagcgtttccagccccttcacgcgcccggtcaggcgcgccatcagcggtctgacctgccagccgttgtcgtcaaacgccgcgtccaagctggtccgggacacgtagataccatttacctcagagttcagggcggcggcatggcgtcccgaccactcccggtcactgagcagccggtacgtccagtgcatgtccttcgcggtttccagcgcataggtcagccggaacaggtcgttctgttcagacagcgcgccagtgcaggagcgccagaggtagtccagcttgctgggcagctttgctcctgcaccgtaccggcggccctgtttaagcagccattcaatgtcgggggcgacctcgcgcggaaagcggtgctgcttcagggcggtagccagccagcggatgataaaaagattttcttgggcgtcagagcatacacctccgtctttccgtgccagggccagtgcggtcagagcgcaccacgcaagatggccagatttttctgtcagcgtcactgtggactcttctcctgtatattcttcctgctagattctggcagtttcccgtttacagcctgagcccgctacagctgttgggtcagttttacaggcccttgggtaaggctgcagagcctgtatgcgctactgcatataatactggcctgatgatccagaataaatggctgattagtttcaccatgcccgaattccggataataataaaccggatagttaaagtggtcggcaaactgttttatcacataccggtaaagcgatttttcctcgtcgctggcattcagcccgtaaaactgaccgaagataacggcacgtggatggaattttcggctgtacgctatctgatgcaaggtccggtcaagctgtttagccgtaactcccgtatcttccagcatcataattttgtctgaatagctgccctcatagacagtggaaaacagggactgcaccagggtcaggttcccgccatccagtttaccccttactgtttttaccgcctgatagttcatcggcttgataccggtgtaatttatcccgtgagacagggcctcaaagacttcattcaaactgttgttcatgctgagttttttactgttatcagcctcatgcatttctttattgtaagacgccaccacgccatgcacgcttggccagttcagttcatgactgacaaagctgtgaatggccgttacatcactgaaaccgatgaggattttcggcattgaggctgaaatacgctgccggcttgcatacagggcagggtaaagattgagcgctcccgagccgcccctgacaaaccagaggtagtgcacgttgcgatcactgagagcattaataagggtccgggcccgcttttcatccgtgttgacgtaacccaaccgggtaggcacttggtcgagatatcgtttgtcaaccgagtagcactggcgagaaaatgccgtctcaatctccgggatgacgttctcgtcatattgcgacgagcttgcaatcaggaataccgtccccttctggccggaacagacttttcgttcaggcgcttcagccggggaagctgttttcttcaccatagtctgtgaggtagtcgcacacccggtcagaaaaagcacaagaatgatgatcgcgctttctttaaatgccgtgcattttatatgaatcatatttatcttccttaaaaatattttacggtcaactaacaagtattacatgacatttataatattatttttttaaaggggtgatcttaaagatcacccctttaaaaaatgattttttattgattcaattattgtgagaaaagtcaggtaatatttagcacgatcaccgccgagcctgaaaactcgccaggatcaggagcccctgagactatggcttctgaggtgacttcaagtgttgcaggcctgtttttatctattgaaaatatctctccagattgcgaagcgtcttttccatttaaggtcattttggccacgagagaaccatccttacgcaaaggaactgtttgagaaccgtcattgggattaaaaagcataactgaaagattgatgttggtatcacaaattacgtcaactctgccgctgatttttttcccgtttaacgctgatgaagataaggttccatagttcagcgttagatcaccgctgaacttacaacgtcctaccggaggaggtattattccacacatcgaaccaggtaatagtttccactcctgtgtaaagtaatcaccataaaataaacctacacatgatgtaggtgtgatttcttctggtccgactttgactgcgtaataactatccatattaaaatattttcttatttcaccaattgttttggtcttattaatacatgtataattatcgttatcaatcctatacttcgaagaagtcgaacttagacgcacacccattgtcaagacacatgtagctgaatcactgaagcaagggttaggattattatccgattcatctgtccatgcgtctgttttgagtgaaagagataaatcggaaccgggattagcggtaacttgcgcaacatgggcataaatggctgaattggaagcatgtgaaaaaaaacaatcaaaataagccattgcaatggaaatgatctattctcgtgttcaaagaaatcactcataattaagctccagtatggccgtcgatttaaaaccacccggctcaatgctcttattcctgattctatcaggttctcccagaagatatgcattaaaaatcaattcattgttaccggtcgtcagtttctgaggtggggcatttttgttaagtgaaatctgctccccgcttctgttctcaaatccaattgcaacacctggctttttagaggtactgccctccactgaaagcatgtctggcaaagccgtgtctgcattacctatgaatttcacaacaacactattagctatacttgtattgcagtcctgcagatgtaaaataaatggaatacgtggcattgactggttacggtataaatcctgcaaatcaatattacccatatgtacatttattattttatcactgtcaggaacaatacaaggttgagatacaaggatacctttaacagtcacaattgaaacagcttttgcatcacccattttaaaagcgggtaatgtattggcctgacaggtgtaagttactatgatcattaaaactgcaagtaatccaatctttttttattcataactaaacctcattttgataagactatattgcatgtttaagtatcgtaactcccacccttttctaatacgtgcgcggcaatgctatccattttcacatgttgatcgaggaagcatttggaattgaaaacggagcattagtaattgctccatctaaataaacgtgcgtgctatcagtagttttgagagttggagttggataatccgccatggctgaacccgcaaaaaatagttagtccaatatccagcgctaatgagattgcatttaatttcattttagaaaattccaatagaattttttattaaagaagggaagtgagcaaccatatttacctcttcacataatatgtagatgaatttctttaaagtcaagtaggtaaaactaccgagaatatgtaaacatttatctcaactttgggttgacatgaattatatactcttaaatggataggtcaactttagtaaaattgattaaatcatagctaaaaactatcgattttgcttatttgattagcattacaatttacattggttagaacagctggtaaattataataaaattcaataagttaatttaaatgggaaactttagtaagttatagctaattcttgcttttttaattacaaaaaattgcaaataaatatattacattactcgtttgctgtccgttttatttaatgaggaaaaacgtcaacagaaaataaatgacgatatttcatggtttacattagatcaaaattcaatgtgaatagctacgaataatcttgacacttccgagccgttgataatactggttttcatattctgccggtgacatctgatcgccagaaccatgccgacgcttactgttataaaacatttcgatgtaatcaaaaatatcactgcgggcttcttcccgcgttccgtagatctttttctttatccgttcgcgtttcaacaactggaaaaagctttctgcaaccgcattatcgtggcagttaccgcggcggctcatgctgccctccaggccgtgtgatttcaggaacaactgccactcatggctggtgtactgactgccctgatccgaatgaacccgcacctctttttggggattacgcctccatacagccatcagcagtgcgttcaggacaatgtcctttgtcatccgggattgcatggaccatgccgataattttgcgtgagaacagatcaacaaccatggcaggatacagccagccttagtgggtcctgatataggttatgtcggttacccaacgctcatccggagcatccggattgaactgtcgctggagcctgttgggcgacacgatactggcctcgcctttacgtgcccgcgggctccggtatccgacctgagcctttatcccgacacgtttcatcagccaccagactctgttgactccgcactgttgcccgctgtcccgcagatccagatggatcttgcgataaccacagacgcatcccgattccagccagaactgtttaatctgtcctgtcagtctcaggtctgtctgatggcgctgtgaatgcggctgctgaagccaggcgtaaaagccactgggatgaacatccagcacccgacagagcaggcgaacaggccagcaacgggcgttgtcacggataaaggcgtacctcagtcggacaactttgcgaagtacgccgcggctttttttaatatgtcccgttcgtcggtaacccgcttcagctctttctggagacggcggatctcggcctgagcatctgactgttctttatgagtggatgagtccggaccgtacttctttatccaggcgtaaaggctgtgggtggtgatatcgagacgtgttgcaacgctggaaacagaatgaccgcgatcaacaacctgtttgactgcttcaattttaaactcttcgggataacgcttaccgctcatgggcacctctctttaagtcatcttaaatgactccgaggtgtctgttaaacccgtggcgattcataccgtacaataatttccgatctccaaactgcccccttttatgacatatgaggtacgcatggccagtgcagctttactgctgtcaatttagctgaaacaggccgaagagagagcgtacctcatatgtcataatctctagccatagacgttcttttttgaaggttgtggcggcaaaagctaacgcttttactggtaggtattgagttgctatgaagcttgaatgactttcgttgaagttagagctgatattcgaaccggtatcttgttcaacgccatttttagttgaaccaaacgataaggaaaccacttctcgtagcctttaggctagcttagataaggttgacgtattactcttttttgatacaatggtaattgtctagggtgcgaatgcctcagtaattggaactgcgctattacgttaccctagacaccccctcaagttcgccacagcagtaagccatcgttctcccatctttgaagctgatcaggattatctttcgcgtaagcgctcgacacccaatgaacgtttggctggtatttgcctacatgcttgctcagctgaatggggatgataattggattaccccgctgaaactccagggtcactactactacagatcctgggcgcgatgcggaattaaaaatctgttttggctcgcaaaggattgcatggaacttggaaagaatgtctgttccaataccatgatcaaaaaccattttttcaaaaactgaaatggtggtgactatctcaagatcatcacaaccaataccggctaatatattagcgggaaatcggccaatagagacgatttgacgcattttttctgcatcgatgccctcagcagtactaccagcctcacaaatccatgcagccatttctggcgtaaatacctcatactccactctgatgctcaatatcatgctccctaaaggatgtttttaatctgagggcaaaattgacccttattttatcaccatttactgaagcatgttggaggtgtcactcgtcactaaagatcagtacgggatcagtttggcgcttcatcagagcttgatgcttattgttattgcagagctatcaatccctgttgcctggctaatatcccttttggctctttcaattgcctcactaagagggagttgctctgaccttacttcagcagggttcggaaccgctgcgccaggaagtgacaggggagatggattgaatttcttccactccagtttttccggtgttacctcaatacgcaaaaatgcttcttgcgcactcaaataagcaacaggatagcgctgaccatctgttagcattttccatgcgttgggagagtgaatttctgcgtattcatcaaaagttataacgttcctgtcttcgtaatcgggatttttaaaacaacctgtaattttggcaataaggaaagctgtgccgtgctccaggtcctttactgcccaagtttcccttctgtttcgtactgcaatgaggtattcggcatcgttgagcctgtctgttttggcatgccagtaacctgatcccccttcagagctcattatgtttagatctttaccagtaaaaacaacaactgccttcatatctttcatataaaaaaccttaaaatgtgaatgaatttcattttccattaaatctatacgatagaaatcgtttttttcaatttttttattcgataagaattcagcgcggtgtaactttatcgactgtggtaagcgtgtttacctgggattttgataaatcacccaaaacggggttttcagcagccctttgttctgatatcccttgtcattcatgttcgtgcatagtcatgcagctacaccagaatcatcaggtgcgtttttcagggtttttgacagggaaagatgccggaaacggcccattcgccgcagaaacgcgctgagggcctctcagggggggcggcaaaggggtgttatggtaaatcctggcgtagggcagacacgggtgatgcagggtaacaaagccggaggccgatcgttaattttgccctgcaggagtgatagcatcggcctgacaacttacagggagcgtttcatgctaaagatgacaatgagctacaacgacctggcaaaggggggcggcgaggcaaagctgcaggtctacggcgtgggtacctttccggtcttttctggccagaaaccctacaccaacgatcccaactgcgcttacctgccgaacagtgccattccggttggccgttactggattgtcccgcggcccgaaggcagtatcgcaaaccagatcaggggatgggttgttgatttctggaataactcagaccattcagagtggtttgcgctgtttaattcgcagaccatgactgactcgatattcatcaacggcgtggcacgtggcggctttcgcctgcatcctctccggccggacggttcaggagaaagtgagggatgtatcacctttgtgcggcgcactgacttttacacggtcaggcaggcgctgttacgcacaccaaaaatccgcgtgcccggttcgcggaacgggctgatggcctatggctacgttgacgttcagggagacagcaactttgcagactgcaaaattcgttaagaaagcggcggggttcgcactgtgcttcgtagtggcgtttattatgtcgcggtacgggatgccgctttattcgctgacagcgtggattgttgaccgttctcatctggtttttggccgttaccaggctgacgtttatgaggctggcaccgatcccgtgaccttctttgctctgcttgcggttatcaccttctacgccgcgattctgttcggcctgatacggatggtggtcaggaagctaaaagccacctgaaattggctttgataaactgtttaagtaaccgcgatattgtccgtgcttgtttaaggttgcgttcttcctcagcttaggcggctactttcataatgcggtgctcaaatgtcttgtaagggtagtctgctttcataaatacagagtaaaaagcggctactttcataatcaatgcacctttcaggctctgaaagctgggtaattttatgaaagtagcctatccagcaagatgggacttatgaaagtagccgcctgaatgaatctagttatgaaagtaaccgcctaatctgcgctttggaacgccagacgctgtaactttggtgacctgctattgattacgaacatgatttcacggccttttttgtactcattgaaatccagatatccaattctgactaaatcggccaaggcacgccgaataatggcattttggtcttttatctgagactcaagcgcaaggcgctcgcgaaaccttctcattgatatgtaaagcgtaccagcaggcatactttcaagataaacgtacagagactgtgcagcctcctttcgtgacagttctgatagagctttcaatccaagtaaaactttatggtcataccgataaagttcccacagactactgtcaccaactatctcaacctgatcggtttcatggttaagaactgctcgctgtacgaggtgagtaacgagggattttttcgcattttttccacgaaaagatagggtcacactggataagttaaaaagcgaatcgtgtaaacgcgctctggcacgtccgttgatatcagtaggctttaagccacacatgcgagcaaattctgagaaaggtagtgtaatcttttcgctgttgtagccatatttggaaaatgcagaaattattccaacccaggttttaaagtcagttgacatactgagcttagcaccctgaattttaatgtctgtgtacccttcctgccgagctacttccaggctggagagttcttctgaagcgtcgattaaaaagtcgcgtttgcccttttcttttggggcaaccggtgtaaacacgctcaggcgcaggagggcaacgggctgaactgatttattactggtaggcaccagttcataacttgtgtttgactctttttttacaatagaaaaaggactgtctatgtgtatgttttcctgttctttttccatttacttaaccctaaaatgataatggcatccggttttatgaaagtgaccgcctgagagttatgaaagtaaccgccttgcttatgaaagtaaacgccttttttatgaatataaccgcttttattatgaaagtgaccgcctgaaggttatatttaaactttaaaaacagtagcttacagactctgtgatcttatttgatcttaaagtgatctatatatgaactaaacaattgatctatccagtggatatgtggataagtattttttctaacgcaccttcggcttgttcaacgtaaatcgcacacgtaaataatttgcgaatacgatttccgttatcggtaaaaacttgctcataaccgtttagttttatcagtttactaatttccagacatgaaccggcacgcggtcaaacagcttacccactgtaagttcagctttacggtgatcgtatgctgacgtcatcgcatattcttcctttggatcgccttcgtacttcagatgttcgtatacggtctccagcgtgtccatagaacgataacgcctgaatctcattaaccagtctgtttttgtcataccttaccttaaataagtgggcgctcatggcacgggatgggccataaaccaaaagatttttgctgagtgaaatgactgcaacgtttaaaatgattcgtagcgttgaaaaatgagaacagtcctgtgttttaaggtcctgtaaacgcttgtttgatcccggagatgacaggagggaattagccatagcatgaaaccgcatactattgattcttcgattttcagtcttgtgcgttacgaggcaaccagtggccttctcgaactggagtacattaacggaagcagtcgccgctggctgggcgttccggtcagagtttaccacaccttctgcagggccagagatccggatgcctatttccgaagctgtatcgacggacactacacttcccttcgcgggaaactgactttctgagggagattcagattcacttttcctgctctgttcagccatcatcctcgcataatcttcataatgattttctgcctctgtccttatacggctgaaggaatatgagaaccggtgctggtagccgcagcgcttttccctggcggcctgcatcagcgtttgctgaacccacaaccagaaggaacgccctttttctgaaggcaccggatacccggcctttttcatgatcttgcgcgccacactttcgctccagccatttatcagcgacagtgcaccattaatatcaccacgtgatgtcagtaaattaatttcatgaaactgattcattcttttcctccgtcctttataaaataattatcggagggtaaactgatttcttaaggagacagttgttaagagttattaaaaaaagttaatactgaaaaatgtttgattatttattgatctggtttaatgagttattaaactgcaatgaaacaggggttataaataatgaaaaatctaagggtttactgtctttttttatttacagttccttttttcacatactccgactctgaccttcagacgggtttttcacccggaggaagtgctcagacactcatcatcagcttcatacgctcggacgaggggtcagcggacgtggctgcatatgagttcaccagcaagccggtcgctgaggcgcttgtgcagctctcgcgccgcagcgtccctgtaagattagtggccgacgaaaagaaaagtcacgaccgctggtcgctggttaataagctggcctgttcgggtatccaggtaagaacagattcgcagtacagtattatgcataacgaattcattgtgacaggaaataacggcgtgcagacgggctctttcaattacacctcgtcggctgaaaaacgtaatgccgaaaatgcgcttgttatcagaagcagcttatcagtgagtaaacagtatcaggatgaatttaaccggctctgggcggagtcatcgcctgtacagtgcagccgttaataaaaatataattaatattgccggtaaggtgaactgtatatgactaagaaaagagtttatccggtttacttcaccggtcagcgtggccagcacgaggcgtcagaagctttccagcagaacgaaacgcctgtctggcagcgctggctgaagcatgcccgcgataacaaaaagaccacggtggtcacctgccgctgcctgccggcagagaccgaccccgtaaaacgccgcctgaaggtgcattattctcatgagactgaacgatgctggctctcttcatatgcctttacaggtaacgaacacaagccggactgccgtttctattcggtgtggtcagacgaacgtcaggcggagatttatcagggggatgcagtacgctccgccgcggacggcaccatcgtggtcaggctgcccaccggcctgcagaaaaaggcaccgtcagagtcaaaaccggctgaagacgtgtccggtgatgaaccggtcaagcgtaagcgccggccctctatgcgcctgctggggctgcttcacctgctgtgggaacagtccggcatcaacgtctggcatctcgctttcgataaaaagaaacgcacgcccggctgggtgagctggcgcctgcagcagacggcgggccggatacgcgtcggccgcgtgccgctggaggagtcgctgctgctcatggccatgaagggcacgccacaggtcatttcaaactgggaacacctgagagcggccgaaaagaacaaacggcggctcattgtggtttccgttctggccggctggaatgaggctgctgaagtacggctgcagaccacgctgccgctggggctgtttttcggtttccctgacctggtgctgccggaggacgtgcgcctccgcctggagaggagctttggccgcgagctgggcgactggcgccggggaatgaaggtcgtggtcatcgtggaaacggagccgcccgaaacgacgttcaggcacgaagacgggcgcaaccggccgtccagctgcagtaccgtcatcgacgtggcgctgatgacggtcagcccccgctttattccgctggattcgggctatgagggaatggttgaagaaaaaccgtggcaggaaaaacgcaccttcatcaagccgctgcgctacgacggcgaggaagacgtattcccggattttgtgctgaaggacgttcccggcgtcgatgcgctgccgatggaagtctttgggatgaacacgcctgagtacctgcagcgcaaacaagttaaaaccgctcattacgattcggaatacggtgcgggaagatggtggtactggaacgctgcagagaagtcagacttgccggcatttccccctgcatgaaacggtgaccgtcatcagcaggatcacaagggggctatctgcaattcctgattctgtgcctgaccgtcaggttgtcagtcgtcactgtcaggggtatcttcactcacgcgtcaggaaaacagctcagtcagaacatatgggagcatgcagtggacacgactgaagaactcaatgacacctatttctacgcgggcagaccgaacctgaccgccggtgaactctttttcatcattttttgtgaagaagttgccgaacagctgggaatcgatgacttcggggcgatcgtagctatcctctcaggccgtaatgtcctgacgacccgcgcaaaaccccgcgatgcggaaaagggcacatcctacgcttcacgtgctgcgcgcagagtattccggaccgccaagttccccttcggcattcagctccccactgtcgttggaggatacccaccctggacggcgcgtatacgatggacacacaagctcagcacttttatagggcgtgcggttcctgtcgtgggctgggtgattctggccagagatgttgccgatatcagctttcacacggtcaaccggtataacaccatcgcccgcggggaggataagttatggtagatgagacgcaggcgcgcgtgatggcgctcattgagccgtggaacggtcgttccctgctgacgttccgaaaaaaaacactcacgcctgagatgtcgctcaatctggacatgaagcttgacccggaagatgcggcggaatgcctgcaaaacgtctttgatgcgttcggaatggattctgaccaggtcatgttcagcctctattacccgaaaaaaccgcgtgaggccatccctcttaccatagggatgctgatcgagtcagcaaggtccaggcgatggtgctatgactgatgcgtaagaaccagagacagtcatcagcgttaaggcatgaaagcctttgcggaaaacggccagggccgatgatggtagcgggaggtggcaggaacacttgaaatgcctcaatttccacctcctgagtgctgtaattgcaatgtgacctgtgagcgatatcaggaatcatatttcagtaggtcttcccgacttctgttccataagcccatcaaatgatctgagtgttgtctaacccagtctgaaagtatttttagtgactgccgattgtacttttctccttcgcactgcagaagactgccatcattaatagcaagaacatgcgcaccgttgtgatttctgaaaacaatccggggaacagcatcaggttcattgcatataaccaaaacttctccgccagtaaaatcttcttcctgaagtatttcgttcagctcattaaattgctggggggtaagggaatagaggcctaccttttcaagctctcgacgtccgtgtaactcaaagtcgtaaggtacatagacatcagttttttccataaactcaatggacagaatacgctccaccggtaatttttcagtgtgaacataccaggtgtcatgcttcagtttaggactttttgtccacctcatcagttcacggtcagaaaggctgtcgatattaacccagcctgccacgcccagtatcttagcccttagtgaaggctctccatatttgagcattatctgtttcatggagtaaaacgtatcctgtttttttaaccaatccgagtctacagtcaggcgtataagtcttttattatgggtgcctctgactgggcctttagtatttggacctgaagctcgtgataaaaagtttttagtgctctcggtgaggacttctgtaccatccactaaaccatgaccataaggtaatggggaagacgtgtaccagctgtgaccgtaaagcatccttccgtcactcaattgaaagtagcctttacttattcctcccgccgccaatatgttgtgtaacattgctacaccagtgaaatgatataacttcattttttttatatccttatgcagttctggctgtttctgaatgatatttctctggtttatgccgatatggggccagacaacgaacgcgcatctctggctgtccaccttgcctcaattcctttagcattgagggcacctgcaatacgctctgcctgctcacgactggccacagggaagctgacatgatgtggttcaaaccagaccatcacagaatgagtcatatacagtgaggcataaagcggacgaggctcagtcacaggcgttaccgcattacggtcgttgagttctggtactgcgccaaaaatgccggaaaggtaatcatccatgcgttcaataaaggcaggacgtactgttaaaagttcaggattatcttctgaactgttccactgtttcgcctgccgcctcagactgtccagaagcgacaacgattcataagggatttttttccccgtactttccccccgaatagcggactccagctggtttattctgaaagactgttgcctgattttcagcatcatataaatgcacagcagcaacatggccacaaacgtactgcccagtaaaatgttcatgtctgtattctctcagccatacaacctgatttaagcgagcccaatcgtgagcgggctttattgtttgaaactgttcacatgcatagtgttaagatcggtcaaagcaccttgtcgtgaccgcttactcacctctcagcatgatgtgttttctgcttccacatccttcagcagtttattcgcagtggagcatagccaggcgtaaagtttttgtccgttttctgagaaggtgttcagttggatatcgcgctcctctatatccccgtcacaatccctgatatttctcaggagggttcccagcgttccggtattatcatcaatcaccaccctggaccggtactccgcaaactggttgagggtaagatcgatataccatttgtccagcttagtgatgacgtgggattttattgatgatttgtgttttttcctgaagtcagctgtcgtttgcatatggacaattactggcatcagtgtcgggtagctgtccttaaggtactgtgccaggaagttactggataaataacagcatccgtgcgggaaattattcatctcttgccaccatcgcggcatcctgaaacattcgtgcgaacgggtgtcggcggcgagcaccagtgcgttgcggaaagcatgaatactgcgtctgatttctggtgtcattttttcttagtccctttggattctgcagaattttctttatgaatggcccatatccgtttgacctgacttatgctgcagcctgcaagagtcgcagtgcgcgcaatcgtcataccggattcgcgaagggcaatgatacgttcgtgtgttttcggttccggtctgcgccctttgtacttacccgaagcctttgccagctccacgccctgccgctgcctttcacgacgggtttcgtaatcgtcacgtgcggtctgtagtgccaccttaagcagcatgtcctgaaccgactcaagcacgattctggccacgccgtcctggctgacggccagctcggacaaatccactatgccggggatggccagctttgcccccttagcctttatcgagcctatcagctgctccgcctccgcaaggggaagacggcttatgcggtcaattttttcggccacaacaacctcgcccggctgcaggtcggcaatcatgcgctgaagttcagggcggtctgccctggcaccggaagccttctctttatagacgccggcgacataaaaacccctgccccgggcatcttcaataatactgttctgtcgcgtcagttcctgctcatccgtactgacccgaagataaatacgtgcaatctgcatagctttagcggtcccgtcttcttaacataaataatcgctgagcgcttcgcggccaccgttgccttcaggcatgacgctcacaatgcgcctcagcgcagctttgtgtaagggcgtactgttcacgagcgtcatcagccgccgctgtgcttctgtcgtcggaaggcaggcagacgagtatctacgggttctgaacagacggtcccataagctgatgtttatcagacggtctgtcataacatacatggctataagcgcatgacgcacctgaatctcctcctcaggtagttcaccttccgtgtaggtttctcccggaggactgagataggtttcatccagtggatggtttactaaaaggctgaagggtttcactgcgagctccgggaatgttttcagtacgggtgaacggttttagctgagggagtgaaattttctgtacgcggtcccctggatatttatgtaatcccctaccctgatttcaacgtaagcgtccggactcagaaacgcgattatctcagcgtgtttaatttcagtcgtgcagatgcgtaaccattccagctcccctgaaagcagaactccatagagcatcaggttaacgtcgttgaacgtggttacatgtacaacgcgttccacccttcccgaaaaagttttcgtatttgccgcaagcattcaacaccccttcttctttaagacctgatagtaggcattttaagtataccttaattggcctgttggttttcacaggctaataataactgaaggcagtttaatttggctatctatttattggctatctaaaatgtacttttaactgaaaatccattaataacctaatgttactttatctaagggtattgtaacattatggtatcaatcagatggggtcataatgattgttagctactaaatagcttactattaaataatattacatatattaacaagctatttaaattgcacattagccatactagtcatgattaaaaaaatctgtatataaaaacagtggtaaaatttattataaatattgactctaataatggggcttgctatcttcaactatgacgcatgtgttacaaccaatatagttggcgaacactatctgaagtaaggcaaccggctcacttaaaacgagttgccaaaatagaggtaaagacgatgacaacgatttcgcagaagtcggcccgcgaaatgctcggttctccagagcaattcagaggcggtgtctttgtgacaaaaaacggtgcagctgagcttttcattcaaaccgcggaagaacgtgaagcggaattggctgaacgttatcagcagcagcaggtaagcgccatgctgaaactggtcaatctttctcagcatgattatgaacaaggtcgctttagctcagcccgagacctattggcacggaggcgagcagcgcagaacaaataaagtaggagatataatggcaaaagctttcactacagattcaactgaacacactttaaatttaattgagacctataaagaacgacggatgttacgagccgatgctcaggctttcacttccgatcttcttgaacaggctattaatgacattgaagaaaaccccctccagtaccgtgaagattctgacgcattagagcttggtgttcgtttacgacgttggatcgatcccaccggaaagtacatttgcctcttccgatataatcaagccactgatgaagcaatcttagatatttttgccagtactcggcaggactggctttcgcttctttatttagtacagatttcccgcccatagattaaccaaatcttaatgtaaatgctcaaccctacatgttgttagttcaatagtttgggttctgttctaagtatcctcaagataatgtgactggactaccttcttcatgttagtcctttaaatcaagggttgatttaattaatcttgcagcaatgtagtagcatgctgcattattgctgcaaacaagttgaaagcttcttaattttcttataatttgtcttgcagcaagattgctgcttaattgagaggttgtatggcctggattgtcggattcatttcccagaaaggtggtgttggtaaaagcacaatgtcccgtgcatttggccgtgaggctaacgcaggaggtattgttactaaaatagctgatcttgatactgaacaggctactaccactgactggcatcgtagacgcctttccaatggtcttccccctgcctgttcagttgagcttttcaagactgtttctcaggcgctatccgttgcagacaatgtagatcttctcatcctggatgggcctgctcgtgcaagtaagggcacgactgaaattgctaaagtggctgatctcgtagtgcagcctaccggtgcatcactcgatgacttagttccagcaatcaaagtttttcatgcacttgttaaagaaggcgttccccgcagtaaactcgttttctcattgagtagggttggaactgatgctgaagaagctgatgctcgtgcctatatcttagaggctggctatgacgttctcgacggctgtcttttcgaaaaacccgcttaccgcaaagcaatgaacgcaggacttgcggttacagaaacccgatacaaaggtctcaatgaaagagctgatgaactgattcaggctctcattaacaaagtgggagagcaaaatggctgatttgtctgcattgaaaaataaatctaaatctaaatctaaagggttaggctctcctccggctcctgatgaatacgctacgagtttgaactctccagaggtcgcgccagcaccagatattgctgaagcggcaaaagcaccgtcctcagctggggcgtcactggaacaacctgttcaggagtcttatatcaagcgtgatggcagaagcatgcgcaaaaccaatcgcacaattcctttcgcgactcgcgtttctgctgagtttgatcaacgcttccgcgatatagcgtatcaggaagatctcaaaatagttgagctattggaaaaggccctgcaagcttatgcggaaaaacagggttataagtagcagctagattgctgctagattgctgctagattgctgcatgattaattttattcttattatatggagctcgaagttagcttttatttgtctgcaagatagctgctatcttgcggcatgctgttactttgagctccttttgttttattgattttatcttgctgcaatcatgctgctatctgttttcactcgttgggcattgttttgtttattttatgttgcagtaagattgcagcaatcttgctgcataaaatcgaggtggcttgttgatagctgattagaaaaaattgcagcaagctagcagctatcttgctgtcatcttgcttccatattctgatttcaggaaaccaatttgcagacctactgttcatgttatctgcaatcttgcagcaagatcatgaaatttactgagatatataagagaataatgtgagaaatattgaggttgagtgtatatctgagtccatccttagtgtatatttatctcatattgttctcaattaatgggtggtttgggatatgaaagtgttcatcgatgatggttctacaaacgtaaagctggcctggaaagacaacggcagtatcagaacgtacctgagcccgaacagcttcaagcgcgaatggtcagtggcatttggtgaaaaaccggttttcaactacaccatgaacggcgagcagtactcttatgatccgattgcaccggaagcggtgaataccacgaacattgcatggcagtacagcgacgtgaacgtggttgctgtgcatcatgcgctcctgcaaaccggcctcaaaccctgcgaggtggatattacggtcacgctcccgctgactgagttttatgaccgcaataaccagcccgctgcatcaaacatcgaaaagaaaaaggcgagcctgctgcgtccggttacgctgaacgggggtgaggcctttaaaatccgcagtgtctcagtcatgcccgaatccatccctgccggctttgagttgctgagtgagctggacccgctcgattcacttctcattgttgatctgggaggaacgacgctcgatatttcacaggtccgtggtcgcatgagcggtattacgcgcattcatggtgacgcaaccattggtgtgtcactggtaacgaccgcggtcgcggacgcgctgcgtgttgcaggaacgcggggcagcagttatcttgccgatgatattattgtccatcgtaatgatgatgcatacctggagcgccggattaacgatctctcccgcgtgagtctggtgaaaagtaccattaacgaatcacttgaacgtctcacgcagcgtgttctcagcgccatgaaggcgtttgaaggctatacccatgtcatggtaattggcgggggtgccgaaattattgccgaggccgttcgcacgcactgcggtgtgagggcagagcgcttttataaaaccgactcatcccagttcgatttggtcagggggatgattgctatcggataacgtcatggatacgcgcagaaagatccagttttacattaatcctaaaagcagcctcggtgaggcctatgcagacagtcacaccgatgaaactccgcagggtgagcgcggccgtctctggaaggcggccatgctcagcgggtttgcacttgagcggattgatccgcgcctgccgttcctgctgtcggaactgctgagcgaaaacacgacggcagaagaagtgcttcaggtgatacgggctgtcagccctaaaagcgccaccgcgcagactccgtctcaggctgaaagcgttcctgagccggctgaagcatccccgaatgccactgtcgatgaaacccgcagtaatgccagaggcatgttcggcggaggctaatttaacgaggtcatcatgaacagagtgatactgctggtaacgggctttctggggttccgaaagctcaccggccaggacaggaaaagtgcaggggagtggggctttctgctcagcatgctgtttatcgttccgctgctgttctgggaacatcccggcgtcatcgtttctgtggttctgcaactgctgtgggcagccgtcgggacacgctccgcttttctcgccagcgaaacgtggaaaaaaaacaggcagaagcgctgaaacagccagtctgcataaagagccgcgcgctggttcaggttacccgggcgaccggtatatcgctccaccgcgtggtccatgccggtgacagcatgtcccgcttcatcttccactcggtatcaattccctgacccgcaaaccatacccgtcccagacctgactggttgatgccgtccagcacctgcatcagctgcgcgctgttcgcccggggccggttgtcgtcaaacaggttcagctgactgacgccgtgaggcgtgaagtcatcgagcatgacgccggccttcatataccggtggccatcaatccagatgcggtccagcgcgcgcatggccacaccgatgatgtcccgcgtgtcatgcgtgggcagggtgagtttttccccggccgtgttgccgtaaaacgtctcgccgaccgcatgcggcgaggtccggacaaacacgctgatgtgtctgcagtactgacgttcgccccgcagcttctcagcggcgcgcgtggcgtactggcagagcgcctgctgcatggccactttcgtggtaatacgtgaaccgaagctccggctgcagacaatctgctgctttgccggcggcatctcttcgaggggaatgcacgcctcgccgttcagctcgcgcaccgttctttccagcaccaccgaaaagttcttacggataaaagcggggtgcgtgcgcgccagttcgagcgcgttggtgatgccgagcaggttaagctttttgccgatgcgacggccaacaccccagatttcctccacgggctggcgcatcagcagcgcctcggtccgcttcgggtttccgggcgtcagcgccagtacgcccttaaactggggccactccttcgaggcccactgcgctgatttggccagcgttttggtcgggccgatgccggcgccaatcgtcagtccggttctggccagaacgtgggcacgcagtcggtggccgaagtgttcaaagtcctcacagccatcaatgccggtcagatcgaggaacatttcatcgatggagtactgctcgactctgggcgtcatttcctcaagcgctgacatggttctctgcgataatgaatgatataaggcgtagtttgagctgaaaatgtgaaccttttcagggaaatctagcgcttttaactgaaaccacggcacccccatttttatgcccagggctttggccgctttgcttcttgctatgacgcagccatcgttgttcgaaaggacgacgacaggttttccccgcaaatcaggccggaaaagggcctcacaggacgcataaaaactgttcacatcagccagaccaaacatcggcatggttacctccggcgcgcctcggtgttgtggaaaaaccaggtgaccacgcccagcaggtgcagctcctccgggtatatcaccggataggccgggttcatcgggcgcagtgcaatctgcgggtgcagctgcaggcgcttgacggtgaactccccgccaacctccgcgatgacgatgtctccgtggctggcttccttcgcgcgatcgacgaccatcacgtccccgtcgtacagtccgaggtcttccatgctgctgccgctggcgcgcacaaaaaacgtggcggcccggtgggtgatgcagagctcgttcaggtccagttccgcctccacgtagtcggtggcaggggaggggaagccggccgcacagcgctcaacaaacagcgggatgcgcatgacggggcggatgtcggcaggcctgaatatcgtcagcccgccccgggaggatgtcgttttcatggcgccgctctccggactgaatggcctgaggccggggcggttgtgagtgagtctgacatggtaaatttcctccctaaatagcactgtatataaaaacagtattattgagccggaggcgcatggcaagaggaacgaaacggtactctgtcaaagggatgcctatgttactgagcaggctaatgatttttttgtcaggcggtttcagtcaggggagcgcgtaagcagtctttgccggcaaaggtgaaatgacgcttcctcgacacggctgttcgttcctcgctccgctgcggtacgcctcagcctggcctgcggcgagcgttgccacctcgcgttttaagggcggaataatcgcacagtgttattgttgttcagggcgggtgagtgttttatcttccgggaaagccacagacggaggaggtatttatggatgagcaggaatcagtgggccgttttctggcggcgctgctggccgaatacaacatgagcgtggacaaattctgccggcgttcccggctgcgggagcatgaggtcaggctcattctgcgggacgagcgggttgtcacacccgccgtggcggaaaatctgggccgggtgttttactctcccggcttctggatggtccgccaggcgatgtctgagctgaaaaaactcagtgaggacagctaaaaaagcccggcatgccgggccaaatacatcaaaaactgccatcttcagactgacgcgccggtgtgcagccggagaaagcgtagccgcttttccctgtattactgttagcagggtgtttcactttgtgtgcgaatataaggcagatgtgcagggatctgacctttatctgcctgagcggccacggtaaaaagtgtcaccgcttacgcttgcagacggacggggtagtcgacagaattatcccctctgccacaggcagagtaacccactttaagtctgatgatttgccgccctctgagcagggcggctttttttcccccgggcatggcgtgggtattcagcctgcaggcagagcgccggaaaagtgatatgcgcaaaaaaaagcccgtcagcatgaagcgcgacgggcctgcccggaggcgaggacatctttcagacaacgaacacatcacagcgccagacagtaaacccgcgctgtgtgacagatgtatgtcagcctgagcccggttttattccgctgtttcgccgctttttcccgggctgtgcttcagggaggccagtacattttcgatgatttctgcagtatgggtgagggccatcagctccgccatgaggctcacatccgcacgcagcaccatgtctgcgacgccgggctggctgagcaggggcttcagttccgtccccatgcgtatcaggtgcgcaaggttgttggcaagggtctcatgacaggcgtaatgcccgcttttcagctgcgttaatatcacctcaacgtcggctttcatgcccctgatggcttcgatgcactgctcttcactgtaggccttgtcaccgtcagacacggaaggcctccaccattcccctcagcgcgtgcgcctgttcagacagcgactgcgaagccgacgacgactcctcaaccagcgccgcgttgttctgcgtcacgccgtccatctggctaacggccacgctgacctgtgaaatgccctgcatctgctctgatgacgccatggaaatagtgtccatcgcctccgccagctcaccgaccagcccgaccactttcctgatgctgtgcccggtggacgcggcaacggtgacgccgctttcaatctgctcaacggcctgctctatcagcaccttgatgtccttcgcggccgtggcgctgcgctgtgccagcgtgcgcacctcaccggccaccacggcgaagccgcggccttcttcacctgcccgggccgcttccaccgcagcgttcagcgccaggatattggtctggaacgcgatgccttcaatcactgcggtgatgtcgcgcaccttcgttgcgctgaccgagatgtcctgcatggtcactgacatgcgctcaacgtcagacccgccggcgtgagccatctgcgccgtactgcgcgcggactccgcggtctgctgggccccggcggtattacttttcaccgtggcggtcagctgctccatgctggcggccgtctcctgcagcgcggcggcctgctgttcggtccgggaggagagttcggtgttgccctgcgcaatttcgtcggcggccagggccacggaagcggaggtgtccttaatctgcgtcaccaggccgcgcagtctggcctgcatgctgtcgagcgaggccagcaggctggtcgtgtcgttacggcggagcgttacgggggacgtcaggtcaccggcggcgatggtggcggccagcgcctgcgcctgcgcgggttcgccgcccagctggcgcatcagtatccggatgaccacaaagcaggcgcctgcggccacaagtacggaggcgcccgtcagcagcatcaggatgagcgaggcgcggtcggtggcgcgactgttctgctccaccgcaacctgactgttgcgctcctgtatctcggccatatctttcagggccgcgaggagcttaccctgaaccgggcgtaggtcccggatgagataatccactgcctgctggtcgaggttggccagcccgagctgaaggcctttatccacggctgcaaaggtggggccttcagcgtcgatgatacgtctgtaggtttcccggccagcaggtgtcgaatcggtcttcatgatgtcggccagggcctggcggttggcgaaaaacagggctttctgtttgttgatgcgctcaacttctggcttcatcagcgccgggtcactgaacataatgacgttcctgaccgcaatggcgatgtccctgttttcgccgaacatcgcctgggcgagctggtatttcttcattttaatgttaacggcgtcgtccatgccctcacgggcatggtgaagcgaccgcagtgccgtgccggtgcacagcgtaagcaggacaatgagcaggccgaaacctgcgataaggcgggtggaaattttcataaacgttctcttttttaagttttttctgctgtgtttgcgtctgctgacgacaggttactatcggcatgcgttatcacttgttctatgtctttattggcaaatatttcttatcacttgacggcctttcatcaccgtctcctgcggacgtcgctgcgctccgcttctgaccggcgttccggctccgcctgacgccggacttctccgcctcctctgacgcatttctctctcttttcagggcctgcaccgtgccttcacgttagccgggccgctgcacagtcaaggaccgctggcgctcggcctgctcacccgttccccgccgtgcgcgggacattcagtccgctccggcggcgcgtgcggcttcgcgtccgcccgtgactgctccgcttttcgcccggctgctgtggcggcacggcgcaggtgaggccgtgcaaccactgactgaggagagaatcatgccgaactggtgtgcaaacaggctgcgtgtgaccggcctggcggagaacgtgagtaaggtgcgggcgctgatgcggggagaggtgcgccctctctacgcgcgggcggaggcggagggtatccagctgtttctggcgggctgcgccgggctgctgcgtccggtgacggacgaggcgtatgcgccttatccggcgctgacggcggcggggcggggagaaaacaccccggcaaacgcggcatttacggagtggctcacgcagctgcgtgacggcgttgcactgacggaggaaaacggcgaccggctgcacgacctgtggctggccaccggcctccggagccggacgtgggagacgctggacagtgaggcgcaggcggcgatgggcgacatctggcggaaaaagcactttgactggtcgggcctgggcggggcgggcctcagcgaatgctggaaccgggtgtgcagtgaagatatcgctgaaggcgcagcggcgtttgacgtgcgcctgctgctgccgacccgcctcgacgtggaaatcaacggcttcaacggcgggctgctggacggcgtgccggatgcttaccggttttaccttgccctttatggcgtgaaatggccggaaggctaccagctggaggtgggtgacagcggccctgacttcctggaggtggattttgacacgccctggtctcccatgcacgaccgcgtgttttccgtcctgagtgagcggttcggtgtgaccgttgaacactggtacgccgagcgcggctgcgacttctgcgggtacgacacgtacagccacggtgaactgacggacagactgagcagttcgctggagtggggtgaagaggatgaggacggtttcgcctgcgtgaccgggccggactggattgtgaacaacgtcgggcattacggcggctgacaggaggcggcgggggaagccccgccggacaacgacatgagagaaatgacggtacgtgaatttaaggcgcgcctcgatgccatcggggatgaccagctctgctgcggcaccttctggctggcagatgacttcctcagcattgacccggctctgactcaggaagaaatcgcgtcggcaatggcgattgccgaagacaggcatgatgcgaatgaggggttcaactggtggcatctggaacgggccatcagtgaaatgaaacagggcggtgacatatgaacacctggcttgtcagctggcaggaagaggtgggcagcacctcgcacgagtatcacatgctgctcagggggcgtgattttcccctggcggaagcagcgtgcgagcggatgggtgaaaactggtggccgccggagcggcccgtctgctcacagggctgctactggcagtttgaccggggcagcgtctggctcaaaagcatcgttctgctcgatgaccgcgaggctgataccctcaccggtctgaggttcctggatgaatgggtggtaagcggcacgccggatgcgcccgtcatctgtgaccgctgcgactgccggtgggaagattaccggccctgacctttcaccccgatgccgccccgaccggcggcatcatctccagaaaaccctgagtatgtcgctccgctccgcttttttgccgcttcccgtccgccggccggaaaccggcagatgcaaactgccgtgccctcactgtagccgggctgcttctcagacaagcgaagcttcgccgggctgctcacccgttccccgccgtgcgcgggacattcagtccgctccggcggcgcgtgcggcttcgcgcccgcccttgtctgctcagccggtcgcccggctgggtgatggtcacggcaccacaggggtgccccctgagactgaggagcagaactatgtcccgattcatgcgtggcgacagcgtacaggtaatggccggctttccggataacagcatcgatttcattctcaccgatccgccgtatctcgtcggctttaaggaccggtccggccgttcgatcgcgggcgacgttaacgacgagtgggtgctgccggcgagccggcagatgtaccgcgtactcaaaaacaacagcctggcggtgagtttttacggctggaaccgcgtggacatcttcatgcaggcctggaagacggccggtttccgcgtcgtcgggcacctcgttttcaccaaaacctacgcctcgaaatcggcctttgtggggtatcagcacgaaaacgcctacgtgctggccaaaggccgtccgccgctgccggcgaacccgctgcccgacgtgatgccctggcagtacacgggcaaccgtcaccacccgaccgagaagccggtgagcgtcctgcggccgctgatcgagtccttcacgaagcccggcgacctggttctggaccctttcgccggaagcggttcgacctgcgtcgccgcggaccagtgcggccggcgctggatcggcattgaactgctggagcagtaccacgccgccggccttaagcgcatcggcgaactgcgcgccgcccgggccgcctgatttatttcccttaacccgaccagaaggacagcaccatgacagacccgaccctgaatacagaactgactcagctcaccgacgacgtgaacgacctggaggagtcgctttacgagtttcacctgcggctgcgggacatggtaaagcgcaacctttaccgcggcgcctcgccggcgcagaaaatggcgggcgtcctgattgaggacatggacttgcagctcctggagctttaccggcgggccgccctgatgcgcaagcacctgaactgatataccggagtggtcattttatgaccactctttttcagttcgcgggtactgccgccgcggcgcttttatccacagggttccggccggtttatgcaccgggctgtggacaacagggaataaggcggttgctgcgcgccgctttatgccgccttgcggtgggggagggcagaaaacccggtccgtgcggtctgcggccggtgccgtgccttcactttagcccgaccgcctcgtggtaaagcgcgcctcctcccccgttcgcactccctccgccgcgcttacttccgtcgcgcttccgctcagttttcgcgtcagcgccgtgcgtaatcacggctccgctcgcttgcgctgcggcctcgtcgtcgcgcttgaccactgcggcttttcgtcgggctgtcattcaggcacggcacaggccggaacgttaatccattctgactgcggagatatctgatgaacacacaaccccacgtttacccgccagcgtctgtcctggcagatgctgaaaggctgcactttcttcctgcgctgtttggccacgacttcatgcgtgccgaaaacaacgtgtacctctacgccgaccgctatctggccaactatgacggggcggtgtgggatttcgtcagggtgccaggcgtgccacacggcggcggctacatgaagcccgccggagaagaacgctggcagttttccagtccccacgtctggactgaccttgaaatcagttcggacgcggcggggatcatcatcacggcgctggtactcaatcaccgtagctggctgtacgaccgccacgacgacgaggaactgtgcgcgcatttctgccgtcgctaccgccagctgaccgcatttgcacaaattcatcccgaagccgccgcgattttctgcgcccttgactgataacccacggggcggcgggccgccccagacaggagaaaaaaacatgcatggcaccgtaaatgaagtctgcgcctagctgctggaaacttatatccctggctgcaccctgaccgttctggtgtggacaattgaagatgtggaagtctgtagcgaagacatgggcattaccgaacaggagtctgtcgaggtgctcagacgcatctcacaggatgaggactacattgagcacggtatcaacagacagaccgtatgggagcatctcagcaacattcgggcgatgcatcaggtgcgcgaagtcagccttgacgccagaagccttcagatgctgatcgaggccgcagggcgcttagtccagaccggaggagaggacgaccccgacccgattttgcaggccgtcgcccaggcgagagtggctttaaacaggtaaggagaaaaaatgaaactgtcaccgcaaacccgcgacattcttcgccattacagggcgctgattaacgagcaccgccgcagcagtggactgagagaactcaggacggaggaagtcgtggatgaaatctgccatttcatgacctgccagtgtgccgtctacatcggcggccgcttcattaagcaggacggcaggggataatcagcaacgttcaggcggttacggccgcctgtcagtccgcccaaaaccctgcgcctgcggcggcagaacgtcagaagacgcgcctggcggcgcgcttcctgccgttctgcttattccggcagcgtgcagcagatcaggggaaatagaaccaggccgttgagatgaggccatcggtgatttcaaaaacggcgatgctttcaagaggcgagggtgaaaggccgtgaataaattcatgatcaaacactttattccccagcaccgttcttgagatcagttccgcccggagtgcgggattgttgaaacggttgttgatgtagaaatcacgcagcgccggtttaccctgagttgagggcatttcagcaggcatacgatagcctttaaaatcttcagcaaagcaggccatgaaagcgtcgatatcatgggcattgtaagcctcaaactgagcagcaacggggcggataactgacatacttaacctctctttattgaatttatatgctatttattagcattaatattcaatttagagaagcgatatatgatcccgttctcagttcgctgaagcttaaaagtaaaaacgttctctgcaccgggcgtccggtcggctgtcatgctccgcacagagccggcaggccgtctctgcccggccccgttccggggcagcgggtttccatcctgacgcaacaccttccgcttgcagcagccgttccggctgcgccgctcagtcgcgccgtacacgtcgcaccgtgcatcccgccacaacacacggcgggatgtaaggggcaacgccgtttcgcaaccgcgctcaacgccattgcggcgggttcctgctttcctcagaggttgtgttcgcccgtctgagtcctttcgccggggctgagacaagcacaaaccgcctggctgtccagggacggctgaagcctctcgccggaaaattttttgatgtggctaaaaatttttccgctcgctcccggacacctgcaccggcccgtgcccgttacgccctttgcggcgaacggctctcaaacgggtgaaggatacaacctggggacaaagcagcagttccccgcaaaacgtcaagaccgcggccccggcaactcaacgggtgacggtttttaagggcaaaaaaacagaggggatttcagtgaaacagtcagcaggggtgcgcttaccggacgacacctttacgcgtgaggaagcgacggcagtcgccgcgcagtacaccaatgttgctattgaagacgatcaggttacgcattttcgcctggtcgtgcgtaaagacggtcaggtggtctggcgcgcgtggaattttgaggcaaacgcgggttactggctcaaccgttatatcggtgagtacggcatccgcaaggtgcagtaagcagtgaaaggtgccctgccggagaggtcactccgcagggcgtgacagtcattaaacgaatgaggtactaacgatgtcagtagcagatgttaaagcaaaagcccctaaaaacaccagagttaaaaaagtcaccgacgccgagcaggcggcggtcagcgcggcacttgaagccgcgccacttgaacacgcgcctctgtcggcgttcgtggtgtcgccgctcaatgcgcgcaccattccgtattctgctgagagcgtggagagccttgcggccaccattaagtcggtcggcctgttgcagaatctggtcgcccacgcgctgcctgacgggcaactggcggttgccgcaggcggcagacgcctcaccgccctgaatctgctgctgtctcagcagattctgagggccgatcatccggtgccgttcaagcgcgtgtctgaagacatggcggcgctcgtctcttacgtcgaaaacgcccagcgcagcgacatgcatgcggccgagcagatcgccagcttcggtacgcaggcggcgcaggggaaaaccgccgagcagattggtgcagaggtgggttacagcacccgccacgtccagcgcatgctcaaactcgcgaacctcgccccgtcactccttaagctgctggcagacgacaaactgaccgttgaacagtgtcaggtgctctgcctggaagacgatcaggaacgtcaggtgagcgtctacgagtcggtgaaatcgggctggcctgaactgcccctctccatgctgaaaaagcagatcaccgacaaagaaatttccgtcactgacgatcgtttcctgttcgtgggccgtgaggcatacgagaacgcaggcggcgtggtacgtgaagacctgttcagccagcaggacggcgaaggaacggcagacatcgtgctgctggaaaaactgaccgtgcagaagctggaggcaatggcgcaggaaatccaggcacaggagggctggaagtggagcatgggccggatgaaatctctgtggcctcacggggatggtctggaataccgcctcacagacgagcctgctcctgtttatgtcggtgaagaagaaaagcgtatcgaggaactcttcaacaaacttgaatactgctccgagaacaatgacgaggacggctacagcgcggcttctgatgaaattgacgccattgagcaggccgcgcagatccgcgcatggacacctgaaactcgcgcaacaacgggcgtggtggtcggtttcaacgcttacggcgaactgtgtgtggatcggggcgtgattcgccttgcggatgtggagacggtggaaacggaagaaagcagcggcgcggagcagccacaggagccgcaggagagcaccgccgagccatccggtgccagccgctttgagtatcagtcaccgcccgatgaggccgagggcatcagcctgccgctgctcacgaaaatgtcctccgagcgcacccttgccgtgcaggccgcgctgatgcagcagcagaaaaaagccattgccctgctgacctggcaactctgccggagcgtgttcactgccggttatttccgcagcagaccgttccggatcagcctgaccgagtcacattccaccctgacggggaatgccccttccggcaaggacggagccgcctttctggcgctcacggtggagcgcaaaagactggaagcgctgttaccgaagggctggggtgaagacctcaccgcgtttttctcgctgaacggcgaaacgctcatggccctgttgaccttctgtgtcgcctgctcggtagacggcgtccagacccgcgaatgcggccacacctcgcgcagtaacctgattgaactggaggccgcgctgggcttcaacctgcgcgactggtggaacccgacaaaagccggactcttcgctgacctgaaacacgcccagattatcgatgccctgaacgaggccggactcacgggcgcggcgcgggatgcacagaagatgaagaagggcgacgccgcagaactggctgaaaacagaatgcgagacacgcgctgggtgcctgcctggatgaaggggccggagccggaaaaggccacggacgacgccgctgccagcgaggctgacagcgacacggacaacaacgatcccgctcacgcggcctgacagggagcgcggcccttcggggccgcatggaggacatcatggaaaataccgtaatgaacaatctcagtatgctggcgtcaatgcatccctgtgagtttgaagagtggcgtgagcggggcgagggcgaaagacacgtactgaccagcgccgtgctttccctgctgaccgtcccggcgggctggacggtcaacggcgagtaccgggccgaattcggcggcctgttcccggtgcaggtgcgcttcgcgccgcccggtgaggcattctgcctgtgcgtgtgcagtcccggcgaagtcgccggagagtggcttgtcctgatcgcgtcggcggatggcggctgcgtgcgcgacgtcctccggctgacgccgttcgacccgccgcgcatcagcgccctgatcgccgctgcggcgcaggcctgtctgctggagtacagcgtcaccggcctggccgattacctggtacaggagggcgatgcatgatcccgaaaaaccgttcactggtgccgctctgcgaggccaggcgcgcgatgcttcaggctgttgagtacgtggagcgcaggcgcgagcgtcagacgctacgcgctgacttcccttatgcgcaggcgttcttccgcttcctgaagggcagtaagcgcatcaccctgcgtgaactgcgctttttcgatccgattctgcgggaggaagatttacggggccgcaaacgcgagtggctgcgggccgttgactggctcatcgaaagcgggggctgcgccacccacccgctgccgtcggacgcggcccgcctgctctttccggaagtcatctttcagtgcggcgagcggcggcacaggaaggccgagatgcgcgccgaaaaatacagccgccagtttcgccgcagggaggccctgaaagagcgggcggttcaggcgctgacggcgcaggctgaaatcgaactcgccttccagacgcctgccacggtcgccagctgggcctcaaagtggtcagacacagaggtcagcgagagcgagctgatcagtcagttttaccgctgggccgatcgctttccctcgatggccggttttgtccggctgtatttttatggcgaaccgctgtggcggctcaccgccgaggccggtttccggtcagaggaagcgggcgaagcagtgcggctgctggagcgctggatggtgccaaacaagctcacgcaggtcagggaggaagcatgagcagaggcgattacgttaccgaactgaaaacggcccgcagccagcgccggaagctcgccaccattcgcgcgaaaataaccgaaatggtgtctgaatgggacggcctttccgggccgctggagacgggtacggagcagcttctgaaggcgcttgacgaacacattaaagcgctcgatgacgacattgaatactggcgcagcggcggtgattctgacgatgaatgacagagacgctcagaaacgggtgttaatcgcagtacagtggagagagtattctccggtaatatagcgccggttgaggcgcttaaacgtagggtgaaaactatgactcacgtatttgtttatctcgttatcgcaaccggagtactcggtagcagtaccggaacgtcaccccgatgcccaatatggatgtctgcgagcagttcagggaaagcatttctaaaccacggggtttaaccagtgtcccccccgcccgacatggtgcgctgtgttgaggcgaagaccggtaaacctgttaatccgtgaaatgagacagagaggggtgttatggatttagtccaggcagtaaacatgcatgaggtgatgacgggggtgaataatccgctggcgctgtcactgatggcggtcatggccgtgtgcagtctgtatgtcatgtggcaggcaggaatgagggctgtacgttttatcaggctgctcatgatgatgcgctgaagctgaatgatggccccgctcagccgggcggggttgttcagtggttgtcctgaggcggacttttccggccttttcctgtctgtgttcaccttcccggtattcattttctcagtgctcgcctcggtttttctctcaggttcctcttaaagcaaacccctgtgaaacatggcccccttcggctcctgccctggcgggcagtcgtcagccccactccgaccggcggcggaaaagctgccgcccgtctccgccgaaccgcaaagggccgcgtttcgggcctcccggctaaggtctgatggctgaggtcaaaggctgcaaccggctgtcgccggtgcgttcaccgggcgcgggcgccctgtaaggccgtcacgccgttccgtcgtgccgcaggtgttcatgctcatttcatccccgtgcggctgtcctgttccggttgttctgcgcggagggctgacagtaccaccgtcagctcagacaaacaggggtgaaatgcactcagccaaaaacttttcgcatacccccgcaaaaactttttgtcttcgcccctggttgtcctccctttgccggtgccactttgcccttcgccgcgccgtaccaaccgaaacagggtttcagcaaccagaagaggagaagcagcatgaacacacacaacgtcaaggtcaaaaccgccgcaaccgaaaccaccgaaacgcgggttttacggccaaacgtcaacggccttccgtccggtgtcgcgcagacgctggcgtttctgggccatctggcagaagacggcatggaagagagcgaacgtgcggaactgctgctcggttcgctgttgagcctcgcggaagccctgcgcgatgccgtgccggactggtcagcccgtcgcccgcggctgccgtttccgctggttcgggcgtggctggcagcgcgcgacattgccctggctcagttcggtgaaaccgggcagggcgcatgggaatacgccctgaacgacctgcgcacggaactggacgcgggttttcacttctggcgcgaaaacatctggtgatttttatgcgccgcgcaggcggcgtacccccccaaccactgacagggagaactttatgaacctgattatccgtgacgtcctgacgggccttgatgctgacctgctgaagtgccggaacccccgcgaggcggcgtttatcgcctcactgtacgacggtgggcgcgacaccgcctttactggcagggccgcgagaaagcggcgcttaaagcgccagcggaaattgacgtccaccgctttcacgacgcgctgggcgtggcgtatccgctggactggtcatgcagtgaagacggggagtgtgaaacgttcatgctggccgagttttactgcgggcaggtgaccgacatttacgcccgagccggagcgcgttacttccggctgcgggattattcccacctgagccacgcgcagatcatgacgcgcgttaaggaggcctttgacctgagtcagaaatgaaaaaagcaggcctgagcctaatgccgatcatttaaggatcggttgaccgatccagtgacaggtgtaaaaagggttcatgttcatcatggacccttttttatggaactctcacaggctctgggcatcattcataccacctctcccgaacgcgcccgctcgctctctgatcttattcccgctgagcttattcagcaggccctgacactcactaacaccgtcacgctccgtaaacgtaagctcccgcttgagtctatgatatggcttgtcgtgggcatgtcggtattcagtaaccgtcccatgacggaaatcgtgaacctgatggacatctgcgaccgcaccgggacgcccttcacggcgcgcagtgccgtcgtgcagcggcgtaaaacactcggtgaagatgccgtacgtgagttatttgatatcacccagcggtactggcatgagcaggccgcccacccgcagtggcacggcctcaacctttttgcgctggacggcgtggtctggcgcacagcggacacgcctgaaaataatgaggctttcagcaagcccgacaatcagtacggtgtgcaggggtatccacaggttcgtatggtgtgccttatggagctgagcagccatctgatcaaagcgagcgctttcgatactgagagcgtgaatgagatgaggctcgccgcccgggtgaccggtaacgtgccggataacagtctcactctctttgacaaaggcttttactccctgggcctgttgcatcactggcaccaggcgggtgaaaaccgccactggctgctgccgttgaaaaagcacacgcggtatgaagtcgtgcaacgtctgggacggggcgacgagctggtgaggctcaaaaccagcccgcaggcgagaaaacagtggccggacctgccgtcagagataacggcgcggctgctcagccgcagtgtggacggaaaaatgcggcaggtgctgacgtcgctgacggatgtaaaccgttaccggggcagtgatgtcagtgagttataccgcaaccgctgggaaatcgaactgggttaccgcgaagtgaaacaggggatgctggacaaccggtggacgctgcgcagccggctgccagagttagtgcgtcaggagctctgggggttactgctgacgtataacctggtgcgataccagatggtcatgatggcggctcagctcaggggagattatctgccttaccagctgagcttcagcggagccatcagtgagatatcgcggctgctgatgacgttaccctgggcttcgccgggcacggttccgggcgaactgagaacgctgtatgaaaaggcgagatggctgatactgccggggcgaagagaacgaagttatccgcgggagctgcgaataagatcccggaaatatgccgataaaaaaaaggctggtcaccttaagtgaccagcattaggcctgagcctgctttgtccacgccggatgtgacacccgcaaaagtttgcatccggcatcgtaaaaccaacatggagtgataaatcatgcagtttgacccgcaaatcgtgtcacacgcgcaggcatttgtaaatgccctgcgcaaagggaagcgcgcccgtgttccggctattcgtctggagcactggcagcagttcatgacactggtttacgcaggcctcggcctcgcgtgatgtaaatccggccgccccctgcggggcggctgtttaaggagtggtttatgtcacagttagattttgccggtttttttaaccaggctgaagatcccgcgccagtgccggttgccgttcccctggcggctgcggcccgtgagccgtcacccgaacaccgcatgatgagtatcgagacggcgcgtaaacagtttgtcaacgtgttcaggcacacggcccggcacctgcgccgctgggacgtgttcagcgacttcatcacgctggcggccagtgaactcgacctcgccacgatccgcgcaccggaaagcatggaacgctgccgcaaaatctgtgagcgctacaggccggaggacattcaggatcttcaccggcttttcagtctgatggtgagcgccctggaagcgaagtttcatgactttctgggggccattttcatggagctggagctgggcgacggcagacaggggcagtactttacgccgtactccgtacagtcgctgatggcgcgcatgctcatgccggg

SEQ ID NO: 18 - DNA, 4650 bp, Pantoea sp. OXWO6B1
ccgaggtttttaggatgctccaggctttttatcaacaattgcatttggataaaaacctcggtttgggagaagccgcaataaggaatgggattaccgcgctagatagtgatgatggctggatgtctgttccagttagtattggcggtaaagttagaaatataattattcaatgggggacatggaggagtggcacaaccgcagacaattataaatgtaacattacttttcccattccgtttccggttaagtgcgcttgtgtaacaaccagcacaggtgtctcaacccctgattatgaattctcaagtgcttatcgttcacttagacaacaagtctctattggttcacctggtcgcacaggtgccgatgcacatttctttattgaatctggtgatgttggtcattccaggtgcttttcttggttggcaataggattttgaatcgatgcttgattttatttatagaggaatcgataaagaggctatctggttgagttacttaatatcgaaatctaactgcgatgttggtgatgacgatcctttcattagggtactgggtaagtgttttatttaacgatgtagttaaaaaagggaatgggttcgtgactcatactaataaggctataaaacacaaggtttttattttaactaaaaaaatataatttagttggtggtgagagtttttaaataaatataatattgcatatttgcccttaaaatgaatgaagaggtggttagactttctaaatgtggtcagttgatattgatgtatttaaaatatgctgatgttattaccttttctaaagttgaataatcatagcttcttacatgccgttcaaccaacattaaaagccgtaagcaattttacggctttttcataaattacagttaaactgtaccggcttcatggctcaagatttcgctgaaaaatatcttttagatttaccttataaactgctttgaagagttttattcacattagttaataatatcttgtaagtatgatttttaatcgcgtaaagtaattgggcttgccaaacccgagtgacattatcaacctcattaatacgggcattcatctttgcagaaaagtccgggtcgcccattagtgaaccagactccctggcagtcagcaactccgcaatttggttagttaaatacaatggtgtgatatttagcactgctacttattctctgatggcgaagcgtttcccaaaaattgaattactattttatatagaaggctgttctatgatgaaatcataatcgaaacctccatgatagaaaatagtcagatttttaataagatcaacactcaggaaaattgattggcgagatgattagtcatgaaaaaaagataaccaactagattggacacagcagaacaggcataaagttcattactggtcagtgcaatactaatgattattttctggtagtctgaacttcagtcaggcatcattagtgataaagataaggccagcctgatcgattggctgacctatatcaggggattaaaagaagttaaaactactaacgtaccagatatcacatggcctgtgccatcggaggtgtcggccaactaatctcaggggctgtggaaacatccacgaccttcacagcagatttatatgccatccatgctgaaagctttgctttatcagtatcgctaatctctccaagcaacaattcaattcgccagtcagatatcattatttcaacttcactcaaaagttctcgacgaaatttctcagcacttgctatatctgcttcgtgttgggccaccagatccaaaatccagttatccccgtcccatttatcatattgtgagcctggctttttgggcgtggtacttattagataatctcccaaattttttataataaatggttttccgtttgtaatatcataaacggtttcaccccgatgatcgctaacgtactcccaggataaaagatcttcagtcctgcaaactgccattccatccttattttttaaaggcgcatcgatacatgaattggcaggaatgccaacacctaaagccagactttcaatgccggatgaaaggtattcacgtgagatctcatcaaaattataaactctgacgtccccagccttaacggctataaagtttttatctaattcagcctggttcattatgcagcccttacaatataattaaatgcgatattcctagggcgcatggttatccatacagaaccctctttattgtaaactgtattactagcgcctccactaacgccattatcctgagcaacactgtttgtaagatctgaattattgggtgcccgataaataccgcctggcgatgctactgacttagttacaaagtcggccccagaataggccataccgatataaacgccactactgtcaacatcactaccgttataatccatcatggctgtacgaagataagtcggaatctgggctgctaataactcacggttagaatcgactccccgcccatcatcccatccacgaataaactccccacgtaaatccggtaattttagtgatggataggcctttgccagaagcgggtactgagcagaggtgatagctgcaccattacattttaaccagcccactggcgggttcgctgacggccagggaacaggcactccaaccggcaaagcggagccttctcccaaactgaggtttttatccaaatgcaattgttgataaaaagcctggagcatcctaaaaacctcggtttaaatgaaatgcttttgggacgattgttgaaagtaaatcttttcagccaaagtacgacttacgttaagccggctgctcgattgctaaaaataatcgttacgggcggaggtggaggtggtggtggtactgtcgctgttggaacaaatcagggggctgtgggttcaggtggtggcgctggcggtaccgcaatctcctggtattcagttgatgagctcgaatttcccatattgataacggttggcagaggcggttcaggcggagtaggaagtaatgagccgcaatcaggacaaagcagtagttttggacgatatctttccgcatcaagcggtgccagagctgcgagcggaactgcatttaactatggagagaatcgcctgctttcaaatggtggaggtggacagggttatggcggtaatcatatgaacgttaaaggctctgcaggaacccctgctataaccttaagctcgggctatgagagtggaggcggcggcgcatcgtatttttgtgcgggcgggaatcccatcgctgccggctcagctttttccggtgatccaggcgcattaggttcaggaggaggcggaggattttccgtaagtaattcatctgctcagactggtgggaatggaggcgatggattgattatcattgaggaatatgcatgaaaacgtatgcaagaattgaaaaaaatatagttaaagagctattttccactgagggaaaaatcacaaagcttttccatcccgatatgcagtgggttgatattacatcaagcggggtgaaaatagctgaaggctggaattatataaataacacattcattccggggaaaaagattaacatcatataattaaaaacccgcatatgcgggtttttttgaaagccaaacactactaatcgcttaaaaaattcattaacaaaaaatcatgaagccgtaggtaaactcaacatttacagtaaatcagcttaagggaaataggcctagagttctaactcattgttaaaaaagaactttaactaataaattattttttccttcgctaatgaatagatcatgctgaactctttgtcttgataaaataaaccatcagctttatttaaaaacatacctggctggcaaaaaacaccactttcaattttcaccatggtgaagccggatatgtcaaattcattgtccctgataataatattttcgacataattactacctgtttgaataagtgcgaaattagccatctgttaccactccactatgaggaaaccgggctgacctacagcaccgttaccattaatgccagtagatccacctgcgccgccagcaccaaaaccatctccaacgtaaccgttttggcctccagcactacctgcggaagatgagcgaacggagccaccgcctccaccgaatggacatgatgcgcctgcgccgccgcaacctgttccaatcgtcgagcccgttgttcctgctccatcatttccagtgcttccacgaggatatcctcccccgccagccccaccatactgcgctgaaccaccaccaccagggtctccaccctgaccggcgatgagggtcaaataattgccaaaaacagtattgccaccaactcctccagctttgccatcggagtttactgacgtggttccaccggcaccaccagccccgatgactacatcgatcatttctccaggcttaactgttatggcgcgcttaataactgactgtccaccgccaccgccaccgccgccaccgccaaattcactggtgtttgtacggcaaccgccaccgccaccgccgcctccagcagcacatccggataagtagacagtgcttacgccatccgggacctggaacttgccgctactgatgaattgtttaacgcctctagaacgcgaaatctcattttggactgcttctacaaaa

SEQ ID NO: 19 - DNA, 20368 bp, Arthrobacter sp. OY3WO11
cccggcaccaccagcaactactcagccgtggatcgctccggagcaacttcacaaacttaccggatcattcactccgaagcaaatccgtgtttcaggatttccatcagaggagaaccgctcccaacctcttcaggagcgctctaaagccctaccagaattggtgttgatttttgggggtttggccgccgtggttaccagctcttcgctgtctccctcgcggcgacttagaaaacaatacacctgctcctgcgccaccgcaaatccccctgccaggagggcccgatccccgccgttccgcggaagtacgggccgttggcaccccgggagggccctccgccgtcgtacttttgttttgtgtgctgcggcacagtcctggtgctggcacggaagcccctgcggagaggtgcaggttaaacgcagaagagccggcaaccataaggttgccggctcttctcaagcagctggtagcagcagtgctggattaccaggaagacttggtgatgcccggaagttcgcccttgtgggccatgtcgcggaagcggacacgggagatgccgaacttctggaaggtaccgcgggggcggccgtcgatgatgtcgcggttacgcagccggatcggggacgcgttgcggggcagcttctgcaggcccaggcgggctgcttcgcgtgcttcgtcggttgcgttttcgtcaaccagggtcttcttcagctcgaggcgctttgcagcgtaacgctcaacgatgaccttgcgctgctcgttgcgagcaatcttggacttcttagccatgtttagcgctcctctcggaattcgacgtgctggcggatcttggggtcgtacttcttcaggaccatgcggtccggatcgttacgacggttcttgcgggttacgtaggtgtaacccgtgcccgcagtcgacttgagcttgatgatcggacgtacgtccttgtccttagccactagagcttcaccccacgagccaggatctgggcgacgactacgtcgatgccgcgtacgtcgatggtcttgatgccacgtgcagagacctgcagcgtgacgttacggcgcagggacggaacccagtagcgcttcttctgaatgttcggatcgaaccgacgcttgttgcggcggtgcgagtgcgaaatgctgtgcccaaagcccggctcggctccggtcacttggcagtgtgctgccatgacttctcctcaagaattgaaagtaatgatccgcatatctgctgctggaccatgctgctaagggcgacccaaaagtgaagaagggcaacggttagtcacgcaacttgagcccctaactaccggccgccctggagaaattaccgggccaccggagcaattgcgcacgctccgcgcacttagcgcctaccaagtctacgagtccacgcaattaaagaccaatccggcgccggaaggtgtataagcgggccgtgcagctagaggcgcgtgagctcgggatacttcggtttcaggccgtcgccggaggacttgccggtgaccctgcggacaacccagggaccggcatactcgcggaaccaacgggcgttagcgcggagggcgtccaccccgctgagttcgggcacgggggtcataggcggaatgtcgatggagtggtcgtgttccaggacgtccagcacccgcctggccatattggcgtggccggccgcggacatgtgcatccggtcgtgtgcccacatgccccagtcgtagtactcgctgaagcgccagtaatccaccaggagcgcgccgtggtctcccgcgatgccgcggaccagttcgttgtagatcgccgtgcgcccccgcatggtgctgaacaccttcgagccccgcgcatcgaagcctgtgaacatgaccacggtggcaccggtggcacgcagtttggcgatggcgtcgtcgtactccaccaggaggtcgtcgatgtcgatcctggggcggaggatgtcgttggcgcccgcgtagatggtcaccagggtggggttaagttcgacggcggcctccacctgctcagccagaatgtggcggagtttcctgccgcggatagcgaggttggcataaccgaagccagggtcagcagcggccagctgctcggccacgcggtccgcccagccgcggacaccgttggggcgggtgggatcgtcgtcgcccacgccttccgtgaaggagtctccgagggcgacaaaccgggaagtaaagtccatccggttagtttgccacccgttgccgggagcaaccaaccagctgacgggcgggctagctttcccggaggatccagtggtcggcgtccagccgccccaccaccttttcgccgatcctcgcaaggtccaggacgtcctgctcagtgagggcatcgaggaacaggtcacgaacgtcctcgacgtgcccgggcgcgagccccacgatggtggccatcccttcttcggtcagatgggcggtggtgacgcgggcatcatggggatgcgggcgccgctccacccagccgcgcttctgcagcttggtcaccacgtgcgaaagccgggacagggacgcgctactgcgggcggcgagctcgctcatgggcaggaaccggccctcagcctcggaaagcatcgccaggacggtgtagtcgaagagggacagctttccggcagtgtggagcttcgtgtccagggctgcgggcaaaagggtgttgatgcttaccagggccagccaggcacggcgttcgtcggcgttgagccagcgcggttcggtcatgtcccacattctacgagagcagcgtggttgattcttcaactaggcgtcgcggcggccggtaggctggggccatgtatgttgtttccctgagctaccgggttccgcaggacatcgtggacttccataacgccggccacattgcctggttgcagaaggctttcgacgacggcgtctttattgcggccggccgcaaagtgcccagaaccggcggcctgctgctttcccaggccgaccgccccgcccttgatgcctgcctggcgcaggaccccttctatacgaatggtgtggcggacttcgaagtcatggagttccacgcggccagggtggccccgggttacgagatcctgctggacagctagcactcacgggggcggccgtccgctgcgcccgccagtttcttcagcccgcccttccgaggcaccttgaccggatccggccagcgcgggcccagctcgtcccccagggtgacgccgcgcagcttgcggccaaagagcggcaggacccagtcgcggatccagcgccgctgctgccgctcccattcccgcaggctgtgccgggccggcggttcccagtcctttggccggatcttgtgcggcacctccaactgatccagcacctgccccgcaaggtacttatgccctgccttggacatgtggagccggtcggagtcccacatccgccggtcatggaacgcatccaggcaccaatagtccaccagcacggcgccgtacttttcggcaatggcccgcacttgctggttgtagtaggtgttgcgcttcttgagtggttccagcagtgcggacaccttgacgtcgaaccccgtgaagagcaccaccgttgccccggtttccgccagctgcgccaccaacttttcataggccgccatcagcgcggccatgtccgtcttcacgtccagaatgtcgtttccgcctgcatacagcgtgaccagcgagggccgcatccgcagcgccggttccagttgctcgttgacgatatgccggagccgcttgctgcggatggccaggttcgcgtagcgccacccgggctgggctttggccagtttctccgccacccggtctgcccacccgcgaacaccattgggcagccgttcgtcccggtccccgaccccctctgtgaaagagtcccccagggcgacaaacacccgcctcccggagtcaggaagcaaaggttgagcaggcaccagcccaacttagccccaccagaaagagcgcagggaaagccgaggtaaagcaatggtgacgaaccctcatgccgcggccgggggcttgcgtaggagcgcatcgccgaccagagcgaagcgccgggaggtgtctaagcgacggcaagccgccggttgcggcctagccagcaaccggccgggctacccctcggccttgccctgccgccagtagcccatgaacgccacctgtttccggtcaatcccgacgtcccggaccaggtaccggcgcatgtctttaatgacggcggcttcgccggcgatccaggcgtagaagggcatggcgcccgcgggcatgcccgggttcttggatgcctggatctcggacgtctccatccgcgccggggtttcccagaggatgtccacgtccacgttgacatcctccggctcggggccggcgccgccgtcggccgctttgatccccacccagccgggcacgggcacggccttgcgcacggcgtcctggagcagttcgccgtgcgggcgggaccgcccgatggacgcaccgcgtgccagccaggtgatctcgacgtcggcaggtgaggtcagctccatgaaatcgccggcttcggggacctccaggaaagcgtgcccggtcatgtactcgggcaggctttccaggatggcggagatggccgggactgaggtttcgtcgccggcgagcaggatgcgctgcgccagcccgggccgccattcgatgcctgagtaggtttcggccgtgacacagtgggcagccctgttgttggggccgatgatggtgatcgcgtcgccgggccgggcgttgagggcccagttcgcggccggtccgccgttgccagcgttgtcaaagtgcatcacgaagtcgacgtcgatctccgggtacaccgcgtccaggcgggcctgtcggacagtgtaggtgcgcatggaaccgcgcacggcagggtccatggccagccattcccggtaccagccggcctggctcatttcgaaaacggggaggggcagcgggctgccgtctgctgcgagggacgggatcatcagcttgatccgcaggtccagggtgtcgccgtggacgccgaagtcccgcagggcgtacccgccgaacgtgatcctgcggaagttggagctgagttcctggaccgaggtgacggtgacttcgaacgccagggtcatgggctccgtggaggcgatgtcgcgggttttcatgaaacgagctccagttcgttggcggggacgtggtgacggccgatgggaatgatcaggggcgtgccggatacgggatccgggatgacacgcgattcgaggccgaacacgctgcggaccagcccttccgtgacgacgtcgagcgggctgcccactgccaccacgtcgccgtccttcatggcgatcacggtgtccgcgtaccgcgcggcaaggttcaggtcgtgcaggacgatggccacggtggtgccgcgctggcggttcaggtccgtcacgaggtccaggacttccacctggtgcgcaaggtccaggtaggtggtgggttcgtccaggaggagcacgtcggtttcctgcgcaagggccatggcgatccagacgcgctgccgctgcccgccggagagttcgtcgacgttccgttcagcgaggcccagcgtttccgtggcttcgagcgcgcgctgcacggcagcatcgtcccgttcgctccagctgcgaaagaagccctggtgcgggtagcggccacggcccaccaggtcccggaccgtgatgccgtccggggcggtggggtgctgcggcaggaggcccagggtgcgtgccagttcacgcgcaggaagggagtggatgtccttgccgtccagggtcacggcgccggccgccggcttgaggagccgggacagtccgcggaggagggttgacttcccgcaggcattggcgcccacgatcatggtcactttgccctccggaatctcggcgctgaggccgtccaccacgcagcgctggtcatatttgagcgtcaggtccttggcgttgagaactgccacctcaggcatcctttcggttggccgtgaccaggagccacagcaggaacggggcaccgagcgcgccggtgattacgcccaccggaagcactgtgccgtccaggagcaggggtgccaggttggcggccgcatagtcggccgccaggacaatcacggcgcccacaagggccgacgccgggaggctggctttgccggtgaagcggcgggcaatgggaccggccaggaaggcgacgaacgagaccggcccggctgccgccgtcgccaccgctgccagcgcgacggcggtgatcaccagcgccagccgggtggcacctaccctgatccccagtccggcggcggcatcgggaccgagctccaggatgcgcagcggaccggcaatcaccgccaccgcggggagcaggacggcgagggccagggccaggacgccggcgcggtcccagctggcggagttcagggagccgttgagccagacgaggacatccgcggcggtgcggatgtcggcgcgggtcatcaggaagttgaccaccgcgtgcagcgctgcagcgatgcccatgcccgccaggatgagccgattcccggcagcatcaccgcggccgcttccgcgcagggtaccgctgttggagatggcgtagatgatagccgcaacacccagcgcgccgcccagggcggcaccggaaaccgcggccccggaggcgccgaaaaccacgatggccaggaccgcggcagcactggcaccgtagctgatgccaatgacgtcgggactggccagcgggttgcggagcatggtctggaacagggcgcccgccagcccgaacgcgacgccgatcatggttccgatgacggcccgcggcagcttgttctccatcacgatgaagctggcgccagggattttttcaccgccggtcaggtgggcggtgaggatcttgaagaagtccgggatggtcaccgtgtagctgcccagcaggacggacacggcgaacaggaccacgacggcggcggccaggagagcggtccggttcaggaggagcccgccccggcgttgcaggcgtggccccttgggcccggttttgggaacccccagtgatgggtcaacggaagatttggtgatggtcacaatccggcccccttgccgcggcggatcagccagacgaagacgggtgcgccgacgagggcggtcatgatgccggccgggacttcgccgggcaggagcaccacgcggccgatgatgtccgcgccgagcagcagtgccggggccaggaccagggagaagggcaggatccagcggtagtccgggccggtgaggaaccggacggcgtgcgggatgaccaggccaacgaaggcgatgggtcccgcaagcgcggtggccgatccgcacagcagcacgatgccgagtgcagtgagggcacgggccaggcccacccgctggcccaggcccctggcgatgtcgtcgcccagggccaggctgttgaggatacggccggtcaggagcacgatgaaggcgccggcggcgaggaagggcagcccggacagcacaacggaccagtcacgcccggcgattccgcccacttgccagaagcggaaccggtccagggtgtcctggctggagaccaggatgacgttcatcagggagtacaggccggcattcaaggcggcacccgccagggcgagcttcaccggggtggccccgtccctgccgagggaggcaatgaggtacaccacgacggcggcggcacctgccccgacgaaggcgaaccagatgtagccggagagcgagccgacgccgaagacgtagatgccggtcaccacggcgagggcggcaccggcgttgacgcccatgatgccggggtcggccagcgggttgcgggcaacaccctgcattgctgcgcccgcgaggcccagcgcgccgcccgccagcaggccgaggacggtgcgcgggatgcgggcgtgaaccacggcgtggtcgccgttggcgggatcaaacgcggtgagcgcctgccagacggtggccaggggaaggccccgtgcgccaatggccagggaggccgcggccaggagggcaagtacgacgacggcggccagcagccaggcggaccgcggccccccgaaggcgcgggcgcgggttccgccacgtgccggtcccggcaccaaggtgccgggtccgggctcacggcgcgccgccgtcgtcgtactgtccgtcatggaagtgtgcctacttcaccgcatccgcggcgctggcaagctgcggcaggaacgtatccagcgaccacggcaggctcagcggggaggaagcggagatggacagggtcagggtgttgtccgagtcggccaccagggcgccgttcttgatggcggggatctggcccagcagggggtcggacttgatggaatcagtggtggcggcgtccggaacccaggtcacgaagatatcggactcgagctcgttggccttctcggctgaccagggaataaagaattccttggagcccttggaattttcttccaccacgggcgccagctccatgccgatttcggagaggaagcggggacggttgtcattggcagtgtagacgttgacgccgtcagcggaggcgggctccaggttgccgtagatgaagctcttgccggcgatctgcgggtactcggcaaccttttccttgatggtggcctcggtgtcggagaccagcttggcggcttcggcatccttgccgagggccttgccgatgatggacgtggagtcctgccaggaggttccgtaggccagttcggggtgggccaccaccggcgcgatctcggtgagcttcttgtagtcctcctcggtgaggcccgagtaggcagccaggatgacgtccggggtgagcttggcgatctcggtgaagttgatgccgtccgcctcggagtactgcaccggggctttgtccgagccgaatccggcgccgagctcctccagcgccgcgtccttccacggggtggagccctgctcgttgccgccccactcattcttgggcacgcccaccggcacaacacccagggcgatggcgacatcgtcattgacccaggagacagtggccacgcgggtgggctgcttttcgatggtggtttcgccgtagacgtgctcgatggtgacggggaactgcgagctgctggaggtggaggcgctggcgtcgccggcggaggacgcgggccccgtggagcaggcggacagggtaagtgccgcggcggccaggacggccgtggccttgccggctgatttgaacagcgtgcggcgcgtggcgctgggcccggagaagaggggggaagtcacggaactccttaagtcatgaagcgaacttaagtaaggctagcctaccctccggttcattacgcaacgcttccatgccttattccctttcgtgacgaaggacacagccccatcgacgctctctcacttaatgcaggaaatccccaaacgctccatcaccggtgagagagcgtttggggaaatgccgcattaagtgagagaggatcctggtcagtggtaggcgaagctcatgagcaaagctttcagggttttgccttcagcaccccagtaccaggctttcgccgcgtcatcattctcgaacggtggaccctcgaacaccacgtcggcagtcaggacgcggctgccgagcatgatgagcccgtcctgcaccttcccgtccggcgagacgggcaaccctggagtgagccccatgcggtactgtgcggcgtcaccgctgcggtcaacaaagaacgacgaatggggcgttggcacagcctgtcccaccaatcctggcaccggatccgtctcgaggacggtccgggcagcagaggtggccacgacgtcggcaatctcgcctgtgtagatgctgacctgcaactgcccggcgggatcgtaaaccgtggcagtccccacgaacggcgaggcggatgcctcgaagagctccacgcgccagtcggccgggtgctggaacgagagccggccatcagggaaggtgaacgttgccaggccggcggcgggagcggtggtggcgggagcggacgacggcggccggctcgtcgtgggtgcctgaacggcagggctttcggacgtacccccgctccccgccgggccgcctgccgcacagcctgcgagggacagtaccgctgcggcgcccgctgccaggaggaatttcgcgcgttgtggtaagcgcatgggaatgcctttcaagaggacgccatcattctcttggggaacagggcggaacccagcattccgtagtacctatgggatttactcaggcgaggtgagttggtaaagcccagagtggcacagcagaaatacccctcaccagagcttcgacaataattccatcgatttgttataaagcggcccggcgggtgcgtgctaacgcaggacgatgtccaccggattcgcttccgaccgccaggcgccttcttcgcccggccgcggtgtgatgaccggcgccgtgagcactcccgagcggttggtgcgcttgtcgcggaggatttcggtgacggagccaaggtgccgggagaggtcaatgacgttctcgggggcggccagcagcagctggaacccgaattcgtgcagcgccttgatcccggcgccggcgaactcctcggaagccagcacaaaggcctcatccatcatcacggtgccgtacgtggtgaagccctgctccgcgatgcccagctggtagctcagcgcggcagccatgatgaaggccgtgaaccgctggcgctccccgccggacatggatccggtgtccgcgtgcatgaacacctcggacttcttggcgccgccctttttgcccgacgccgtcccagccacttcgcggtgctccttgcactggatgaacaggtggccgcgcacgtccagcacctcggcccgccagcgccggtcctccggcgcctgcgatcccagccgcttcaccagggtttccagggacttgtagcgggcggtgagctcggcgtcgtcatccctttccccgctggcttccccacctgcggcgcttgtcctggcaccttcggatttggccgggcgggtatgccgggccttcagggcattctggatcgcgtccttgaactgcttggcggtgggaggcagcgtctgcttgatgtccagctccaggaagctcccctcgtggaagttgacctgcgagaggatgccgttcagcggcaggatgcggctggtgatggagcgccgttcctcatccagcaggtgcaggagtgtgctgaaggattcgtgcgtgcgctggttgaagaactggcggaactccgcttcctgggcggggaggccgtcgctcacaatcgcgtggtagcgggtttcaaactcgccggccgcgccgatggtggtgccgtggtctgccgagatggcgctcccccagtcacggacgaaggcctcgaagatacgggtgagccgctcggcggtggcctgcccgcgggactcagccgtgtgcagctctgccagcagggcggtgcgcacccggttggcgaggttgtccagctcatgcatctccgtcacatcgccgaaatcggcaaagtacggttccagggcggtgacggtggcgtccgacggcggcgcctgggccaggcgccggcgggcaccttccagcagggaatcggcagcgctcagctgccggtccagtgccttgtactcgctctgcaggacggcggcggcctcggtgctggactggtgcttctgccgcacctcctcgatgctggcgcgcagcggttccaggtctgcctgggccgcaagggcatccttcagccgctgctcgagccgcgtgagctcctcggcggcgactcccgccgacacctggtcccaggaacggtggtcctcggcgatgcggcgcagggcctcgagctgccgggccatgccctggtgcgagtcttcccggctttgcgccagctctgccgccttggccacctcctgccgcaggtcctccgcctggccggcaacaagttccagcttggcggcgttgtcgaacccgaggacgtaatcctgccggctggtgaagcggtcgtccttttccacgctgtggcggttgcgcttcaccacgccgcccaggctgaggccgcggtccagtgaggccagctcgtccgggtcctccaggcaggggtaggcgaaatccagtgcgatgcgctcacggatccaggaacctgcctcggccgcgacgcccgtggtgaggatgtccagcttggtcagcaggtcgccgtcgcgcacgtcctcaagcgccagcgcgccgcctgaaagcggcttggacacgtccacggcccgcagcgcgccgcgcacggcgtgatcgttgaggtaccgggtgaccgcggcgaagtgctcgcccggcaccagcagcgtggtggccaggttgcggagcgcccgctcggcggccgggcgccacttctcctgcccctccacgaggtccatcagttcaccggcgaacggcatccgctcctccgcgatgccggttgctgcggcaatcgcggcccgattttcaatgctcgacggcggcagcagcgacttgcgcgtcttcagcgacacgagttcctgctcagccgcggccagttcgcgcttcttggttgcgtgcgcgtcgaaggcctcgaagcggagttcctgcagggcctgggaatcgtccttgagctcggcggaccttgccgccgcctgctcgtgcgcctgctcccagccttcctcggtccactcgagctgcaggccggcgtcggccagcgcctgccgtgccgtctcctccacctgctggcggagcttcagcccaacacgggcgttttccaaggactgctcgatcgcggagatggcgttgccgccctggttgttgtaatccgcttccagctggcgcaggtccttggccagcccgtcccggacagtccgctcagcaccaagctccttggccttcgcctgggccagtcccttgaagcgctcaagcaatccctgatggaccgtgacggccagcttctgcttgtaggcctcgaactcctcaccggcgaggtcccgcagcctgtttgcatccagcagcgcctgagcgtactcccggttcagcccgggaaccggggccagctggtcccgctgctgccggacgtcctccagccgctgccggatggacatcaggttgctgaattcctccacgacgtcgtccgccgccgcgagggtggccggggcgtccaggacctggtcgcggaagaacgtgttgacgctgccgcccaggcccttgccggcctggatgacgcgcaggagcggaagggcctggtccgagttgatgcccagcagcctgcggaaccgctcggcaaacgccttgtggacgtcgaaaacctgggcatccgggaagatcgtctccagggcagccctggtgaaccgcttgtccgcgatgccctcgagcgcctccaggtccagcgggtcgtggtcgatgacgtagaaacgcccgacgcttgactccgtgccgttcttgggaagatcgaacagggccgagacggtcacccgcgtaccggccgcgttatcaaaggtcagggcgacggcggaccacgtggcgcccggccgctggaaggcactcgctgagccctcacccacagccttgtcccccaccttgccccgcatgtaggtgaatgtggtccgtttgtcctcaacagcgccgccggaacgctgggcggcggcctcattggacctaggccgggcatcgaagacccgcagcatggcatcgaacagcgttgactttcccacgccggagttacccgtcagcagcgtgccgttgcggtccacgtgcatcgtgtgggctccgtggaacgtgccccagttgaccacctggaccagggcaaggcgcatctggccggggtttgtcagctcccccatcgggagcatggaagcgatgctcactgggcgtcctccgtgtcagtgtcgctgtccggggaagcggcttcgttgtcgaactccaggagcgcctccgtgcctgcggggtctgtggttgctgccatcagggcctctatctgggcggggatgtcgccgatgttgtcgaacgggagggccaggggcagggcgttggagatggtgtagacgtcgtccagtcccgtggggaggaggagctggcgggccaggagcttggtgatggccctgttcaccacgtccgagtcccgcagggcatcctgctggccggcgggctggtagtgcgccaccaggtcggcgatttcctcgcgggtgatggtggggtcagtctgagcggtgacatggcggtccaggagcaggcggagccggagcagcacgatggtttccacccggctgagggcgcgctgctgccgaaggatgctggagcgggtgctgcccccgatagcgtcggggtccaccgggcgcaggacggcgatcttgcgctcgtggtccagctccatggtgaggaacagctcggacagccggctccgcaggatcacctggttgtccagcaggaccgtccagagcttttcgtcccggccgccgtccacataggggcccttgaggagcttcaccagcgcctgccgcaccttgatggacagcaccccggtatcgccggggaagagcgcggcaccgtcaacgaaagtgtcgcggggcgtgacggcgaaaggccgctccgccgtcgtcgtggttgtctcttcagtcatcaggatcctttggaagcgtgaccagcggcaggtaggccctgcgcgtggtgccgtctatctgttcgtagtccagggcctcgaggccctggtggtcgaagccggcgccggcgtggagcgcgtgcgagaggagcgcgcggatggtgttgatgtgctgctccccgggcggcagctgctgccacgcctcggaaagggtggaagccccggccagggccgcccgcaccacctccggcctggccttgccggtcctcggcgagcgcacccggtcagagtcgctgaaggcgatgggatcggccagtttgggcggggcggcgaactcgtcgggatcgaagagcttcaccatggacagcgactcgaaccccgcgttgaacaggaccggcccgggaaccaagccagggcgttcccgctcatacggaagggacctgatggcctgctcagcctctcgcaggacctggcggagccggacggactggcggaagtcatcgctctggacgtaggtgttgaggctttcgctgagcttgccgtagatccgctggatctggctgtgctgctggcgcagctccgccaccaggttcttcagggtttccctgtcctccggagacagatcatccgcgaactgccggccgaggacctcgcctatggcggagcggaaccgcagctgctgctgagggtcctccaggaacgccgtgaaggaccggaaggtcctcccttccggactctgccggaggcgtttgtccgcctccagcacctgggccatggtggcgcccttggtcagcgactcctcgatgatctggttgcgcagttcgcctaccagttcctcgatccggtcacgcatcttcttgtagtcggcggggaggctcgccgccaggtccaggatgtttcccgcggcctccaccgcctcgtcgtcgtccagcaggccgtcgaactcgccgctgctgatgtcctggatcagctgctggcgttcttcgatctcctcttccagggactccagccgggcgctctggtccgggttggtctcgttggcaagtttttccacgtcaccgagcagcgtgcccaggcgggacccgttgagggtggaccgttcgctggagaggctgtccaggaacgccagcacgcgtgccgcaggttccgtcacttcatagacgatctggccggcctggttccgccgcgtcaggaactggcggcgcgtccactcgtcgccaaaggactttccgttcgcccctccacccagcccggggtcctggcggcggagctcctcaaggaaggagtcgacgtcggcatggaactcctccagcggcagctgcggccgggtgcgggtaaaggatgcctgcagcaccgcgatcacccagggcgccgagcgcgtcagcgcccaggcaggtcctttggtgaggagttcgaggtcccgaagccgggcgctgatggcatcagcggatgacctggcggagcggggcacacactctccttggactgtttgcggggacggggcggcggcctggatcggaaaacggccaactacaaggttaacgcaggcgccgcgaccactccgtgacctaccgggcggtagtgtttcgatcccatatcaacaggggtctgcgcccgttgcggctctggctggaccgggagttctccccctacgctcgtgctactggtctcaaccaactctcaacacatgcaatgacgccgcagggggactcatgccgttcgatctgacagcagtggacaacgccactttggtattcgtgggcacgctggtattcgggtttatcctggccgcttttgtcctggcctcaggactggtggcgctggtcctcctgggggccggaaaattgagctggacggtggcgtccaaaacgctcctggccgtggtccatggcatcaacgccggatgggacaggctggtgcaccacgccgccacggtggacgttgcaggcgatttccaggcccaggcttcccctagcaccggaacctacccgcgggtaatcttgagggacagctgaagggttctccaacccggcggatccatggctacaccggccaatccggccaaggagatgacccatgagctccgccactgacagccccgcaacaagccctgccaccggcctccccacctccacaggaccggcagcagactcccccgcagaggacaccccggtacccgccggcaagatcggcgccggcgtcacggctgacgaggcccgcgccgtggccgaggccgcgcgggaatccggctgggagcggcccagcttcgccaaaggcctctacctgggcagcttcgacctcagcctggtccacccctggcccaccccggacccggtctccgtggaacggggcgaagcattcatggcccggctgctggagttcgccggcaccatggacggccgggtgatcgagcgcgatgccatgattcccgacgaatacatccggggacttgcggacctgggcgttttcgggatgaagatcccccgggaatatggcggcctgggactgtccctggtgtactacggccgcgctctggccctgctgggcagcgtgcacccgagcctcggcgcactcctctcggcacaccagtcaattggggtgccggaaccggtgaaggtttttgggagcccggaacaaaaacgcgagtacctgccccgctgcgcggccggcgctatcaccgccttcctgctgacggaaccagatgtgggcagcgatcccgcccggctgggcagcactgcaacgcccacggacgacggcgaggcgtaccttctggacggcgtcaagctatggaccaccaacggggtgattgcggaactggtggtggtgatggccgtggtgccggcgcacacggatgctgacggcacccgccacaagggcggcatcagcgccttcgtggtggagatggactcgccgggcatcacggtggaaaaccggaatgcgttcatgggcctgcggggcatcgaaaacggtgtgacccggttccaccaggtccgggtgccggccgccaaccggctgggccgcgaggggcagggcctgaagattgcactcaccaccctgaacaccgggcggctctccattccggcgctgtgcgtggcgtcgggccgctggagcctgaagatcgcccgggaatggtccaacgcccggacccaatggggcaggccggtgggcgagcacgaggcagtgggcaagaaaatcgcgttcatcgcggcctccgccttcgccctcgacgcggtctttgagctctccgcagaactcgccgacgccggccagaaggacgtccggatcgaggccgccctggccaagctctgggccaccgagatcagctgccggattgccgatgagcttgtccagatccggggaggccgcggctttgagaccgcggattcgctggcggcacgcggcgagcgcgccgttcccgccgagcagcagctgagggacctgaggatcaaccggatcttcgagggttcgtcggagatcatgcggctgctgatcgcccgggaggcggtggacgcgcacctggccgccgcgggcgaccttgcgtcgctggacgcgagcctgtccgacaaggcgagggccgccgtcggggcttccggcttctacgcccggtggctccccaagctggtggccggcgccggcatggacccgcgctcctacagtgagttcgggcggctggccaagcagctgcgcttcgtggagcgttcgtcacggcgcctggcacgccagacgttctacgggatgggccgctggcaggcgaaactcgaacggaagcaggcgttcctgggcagggtggtggatatcggcgccgagttgttcgccatgaccgcctgctgcgcccgggcggagatgctgctgcacaccgcacccgaaaaggctgccagtgcttatgagctcgcggaggcctattgcgagcaggcgcgggtgcgtgtggacgagtactttgaccagctgtggcggaacacggacgacgccgaccactccctcacgcggaaggtcctagctggggattacacctggctggaggagggcatcctggaccagtccgaggggaccggcccgtggatcgctgacgcctcccccggagcctcccggcgggaaaacctgcaccgtagataccggtgacgccacaggtcacgaaatagtaagcatccttgctatcactggtgggtgatgcttgagtggagccatgagtagctcaacagacccagagaacctgcccccgaggcgtgcccgcgaggatgttgaccgaaacgggagccgccgcgatgatgcccttggcggcgagcccacccgctcctacccgcaggtgccggcaagcgaccccgcaccgacctctacctatgaccgggtgccggaccgcacagggccggccggcgcctacgccgagcgggagtacgttcccacagctcccgcaccggctgccgatcccaacctgaccgaccggcagaccgccgtggcccgggaaaaggaacagttcggcggcatcaaggtggggtccgcgttcttcggctggctgaccgccacgggcatggccgtcttgctcaccgcctttgtggcagcggcaggaacggctgtaggtctggccaccaacaccgacgtgaacgaggcagtcagccaggcagcccagaaccagggcacggtgggcctggtgggcatcatcgtcctgctggtgatcctgttcctgtcctactactccggcggttacgtggcaggcaggatggcgcgcttcaatggtgccaaacaaggcctcatggtgtggatctgggcgctgatcgtggcaatccttgtgtccatcctgggcctggtggcagggcagcagttcaatgtgctggccaacctcaacagctttccgcggatccccatcaacgaaggccagctgaccaccaccagcatcatcgccgccgtcgtggtggccgcggttgccctggttggcgccgtcctgggtggactcgcaggcatgcggttccaccgcaaggtggaccgggccggcttcacgccggacagtgcctacgacaacgagtaatcagggcaggccgtccccgtccacatagagccagcggcggttttcccgcacgaaccggctggtctcgtgcaggacgccgcgctcactgccgtgccggtagtacgccgtgaactccaccaccccatcggtatccagcggtccgccgccggatatggagagaatgtccaggcgccgccactccatccccggatccagttccagctccgccggcgctgtccgggggtgccaggtgcgcagcaggtagtccgcgtcgagcaatgcgaacgcactgtagcgggagcgcatgagctgctctgcagtggcagcatccgccgcgccccggtggaagcgtccgcagcactgcccgtactgctccccggacaggcacaggcagttttcctggtccatgaatgccgtcatgcaaaagatgctgtcacacgcggtaacagctttgctacaacccgggcgcgcccctgcgtccggcggcatagcaccccaaaaatccgtaaggtggagaaggagctgttgcccaggcagagaggagagatgacgtggagaatccggatacgctcatcctcaacctgacgttcctgggtaccgtgggtgtcgcattcctgatgttcctggtcctcttcctgctgggggtcatcaccctggtccttgcggggcttggccgcctggcggccgcggtgctgatggccctgttcggccggcgctcccaaaaagaatcccttcccctggtgcgcttcatcggaccggcggggagccagcaggcgtccgacggcggcgctgt

SEQ ID NO: 20 - DNA, 25643 bp, Arthrobacter sp. OY3WO11
cgtgtgcctgcctccacgactccggtctcgcggaggattgggccgctgccgttgcggacgcggacgcccgggcaagggcggccaaggcacgcgtggccgcgccggaaatcaagctttcagtgcgggatttgcccgatccccatgtgccggcagaagaagttgcggaagtggccccgctggtggagtccgcgctggataacagccgcccctcccgggagctgccccggtccttcaagaagccgcaggttccacacgtcctggcgccgctggacaccggatcactggtgtccctgtccggcccggcgcacatcagcaaggccgcggcggacgcagccaaggaagcgggctccaaaggctccgcttcgaagggcagacagcccttaccctgagcaaccatctgggttagcgtgaaacccatggaattcagatacctcggaaacagcggatttaaagtctcggaaatcacgttcggcaactggctgacccacggctcgcaggtggagaacgacatcgccacccaatgcgtgcgggcagcactcgacgccggcatcagtaccttcgacacagccgacgtctacgccaacacggcagcggagacggtcctgggagcagcgctgaagaatgagcggcgcgaatccctggaaatcttcaccaaggtctatggacccaccgggcccaagggcaagaacgatcttggcctgtcccgcaagcacatcatggagtccatcaacggctcgctgcgtcgcctgcagacggactatgtggacctctaccaggcccaccgctacgacttcgaaacgccgctggaagaaaccatgcaggcgtttgcggacatcgtccggcagggcaaggcgctgtacatcggcgtcagcgagtggaccgcagaccagctccgggaggggcacaagctgtccagggaactcggtttccagctgatctccaaccagccccagtactccatgctgtggcgggtcatcgaggctgaggttgtgccggcgtcggaggagctgggcgtgtcccagattgtctggtcccccatggcgcagggtgtgctcagcggcaagtacctgcccggccagcctgcccctgaaggcagccgcgccacggatgcaaagggcggcgcaaagatgatcgagcgctggatgcgcgacgacgtcctggccggcgtgcaggaactcaagcccatcgccgaggacgccggcctgtccatgccgcagctggccgtagcgtgggtgctgcagaacccgaacgttgcctcggccatcgtcggagcctcgcggccggagcagatcgcggacagcgtggcggcggcaggcgtgaagcttgaaccggaggtcctgaaaaagatcgacgacgccatcggatcgctggctgagcgggaccctgcccagaccaagtcccccgccgcacgggaagcctagggcggcccgtgacgtccgcagcggaactgcccggcttccctggcctcggtgtcacggggtccaccggcgggctgggcgggatggtggcgcgggaactggccgcactgggttccgcccagcggctgctggtccgcgatcctgcccgcgcacccgagctggacggtgccacgcccgccgtgtgcagctacacggactcaccggctgcccggcaggccctggacggcgtgaaagtcctgtttatggtgtccgccgcggaaacgcaggaccgggtgcaacagcacaccgccttcatcgacgccgcggcaggcgccggggtgcagcatgtggtgtacacgtccttctacggcgcggcgcccgataccaccttcaccctggcccgggaccattacgccacggaggagcacatccgggcgtccggcatggacttcacgttcctgcgggacaacgtctatctggacttcctgccgctcctggccggggaggacggcgtgatccgcggacctgccggtgacggcgccttctcgggggtggcccgcgaggacgtcgcccgctgtgcggtggccgtcctgcgcgaccccgcaatccacaagggcgccacctacaacctgacgggccccgaggaactcaccctggcgcaggccgcggacatcatcacggagagcacgggccgcaccgtcacctaccagccggagacggtggaggaggcatacgcttcgcgggcctcctacggcgcacctccctggcaggtggacgcgtgggtaagtacgtataccgccatagcggccggggacatggcggggatatcaccggatgtccgcgggctcaccggcgaggaccccatcagcctgcgcgagttcctggccaggccggtcctctaaatcccccggagtttttgtccagatacgcaggcttccgcggcctccaagtctgcatatctggaccaaaaactccaacgggaggggcgttgacgtgccggcagggcgggcgtagacctgtggacaggggacgtccgagcccgccaagcaggagtggcaccaccatgaaacagatcttcacgaaccagcagtccgccggtccggccgcagcggcggaaagtccggctccgcccgcggccgggcccaccaccggcccgatcacccgggaggaactccaactgggggcccgcaaccactccatgccgctggaggccctccgccgggacatcactcccccggggctgcattacgtcctgacccacttcgacatcccggacattgatgagtcctcctggcacctgcggatcagcggtgcggtggacatggccatggagctgaccatggccgccctgcgcagggaccccgtcatcacagttcccgtcaccctggaatgtgccgggaacggccggtcgctcctggatccgcggccggtcagccagccgtggatcctggaaggcgtgggcaccgcgcactggacaggcgtgcccctggcctacctcctcggaaaggcgggcgtccacccccacgccgttgaagtggtgttcaccggggtggacgagggcgtccagggcggcgtcccccagcgctacgcacgcagcctgccgatccatgaggcgctgcgtcccgacgtcgtccttgcctacgccatgaacggcgccgaactgccgccccagcatggctacccgctcaggttggtggtgcccggctggtacggcatggccagcgtgaaatggctggaatccatcgaggtggtgaacacgccgttcaagggcttccagcaggaggtcgcgtaccgctaccaggagtcagcggacgacgccggtacgccggtttcgcggatcagggtgcgttcgctgatggttccgccgggcatcccggacttcctcacccgcaaccggatgctgaaacccgggccggtgctgctgcagggcagggcatggtccggcgaaggggcggtcacgtcggtggaggtcggcgtcgatggcgcctggctgcctgcccagctcgaaaagcccgccggcggatacgcgtggcggaagtggaccatgccgtgggtggctgacccgggcgagcacgtgctgtcctgccgtgccacggacgcaaccggcgccacccaaccccttgagcagaactggaactaccaggggatgggcaacaacgtggtgcagtgcatcagtgtgaccgttgggtagctgagctgcgccggctgggacgcagcccggcccggcgccggtaaaaagcgggccgggctatactcggtgccagccatgaccagccttccttcctcccccgccagtgtccgcatcgacgcgtggctgtgggccgtgcgcgcctataagacccgctccgcggctacggctgcctgccgggcgggccacatccggctcaacggcagccctgccaaggcatccgcgacgctggtcaccggcgacacggtcaccgttcggatgtccggctacgaacgcatcctcgaagtgcgccggctgatcaacaagcgcgttggggctgaaccggcctcgcattgcttcaccgaccacacgccgccgcgcccgatcgccccggcgctcggcctgccgcagcgcgaccggggcgccggccggcccaccaagaaggaccgccgcgagatggaacggctgcgcggtccggcgtgacagacctggtcctcgcagacgtgcggatgccgggggacaccgcactgtacagcgtgcacatcaataatggccgggtggccgggattggcgcaggtgctgagtctccgggcgctgcgcgcgtcatagacgcgggcggacgctttctcattccggggctgtgggacgagcacgtccacatgacccagtgggcgctgcatgcgaaccgcattaatctctccggtgccgtcagcgcccaggacgctgccgccgtcgtacgctcttcgatgcccggcgccgatccggcggtgaccgccgttggcgtcggcttccgtgacgccctgtggccggacgcgcccaccctggcgctgctggatgaggcgaccggcagccagcccgccgcgctggtcagccacgacctgcacagtgtgtggctcaataccgcagcggccagtcgctattcggtgcaggtggacgcctccgggctgctccgcgaggacccggcctttgccctgacccgggagctgggccgcctgcccgatgccgtggtggatgcctgggtggccggagccgccaaggcggctgctgcccgcggcgtggtgggcgtggtggatttcgagatgacctggaaccgggacccgtggcttcggcgcattgccggtggcttcgatgccttccgcgtggacgccggtgtttacccagccgatctcgagcgcgctgcggcgcagggcatgcggactgggcaggtggtcgacggcggcaaggggctgctgcgggtgggaccgctcaaggtgctcattgatggggcgttgaacacacgcaccgcctattgcgtggacccctacccctttggcgggcatgggctcctgacggtggagccggttgagctcctggcgctgctggaacgggccagggataccggatttcttcccgccgtccatgcgatcggggatgcggccaaccaggtggccctcgacgcttttgagcgggcggggattggcgggaggatcgagcacgcccagtttgtccgccgggaggatttggcgcgtttcggctcgttgggggtgctggccagtgtccagcctgtccacgcactggatgaccgtgatgccgcggagaccaactggcccgggcggactgaccgtgccttcccgttgcgctccctgctcgacgcgggggcaaccctgctgctgggctcggatgccccggtggcgccgctcgatccctgggctgccatggcggcagctactgtgcgggcacgcggtgacgggcgcggtccgtggcatccccaggaagccatgacccgcgggcaggcgctcctggcctcgacccgtgggcgttcgagggtgcgcgtggatgatcccgccgacctggtacttcttgatgccgatcccttggctgcgccggacggggtgttcgcagccatgccggtggccgccacgctggtcgccgggcgttttacgtacgacggcggcctggcttagggctggttaacccttggcgcgcgccctcacaaggttggcaaacgggagccttccgtgttcctcgacgaaagccgtgtggtagtccgcttctgccttggcgaggtggtctgcaggcagttccttccaggcgatcagcagctgatccgcgtccgcgagctgccagaccagccggccgtcccagtgccccggcggcttaccctgcccgaagtccaggaactcctggacctgccgccggaggccgcggttgcccttgctgccggggcccgccttgcccaggtataggacgacggcggcgtccacccattcagcggcgagggcggtctcggacagcgacgggtccttcttcttgaagacgcctgcggtacttttcttgaggaagcggggctggaacccttccggcgccaggacagcgaagaggccggttgcctgcgggacccgcatgacctcgagcgagccgatgggacggaagccggcgaaaccgtcggctttcaggccctttctggtgaactgcatcccttcattcaacagcacgcctggcaggctgccctggtttatccacataccgccctaagcatcgggtcattgtcacaccctgctggaagactttgtttatggaagcggttcaggggcgggcaggggcaatgccaacagcgcaggcggcgagaaaccccactgcgtctgcagccgccacgcaccttgtctccgttgcgccgccggttcctggtgtcctgtccgttgctgatatccgggcgagccttgctgccgtccctgtgtgtgctgacggtccggggatgattgatcagttgcgggatttggaggatttgaagtcgctggtggctgcgaagcaggcccggattgctgtggctttcgacgctgaacagcggcgggagcaggccgcggccggtatcccggccaaggaacgcggcgccggtgtggccgcgcaggtggcgttggcgcgccgggagtccccggcccgcggcggccggctcctgggcctggccaaagcctcggcaccgagatgccccacgccctggcagccctggagtccgggcagctgaacgaatggcgcgccaccctcatcgtgaaggaaacagcgtgcctgtccgccgaagaccggtgcgcggtggacgaggaactcgccgccgacaccgggacgctggcaggcgctggttcactggccggtgcaggggaccgggccattattgccgcggtccgtgcggccgcgtaccggcgggacccgcactccgtggccaggcgcgccgcccatgcggtgagtgagcggaccgtgacccttcgcccggcgccggacaccatggcccgtctgaccgccctgctcccggtcgcgcagggcgtcgccgcctacgccgccctgacccgccacgcagacaccgcgagatcacacggtgatgaccgttccaggggcgcgctcatggcggaccagctcgtcgaaaacatcacgggcaccccgggaggggccagcagcatcgaagtccagctcgtcatgaccgaccgcaccctcttccagggcgacagcgaaccagcaagactcgcaggctacggcaccgtccccgcccactgggccagacaagccgttttggggcagccggaacgccccgatccaggacctgcggatagcgccatgacagtatcggcgggaggtatagcaggaggttcggtggccgtgaggacccctgatacaggagcggcccgcaccggcgctcctgccacggaagtcagggacagcactgacttcgaggtctggctccgcaggctctacacagcgccgggcaccggcgaactcctcgccatggactccaaagcccggctcttccccgccgggctccgccgcttcctccaggtacgggacgacacctgccgcaccccctactgcgacgcgcccatccgccaccacgaccacatcacaccctggcaccaggacggccccaccaccagcaccaacggccaaggcctctgcgaagcctgcaaccacaccaaagaaacacccggctggacagcccgtccggtccccggaccacgacacacggtgcaactccaaacccccaccggccacacctaccactccaccgccccacccccgcccggcacgggcactccgtcccgccgccgtgaaaaacgcccaaagcacctgcagcaggccaaagcacgcaagtgcgcgcgactccgggattccctctcggcctaaggacggaacgcgttgttcgaatcaccgaccgccggggttccagctgatccaatcagccgatctcatagaagggagagagaacttcacctgcccacccattagcgcggaagcgtagagtggcctaagacgcctgattctggacgccttgctgctgagggagaaatcgtgacgattgattgggacgagaaaaaggccctgctacaggaaccgaacattgcgaaggtaacccagctttgcgatgaactgatggagaagaagccagggtctgtcgttccttatatcgaccctgtgcacgacgaggacgagtgccggatcgtcagcctgcaggtcagccccggcaagggcaccgagtccggctttgtctcgcactacaacgacgatgaagcggcccggcgcgccacccagatctacgagttggcagaactcgatccgcgctatgtgatgccgtggcacgcctacccctgggtccgcgacgcggatatgccgtccgccctgaatgtgcaggagaaaactgacggcctccgcccgttccggcagttcctgaagatcaactcccgggtttctgcggtcatcgcccacggcaccgacgcctccaccttcctcaccctcttcgagaagacctaccaccagtcgctgaagaacagcggcatcaaggtgtacaaagccaccgcactcggaggacgggccttcgccgtctcggaagcgaagcaggaagagctcctggccaagaacgtggacatctataaggacgccatgcaacgggcagggatccagcacctctaatattccctctacggcatggatgtcatcgcctggctgctcgagtccgatccagccctccgctggcaggtccagcgcgacctggcaggcgtgccgcctgaggcggtgcttgccgaacggaatctggttgccacccgcggctggggcgcgcgcctgattgcgctgcagggagcggacggacaatgggacggcggcacctactggccacaccatgacgacgacccccacggccagccctggaccgcaaccacctacagccttctgctcctgcgcgatttcggcctgaaccctgccagccaggaagccatgcgggcggtcagcatggttaggaacaacagccgctgggaggaaggcaaccagcccttcttcgaaggagaaaccgagccctgcatcaacggcatggtggtggggctgggcgcttacttcggggagaacgtcggcactgtggtggagcggctgatcagtgaacagcttcccgacggcggatggaactgcgaagcagaaaggggatctgcccgcgcttcatttcacaccaccatctgcgtgctggaagggctgctcgagcacgaacaggccaccggcgggaccggcgcatcacgggaggcccggcaccgcggcgaggaatacctgctggaacggagcctgcaccggcggaaaagcacgggcgccgaggtcaatcccgaatggctgcagttctcctaccccacccgctggttctacgacgtgctccgcgggctggactacttccgctccgccggcggcacgcccgacgaacggctgggagaagccgcagaggcagtccgctccaggcagcagccggacggctcatggctgctggaaaacacccaccccggcaaagtgcacttcacgctggaggacggcgacgggcaacccagccggtggaacaccctccgcgcactgcgggtcctcagctggtatgagggccaatagatgggaccggccactcaacaggcctagccctccagcagccgccgccgatgcttcaactccttgacccatgccctggtgaccatgtccgggaagggagagccgccgtcgtcgtcagtcctttgcccggacccgctcaggccgcggaaggcggccccggactccaggtccgcaagcagcgggcccgccgctttcagggcaatatccaccacctgggcggccgcgcgctcagtgagcccgagctccgtgccccagcccaggaaatggcggcgtgacacaccggtccgtttgccgttcatggtcagcgcaagcgtcttgtcgccatagaccactgtggaggggatgtcgtagaccggcgcaatggtccactccccggaaggctgctggaccattgaaacgttcttggcgtgcaggtccccgttgccggcaagccatgcataggctccctggatggccaggttcctcagggcaggaaggggcgcagcgcagtggtccgccagcgcatggcagacctgcccgtagcccacgttgtacttgtccgccggataaagcttcagcacctgcgccccgtcctcgaccgccagccgctgaaccccgcccggttggcccgccggtgcgggaacccggtcgaagcgctcgaccagcaaccctggccttccggcaacatcgcggatcaacctgaccttgcttagcgggatcctgagcttggccgcgtaccggaacatcaccagctcgttctccaccacatgcgggaattcgggcgcgttgagtttgaggatgaactgccgcccggtaccggtcaccggaaccgagatcatgccggcggagagcttgtcctgcacaccggccaaggccaccgggtcgatcaggtcggggtcccccagcagctggtcgaagtccaccggcttcttcgggtcgagccggaccgcatggtcatccgggtccaacggctccccgtggcccacgatctgcacgtcgcccacaggattcgcaccggctgcgatgagcagggacaggtcgtcatcagcgctggtcttgatggagcgccgcagcgcattcaggcggcggccctcaggcagcaggccggtgaaatagggcggagcggcccctgcagcggacagcaccggttcgctgctgagcggcagggaagtagcgacggcgggccctcccgattggaggtaggcgggcaggtagctgaagcgggtaccgccgtcgtgcctttcgagccgcgctgcaaggacacctgctttgtagatgtccgcgacgcggtgcctcatagttcaccgccgttcttagccggcgacccggccgcgcggacggcctggctggtccgggcggcgaccttcagttccagacccagggtttcaaggacggcgaccagcgaatccagctggacgctcggcttgccctgctcgacgaagcggacaaagcgctcggagacgccggccagctgggcgaggtcgtgctgcgtcaggcggaggactgcgcggcggctgcggacttctcccgccagcaccgctgcaaagctctgggacatgggactccataggtacgatcgttccgttctcaccgctacggcaagcttatcgccggtcgcgatcaaccaaaagaggaagaccggtacgaacataccgttgagagtcggtttcccagccattcagcggatgggcatttcgacggggcgaggcgctttacggcacagaactgccgtgatcttgattttcccttgacgaactcttgcgtttctgtcgccagcatacatagggcaagcattcaggtttcttcaaggtcgattacactcttccggcagggagccgggcggaaggtcctaccgaaagcactaagtgaagaaactgataatcgccacgatggccaccaccgccttgttggccggttccgttgcagttggcgcagcagcgaacgaagattccggaacggtggtgcgggtcgtcgacggcgacaccctgatcgtctccatcaacaacggcgatcacaccattcggcttctcaatgtggacacgcctgaaacaaaggaccccaaccagccggtggaatgccttggcccacaagcctcgaagtacctcgaagaggcccttccccaaggcacccaggtaaggctggaattcgatatcgaacgccacgacaaatacggccgcacgctggcgggagtctttgctccggacggctccctcgtgaatgccgagattgcaagggaagggctgggaatacccgtgcagttcggcgaaaaccgcaagttccttccgcccgtccaggcagcctacgaggaagcccggaccgcaaagtccggcctcttctccgagacgatcgactgcacccttcccgcgcagttggctgacacggccaaagcactggaacaggccgccggagcggcgccggcaacaacatcggtggccgcgggcgcggcggcggccgcactggctacaaagcttgccgccgccaaatccctcagggcggtccttgctgctaccaaggacgccaacagggcaatttattgggccggactttcggctgccgccactacggccgctgtcgcggccctcgaaaagaagatcgcctcgggcgagcagaagagggatgagttcaaggcacagcagtcgacgttggcggcagctgaaaagaaggccgaagaagaacggctggcagccgaagcccgcgcagcggcggaaaagaaagctgctgaagaacgtgcggcagcggagaagaaggctgctgacgaagcggctgccgcagcaaaggcagctgcagaggaagccgcccggcaggctgctgcggaagcggagcggcttcgtaggctgccagcaccggcgccgtacgtggccccggtcccccagccctacgttccgcctgccccagccccgtatgtaccaccggcaccctctaaatacacaggaccgcgctgctatgcgccgggcgggaagacctggcgcccctgctaaacacccaacaacagcgggtccgagagcttaggtgctcttcggacccgctgttgttaattgtcgattcaagaggtcgtttgatcgtccgagtgggcgctcctgcggcgttcctcgatgctctgggcgacctgcagaatgctgtcctccacgcctccggcgatggcctttggtgctgccgcaacagtgccggccgcagtaccaacagctccagccacggcgcttccggctgcgtggcccagatcgagaagggacgtgtgccattccttgcgctcgaacgcctcagtagccggcatgccgtaagcctcggagagcccggcagctcgacttttccaggtcctgaccaaccacctggtggaaaacggcaaggtcaatcccgctgccctcattgactcgccctaccacgagctcgcaccatccgggcctgacgtgctgttcggtgacgacggcattgtgaaactgttcggcatcttgcgcgccattgaggacaacgcacgcgtcagctgactctcaggcctaccccgaccgccgctaatgcggtcaaaaaagcggtgcggcgttcttctccacaagggcggggttccccacggattcacgcttcttcttaaggaaaccggcgcgctgatatcgctgggccatgatgaaccctgcaggcgtgccatgctcgtaggactcgacgaagacagcctcctgacgaccctcggacgtggtcatgtagccatcccaagcaacgcacgcccggtccggatgcggctcctctttgacggactgcctggcggcggcaacgcctgcctcaagctgattctcaacgaggtagcgctgcaggttccgctgtccgccatgctcccggatgacaaacgggaccaggtccgtgccggacgagaccaccgaatcaatggcgtggtccaaggccataaacgcaaggttgacgagttcctccgagtattcatccatagcaggaggctaaccggcccggcagaagaaaagaacaggtggatgatagaaattaggtagacactcaacgactactaggtggaatggttcgtggaaaacgcggagaaagaactgaacagccgcggcatcaaaatcacgcagtggaagtggttgagtaccgacttcagcggatatgaggatacgcaaaatagatcactactagcgaacgcagtagtaaaagagcccgcaatgtccggccgagcaaagatttttgttgcagcattcgtggcatttgtctttctgctgccgatgctgctcgtcaacctaacgggtagcgacaaccttctcatcagcatgttgcgttgctttgtgatgctggtagcggcactcgtggtctggagccgcagtacgttgtttgtcgtcctcggatcggcggtgtcgggactgtttgccgttggagcggtgaattccttggcccgtggttccagcaccgagggcacgatcggactctttacccttgcggtcgcatttgccgtgggctggtataccgcgccggtttttagaaaaaacaaaattgcggtttccgacgatcaggtcgtgtacgggcatcagccgtcagagtggggccggggtgctggcgattccacgcgcagcagcatatgggtgatggggctgcttctcaacaagctcgtcatgattcccggtgtttatgtattccacgggctaaagtcacccggagccaagcggattgacgttgagcacgcggtatcgcatggaaacactgtgtatttgatcgattcatggctagacggatctacacattacaactggcacccgaacagcagggggaccgtgatctcttccaaaggcgatgacggtcaccggcacgcccaaatcgccaatgctgcagatcgctaccgcgcagccctgggtgcgggcgtgaacatcatcccaatcatttcagtcacttcgggaactgcctccatcggaccggaaagatggtcgcctcgcggcgttggcctttttatggctgacgaggtgttgggattcatcggagatggcgcagtggacagtctcccgacatggcgcgaccggcccgaggttcgtcaaatgctcgcttccagcgtcgtaagctacgcctgaaaaggcgattttcgtcaggcagacgcgcaaccttcttcggcgtggtgaacccacgactgaccgccgcattgacaccgcgtgtgacccctgccatatttaaagcgtgaacctgtcagacagccggacagcaggacagcctgcaccccttgcgcgactcagtgctgccgaagcagttttcaatgcgatccggcaggacatcgagtccggagctgtcccggtaggcagcaagctcagttccgaggccacgctctcccagcagtacggggtgagccgctcggtgatccgcgaggccctccgctcctgcaccgccctgggcctgaccgtgaccaagacgggcaaaggcacgttcgttgtggcggacaaggtggccaacgaccttaccctcggccagtactcagcacgggacctcacggaagcacgtccccacatcgaggtccccgcagccggcctggccgcggagcggcgcagtgacggggaactggaaacactccgccacctcgtggccgccatgcgcaccgaaaccgatcccgagtcctgggttgccctggactccagcttccatgcagccatcgcccgcgccagcggcaacagggtgttcgccagcgtggtggcggacatccgcggcgccctggcccaccagtccgaaaccctgaacatggtggcggacaggcagcacgcctcggacaccgaacaccaggacatcctcgccgccatcgatgcaggctccgccgaggatgcacgcgccgcgatggcccaccacctgcacgccgtgggcctggccctcgattccatcctcagtaaataaccccgccccaacccagccaaggaatccatgctttcccctgccctttcacctgccctcagtgctgccgccctcccgcagcacacacccctggtcgccgccacccgcgacgggctggtggaaagcgtccactacgggtcagccatcgcgctggacgctgacggcaccacagtggcctccgccggcgatccgcttgcaccgttctacccccggtcctcgctcaagccgctgcaggccgtggccatggtccgtgccgggctcgaacttcccgcagagctcctcgccctggctgccgcaagccactcgggcggcgcaaagcaccgccagggagccctgcggatcctggaacagcacggcctcagtgtcagcgatttcgacaacagcagggacctcccctacggtccggccgaacgggaggagtggctgcgcaacgggggccgttccacccagctcacccagaactgctcgggcaagcacgccgccatggccgccacctgcgccatcaacggctggccggtcaagggctacctggaaccctcgcacccgctgcagcggctcgtggccaccaccgtcaccgaactcaccggcgaagaacccctcgccctcagcaccgatggttgtggcactcccctgtatgccctgaccctgccgggcatagcccgcgccttcggtgcggtcgcccgcgccgccgcggacagcagtggcaggaacgacgacggcgggccggcccacctgagtgcggaagccgccgtcggcctcgccatgcagcagcacccggacatggtggcgggggaaggccgtgacgtcaccgagctgatgcgcctgcttccgggcgcggtggcgaaggacggctttgaaggcgtccagctggtgggcctggcggacggccgctcggcagccgtaaaaatttccgacggcggcgaccgcgcccgcatgcctgccaccctcaagctgctggaggcgctgggcctggacaccaccgggctcgccgccctcggaaccgccccggtcctgggcggcggcctccaggtgggcctcctgcaggccactgatttcctgagccaaccttccctgtccacacccgtcaacgaagccctgtaaggacacatgaccatcatcgatacaccagcctccgcagccgcaacctcacctgcgcacacccggtccgagcacgacctgctcggcgaccgcgacatccccgccggcgcctactggggtgtgcacacgctccgggccgtggagaacttccccatcaccggccagaagctgtcatccaacatgcatctggtccgcggcctcgctgcggtcaagctggccgccgcccgcaccaaccgggaactgggcctgctggatgcggaacgctcggacgccattgagcaggcctgccaggacgtgctggacggcaagctcgccgaccagttcgtggtggacgtcatccagggcggtgccgggacgtcgtcgaacatgaacgccaacgaggtcattgccaaccgcgccctcgaaatcctcggccaccccaagggcgactacgcccgcctgcaccccaacgaccatgtgaacctcagccagtccaccaacgatgtctaccccaccgcggtgaagctgggcactatcttcgccgcgcgggaactgctggaggcgctggccgaactggaggaagcctgcgcagccaaggccctggaattccgcacggtggtgaagatggggcgtacccaactgcaggacgcggtgcccatgaccctgggccaggaattcggcagctacgccatcaccatcggggaggaccgcctccgcctggctgaagccgatctgctcatccacgagatcaaccttggcgccaccgccatcggcaccggtctgaacgcccccgcgggctatgcggaagctgcctgccggcacctcgccgaagtgaccggcctgccgctggtgaccgcgccggacctgatcgaagccacccaggacgttggcgccttcgtgcacctgtccggcgtgctcaagcgggtggccgtgaagctctccaagatctgcaacgacctgcgcctgctctcctccggaccgcgcgccggctttggcgaaatcaacctgccggccgtccagtccggctcgtccatcatgcccggcaagatcaacccggtgatcccggaagtggtcagccaggtggcctacgaggtcatcggcaacgacgtcaccatcaccatggcggccgaagccggacagctacagctgaacgcgttcgagcccgtcatcgtccacagcctccacaagagcatctcccacctggaagccgcatgccgcaccctgacggcgcgctgcatccggggcatcaccgcgaacaccgagcacctccgccgcacggtggagcagtcaatcggcctggtcacagccctcaatccccatctgggctacgccaccgccaccgccatcgccaaagaagcactggcaaccggcaagggcgtggccgaactcgtcctggaacacggactccttaccaacacacagctccaggaactcctcagcccagagcgcctcgccaacctgagcaagtaatcccccatgccaacggacaccccaaggacccccatgtcgaatcccacgctcccggaccacgtcattgacggcggtcatgcccatgcttccgaatcggcgctgcatgccgaggacaagggctaccacaagaatttgaagccccggcagatccagatgatcgcgatcggcggtgcgatcggtaccggcctgttcctgggcgccggcggccggctcaacgccgcgggcccgtccctggtcatcgcgtacgccgtctgcgggttcttcgccttcctcatcctccgcgccctgggcgaactggtcctgcaccgcccctcctcaggctcgttcgtctcctacgcccgcgaattcttcggcgaaaaagccgcgttcgtctccggctggttctactggatcaactgggccaccaccaccatcgtggacatcaccgccgccgccctctacatgaacttcttcggcaactacatcccctggatggcagctgtcccgcaatgggcctgggcactgatcgccctggtggtggtcctcgccctgaacctcgtctcggtcaaggtcttcggcgaaatggaattctggttcgccctgatcaaggtcgcagccctggtcatcttcctcatcgtgggcacctacttcgtcatcttcggcacccccgtggacggccagcaggtgggcctgagcctgctctcggacaacggcggcgtcttcccgaacggcctgctgcccatgatcatcctcatgcagggcgtcctgttcgcctacgcctccatcgaactcgtcggcaccgccgccggcgaaaccgaaaaccccgaaaaaatcatgcccaaagccatcaactccgtggtcttccgcatcgccgtgttctacgtcggctccgtcatcctcctggccctgctgctgccctacacctcctacgaaaaaggcgtcagccccttcgtgaccttcttcggctccatcggcatccagggcgtagacgtcatcatgaacctcgtcgtcctcaccgcagccctgtcctccctcaacgccggcctctactccaccggccggatcctgcgctccatgtccgtcaacggctccgccccgaaattcgcctcccgcatgaacaaggccggcgtcccctacggcggcatcgccatcaccgccggcgtctcactcctcggcgtcccgctgaactacctcgtcccggcccaggccttcgaaatcgtcctcaacgtcgcctccgtcggcatcatcatgacctgggccaccatcgtcctgtgccagatccagctcaaacgctgggccgacaaaggatggctcgagcgcccctccttccgcatgatcggcgccccctacaccggctacctctccctcctcttcctcgcaggcgtcctcatcatggtcttcatcgaatcccccctcaccatgctcgtcaccgccatcgcctccgtcctcatggtcatcggctggtacgcctgccgcacccgcatccgcgacatcgcccaaacccgcgaaggccacaccggactctcccccgtcatcgccaacccgccagcggcaaccttcaagaagtaacccctcttcctaacgcccgacggcggcacccaggttctggagctacagaacccgggtgccgccgtcggggtttaacaaaaggtccggcgttggctacttgtgcgaaggtttcaccaccagggccgagcccccgccgcggcgcgtcggttcggccacggcggtgaccttcttcccgtcgtcgctgaactcgatggccgtagcggcgccgatctcagacgcggaggtgaacgcgtcacccgccggcacgagcttgtgaccgtactgcgtccccagggtcgggaaggcctcgatgaacgccggctcagccgtcacgtttgcggtgttccgctgggacgcgcgcggggcggcgagcgcctcctcaatggtcatgccgaggtcgatgcggttgatcagcgtctgcagcacggtggtgatgatagtggagccgcccggagagcccagtgccagaaacggctcgtcatccttgagcacgatggtgggcgacatagacgaccgcggccgcttccccggctcgatgcggttcgggtccgtagcgctgtagacgggcgagaagtcggtgagctcgttgttcaggatgaagccgcggccgggaaccgttataccggagccgccggtctgctcgatggtgagggtgtattccacaatgttgccccatttgtccgagaccgtgaggttggtggtgttaatgttctccgtgtccttctcatctgcgagtgctgcaggctcaatgtcacacgtgccgtcgtagtccgctgcgtcacctgccgccacaggcttcgttgctgcctggagtgggtcgatttcacaggccctctccttgccgaagaccggatccaggagtttcttggtgggaaccttgacgaaggcagggtcccccacatacttgccgcggtcggcgaacgcgagcgcagtcgcctcaagatagtggtgcagggcggcaggctggtccttcttcaggccgggaaggtcgaagacctccaggatattcagcgcctcacccacggtggtgccgccgctgctggagggcgccatgccgtagacgtcgtagccgcggtagttcacatgggtggggtcctggtccagcgcctcgtagtcgtcaaggtcctcggtggtcatcacgcctgcggggccgggcaacgcatccggtccgggtgctgaaggagcattccggaccgtccgcacaatatcctcggccagtttgccctcgtagaaggcgtccttgcccttgctggcaagaagcttgtacgtttcggccagatccgggttcttgaagacagttccgacggcgggaggggcgccaccgggaaggaacagctcccttgttgcctcgaacggagcaaagcggtcctggttgtcagcggtttgctggcggaaggtttcgtccaccctaaatccggcggtggctacttttatggccgggctaaggacctcggcgaggctgaaccggccccagcgctccagcgcccgctcccacgtggccggcgtgccgggaacacccacggaaattccgctggtggcctgcttcttgaacgcatacggcttgccgtcttccggattgatgaacgccgtccgcggcatttcggccggcgcagtctcgcggccgtcgatcgtgctgacttcctcactctcggcgtcgtagtacacaaagtagccgccgcccccgatcccggcgctgtacggctcggtgacgcccagtgttgccgcggcggcgacggccgcgtccacggcgttgcctcccttgcgcaggattttgatggcagcctcagatgcgtccaggtcgacggtgctcacggcgccgccgtagccggtagctactggggtctttttggatttatcatcctgccctgaatcggcagatgccgggctggttaaggcaccggttgtcacgctcatcgccagcgctgcagtgaccgcagcgagccggcgtcccagatatggcatggttgctcctgaaggggtgcgggtgaggtggatcacacgctactcctcccgtaatgcacactcaacgctcccgcctaaccctgctgcctcggtagcatgaaagccactgccggcagttgaaccaccaacacggtccccgttcgggccggggaaacgaggtacctcatgtcaggatccaaacttgccgttgtgggagcagggagcgtggggacctccctcgcgtacgccgccctgatccgcggttcggccagcaacatcgccctgttcgacgtcaatgccgccaaagctgacgccgaggtactggacctcgcccacggcacccagttcgctgccgccgctgcgtccatgaccggcggcggggacatcgccgtgacggagggcgccgacgtcgtcgtcatcactgccggagccaagcaggcgcccggccagacccggctggacctcgccggaaccaacgtgcggatactggaagagctcatgccccggctcctcacgcactcccccgacgccgtctacgtcctggtcaccaacccctgcgacgtgctcaccgtggcggcgcagaagatctccggactcccggcggggcgcatcttttcctccggcacggtcctggacacctcccggctgcgctggctgctggcacgccgggcgggagtggccgtccccagcgtccacgccagcatcgtgggcgagcacggggacaccgagttccctgtgtggtccacggcaaccatcggccccatcccggtccgtgactggatggtggacggggagcgcgtcttcacccccgaatacctggcagagacggcacgcgaagtgacgcaggcggcgtacaaggtcatcgccggcaagggcgcgaccaactacgcgatcggcctctcgggcgcgcgcatcgtggaagccctgctccgcgatgacaaggcggtgctgccggtgtccaccgtgctggacggacagcacgggatctcaggggtggccctttccctgccgagcgtggtggggcggggcggcgtccacaccgtgctggaaatgcccatggacgacggcgagctggcagccctgcagcattccgccgacaccctgcggcacacgctggccaccttgggcatctgagcgcccccgccagcgcccggcccggccggccgtcatgcaacgcccccgcaacccccaggccgctgcgggtcgcatatgctcagcagagcgctgcacaccgctgctctaacagttcaacgacgaaccaccacaggagtagacccatgaccaactggcgtatcagggatttccattcggcggacctggacgggatcctgcacctgtgggaaagcctcaaggcgagcaacgtggaacccgtctacgccctctccgaggtactggcttcctgcgagaaggaccatgccgtggtggcggtgcagggcgagcaggtggtgggggccgccgtcggacgcgccgcccatgaccagggctggatcgtcttcctggccacgctgcccgaataccgcggccgtgggatcggcacctcgctgctcgccgccgtcgaaaaccgcatggcgccccacggcctcaacaagctctcagcgctcatgccggagtccgaaacccgggtggaggcgttcctcagccgcggcttcgcactgaagaagaacctgcggtacttcgaacgcaccattcccgtccagcggcaggaactcggtgcgctcggccagctcggcggacgcgtcctggcccgggacctctgggaaaacgtggccggcatgcgcaaggaaaaggaattgctggaacgccgcctggtcctcccgctcgccgaggcggacctcgccgatgagttcggcgtggtcccgccgcgcgccgtcgtccttttcggcccgcccggcaccggcaagaccacgtttgccaaagccatcgcgtccaggctggaatggccattcgtggaggtgttcccgtcccggctcgcggccgacccgcagggcctggccggggcgctgcgcgagacgttcctggaaatcgccgagcttgagcacgcggtggtgttcatcgacgaggtggaggagatcgcctcccagcgctccggcgagccgccgtcccctttgcagggcgtcaccaacgagctgctcaagatcatcccggccttccgcgaacagcccggccgcctcctggtctgcgccaccaacttcattcgcgcactggactcggccttcctgcgccatggccggttcgactacgtcatccccatcggcctgccggaccggcaggcccgcgaagccatgtggcagcgtttcatccccgcgcccgtagtggactcggtggacgtggagctgctggtggaacgcaccgagggcttctccccggcggacattgaatatgccgcgcgcagtgcctcccagcgtgcgctggagaaagcagtgtacgacgacggcgggctcgcttccggaggcagcctttccgtccgggaggcggtgcggaagggtccatccacccaggactacctggacgccatcggcgacacccggaccacggtcagcgccgaagcgcaccaggagttcctggaggacatcgacgccctgggccgcgtttaggacataacttccggagcgggaacggcggggcgtaatctttgacccatgtcctccaatcccctccgccatgccatggcgcgcatgggcggccgggacccgcacgagacgcaccgggccgccactccccttgaactcttcttcgacctgaccttcgtcatcgcctttggggttgccggcagccagttcgcccacgagatcgcggaagcccacgtcctggccgggctgctgggcttctccttcgcgatgttcgcagtgatctgggcgtggatcaacttcacgtggtttgccagcgcctatgacactgacgactggattttccgcgtggtcaccatgatccagattgtgggcgtcctgatcctggccatggggatcgagcccatgttccattcgctggtggcgggcgagcatgtggacaacgcggtgatggtgggcggctacgtgatcatgcggctggccctggtttcccagtggctaagggcagcccggcaggacccggcccgccgggaaacgtgcctccgctacgcgcggtatcttgcgctggtgcagctggggtggatcgcggtagccgtgatcgaggctgacgtgcccacaacgctgctcatgattgcgccgctgatcgtgctggaaatgttcactcccttcgccgccgagcggaaaaccaggacgccctggcacgcgcaccacatcgccgaacggtacggcctgctggccatcatcgccctgggtgaatgcctgatcggcgccatcgagacactccgggccatcgtggccaaccatggctggagcgttgatgcggcgctggtcggtttcggtgggacagcgctggcgtttgccatgtggtggatctacttcatgctgccggccggacgtgccctgcacctgcgccggcaccggtccttcctcttcgggtacggccacatccccatcttcgccgccattgcggccaccggcgcgggcctgcacgtcgccgcgtactacattgaccgcgaagcccacatcagcgcagccgccgcggtggccagcatcgccataccagtggcacttttcaagggctccgttacgtggctgtacagcatcatggtgagcccggaccgcacggtgatcacggttgccggcggtgtgctggcctcgatggccgcttcagtcggcctggctgcggcgggcgcatcggtccccgcctgcctcctggtcattgtgctggcgctcggcgcctccatagtgatcgatgaacgccgcgggtccggccggctgcatcttgcccttcaaaaactggaagcaggaactaccggtccccgggcgacgtagcgccggaagcctcacttccggcggtatccggctcccgcgcagcctccgggccggcgtcaccgtaggacaggttctcgtagtccgtggtgtcctcctcatccaggcggtcatccagttcttccagcagccacggattcacgcgggccaggatcttccggatttcctcaacctcgacggcggcgtacagcaccgggcgggcgtccctgtacttggtgacaggcggcctgtccggccacttttccgccagcgcctggacgcgctcaggcagcgagttgtgcgcattgtccgcgatcttgaccagggcggcatcgtggtcctcggcgatctcgcggatccctgcctgatagtcatccgggttgctgtgcagccggttggtgacccgctcaatgatttccacggcccgctcggatacgcccatgtccagcagggcctgccgggtcatgggggtgtcctcggcga

SEQ ID NO: 21 - DNA, 19846 bp, Arthrobacter sp. OY3WO11
gtcagccagcgcgtcccccacggcgaggacatggtccttgtagggcctcttcagcttgtccttctggcggttgtgggccacctcggcaaggaccttcgcggtctctacggtgaacgagggtacccgggtcggctccgcagcatgctggtctgacatgccctaagcctacgggccgctccacacccagggctccctcggcagggcatccgggtcgaatgcagccagcgcgttcccgagcggccctgccggcagccccagtgattccagcagccggtcccgcacctcgtcaggaggaaatccttcagccgccaggtccgccagcgttactgcaccgtcgcgctttgccagccgggcgccgtcgttattcaccaccaggggaacatgcgcatattccggagatggaatacttagcagggatgccaggtaggcctgccgcggggtggacggaagaaggtcgtcgccgcgcaccacctggtcgatgccctgttcggcgtcatccaccaccactgcgaggttgtaggcggtcacgccgtcattgcggcgcagcacgaagtcgtccaccacgccggtgaactccccgtgcaggaggtcccgcaccgtgtattcagcggcttcggcgcggagccggatggccgccggcctggctgagcgcttgaactccagttcagcaggatcgaggttccggcatgttccggggtaggcaccctgcggcgcgtgcggagcggacggtgcctcctggatttcgcgccgggtacagaagcactcataggtgaggcccgctgcctccagccgcgagatcgccccggcgtacagcgggccgcgggcagtctggcgcaccacgccgccgtcccaggtgacccctgcagcctgcaggtcccgcagttgcccggcctccgcgccggaccgggcacggtcaaggtcctccatacggagcagaaacttgcggccggtggagcgggcaaacagccaggcaaggattgccgtgcgcaggtttcctacgtggagttccccggaagggctgggggcgaagcggccggcggaggtcatggttcaacactaggcgcgggacacggtgcccggggacaacacaagggcccctcagctaccgatgacttcggacatccgacgccggtagttcaggggcccttgccgtgtttacagaaagaccatggtgtgaacaagagtcaatcagggcagcctccttgcgggaagcggtgtccagtgtccgggtggtgtgccggcagcctgtgagcctcgcggggatcggcggtagccttgccctcattgccaacatttcaccagcatccatacagttggtgcaacaggtgcggctgccactgaacagtctgactactcatggcagcgcagagggacaggaagtgatcagattgcaggaactggacgccactgacaagcgcatcctcagggccatggacgaggatccccgggttcccatcatggttctggcccagcggctgggcctggcccgcggcacggtccagtcgcggctggagcgcatgacggcctcgggcgccctccgccccaacagcagcagggtgcttcccgccgcactcggacgcggggtggccgcttccgtcagcgcagaactggaccagagccacctcaacgaggccattgccgccctccgggagatcccggaagtccttgaatgccacgctcccgccggcgacacggacctgctgatccgtgtggtggccaccagccctgacgacctctaccgggtgtcagaggagatcaggctctgcccgggcatcgtgcgcacctccaccagcatgttcctgcgcgaggtcattccgtaccgcaccacggggctgctcaaggattagggcgcgggagtcctcccagccaatgcctaaacgggagggcccgcgttggacttcaggttcttcatcaccagcgtggacgtcagccgctcgacgccgggcagggacgtaagttcggcgtcgtagaagcgctggtacgcgggcaggtcctcggcgatgaccttcagcaggtagtcgggggaaccgaagagccgctgggcctcgacaatgttgggattgtccgccacgcggttctcgaagatctccatggttgcctgatccacctggcggagggtgacaaaaacaatcgcttcgaacccgaggcccacggcggcaggatcgatgtccgctttgtaaccccggatgacgcctgcccgttccaggtcgcgcagccgccggtggcagggagcaaccgtcaggcccaccttccctgcgagcgccgtggcggtcattcggccgtcctctttgaggtgccgcaagatatttctgtcaatgtggtcaatcacgcaagaatcttaccgtccagccagctcggccagcgaaaaaaagacagcacttccgcacccaaagtatctagtgtttctcctgttggatcgcgcagcaggagaaaccatgaaccccgaactctttttggcctttgtgctggtggccgccgcccttgcctgcacccccggcgtggactgggcctactccattgccgccggcctcaggcagcgcagctttgtgccggcggtagcggggctctgcggcggctacatcctgcacaccgtcctgctggtggccgggctcgccgcggtcctcacgggcgcgccgggggttctcggctggatcaccctggccggcgccgggtacctgatgtggctcggtgtcagcaccctccgctcctggcgggcggcgagcttcacggccggggacggcagcggaggcaacactgggctccgcaccttcctccaggggatgggcaccagcggcatcaatcccaaggggctgctgttctacgtggcgctcgttccgcagttcgtcagcgcggacgcttccctgccggtcccggtgcagtctggcttgctgggcatgacgttcgtgctgctcgcgggactcgtgtacaccgccgtcgccctgctgtcccgcaccctgctgcagacccggcccggcgccgcccggacggtgaccctggccagcggcatcatcatggtggtcctggcgctggcgctgctcgccgagcagctgctgccgctcctcacggccagcaccttcgccgcggccgggtaggccgccctagtcgccgctgagctccttccagtcctgttcccagatccggcgcatctcctcgtccttgcggatgggcaccggcgcggcaatctcccgttgcggcaccgggtcctcgcggcgccgtccccagtcccgggggttaagcgacctccggctggagtcgagcagcagcagggcccggtccgtgagggcgtcgttgcgcagcgtcatgtgggtcttgcgccggcgcaggacctcggcgagggtctggttcgcggcctccagccgcccctcccgccgcagggcccgggcccgtaccagcagcagcgcggcggagaggtcgtccgcgttgagcagcccgtcggtccagtcgatcaccgtccggctcctgcccagggtcagcgccagggaacagcgcgccagggccatggggagcgacggcggcagccccgagagggcgtccagcgcagcttccgtgcgccccgtctcccgcagtgaatgcgccagtgccagaaagaccgactcctcgctgaacaggaccggaatttccacgcgctcggccagctcgatccgggtaacgatccgggtgaggtacgtggacgagtagcggttggcttcgtcctcgttccttgtggtgaggccgcgctggagaagctccgatgcgcgcaggtagccgccctgcttgtagaccagcagtccggacatgaggtagcagagcccggcccatcccgggtaggccctggcgagcgtgatcagctgctcaggctggcggctggtgaatacggcgtcgtgcacggccttggccggcttgggcatcatgcgcttcaggcgggggatgtcgccgtccacggagagcagcgccgggtggcgtccgccaagcacgccggtgagcagttcgcccactcccccggcgaggtcatggacgggggtacgcagctgcggctggccgaagggtgtgaggtcgcggctgtcccaatagatcggtgcagtgtccccggcggtcatctctccatgctaaccgggagccccggaacgaactccgcacttgttcaaactgacttaatccgcaagggtagtaagcacccttagcagttcaccatcaacgaaggagagcgccatgaacatcgacaagtcccagattctcgaactcctcaggagcaggggagacaacgacaaagccgcccaggccgaggccgaactgccggaccaagtggacaccgaacagcattccgggctcctgtcccagctcggaatcaaccccgcggaactgctaggcaagcttccgggcggccttggcgacaagctgggaggactgggcctctaaggccgccggcgagccgtgccgcacagggcttacgcccgctccatgaaccattcggtgaaggcggcggcacggcctgccccgtcgaaccgtataacccacaggttgtcgtaggagggccgtccggcggagtaggtggtcacgccctggacgaaggcggtgtccgcgtccgctccgaggagcttccacgtgaaggtccagtctcccggttcgtcccgggccgcaagccagcggtccactatgccgtcccggcccagccacggctccggatcgcccggccgcgtctcgtaccgtgcgtcctccgtaaagaggtcccggatgtcctggggctggttgctggcccaggcggcctggtatttttccatccaggcgtgcacgtggtcccgggctgaaggctggtccgtcatggtgccgttgtacgccctgcggcacgcaggcgcaagcactttcagccgttggcggctgcgacccagacgccgatcacccaggtgctggcggcgaggcaggccaggccgaactcggcgagcatgcccagcccggtggctttgagggcggcccagctggaggttgttgcggagccgatgtttcgggtgcgcaggaattcactcagcagcaggcccgcggcaaaacccacaaagagccccaccacgggaatgatgaacatgcccaccacgcccgccaccagagcaacggcgatgcttcggctcggaatggcgtgctccttgagcttcctgccggtgaggacggcactggcggccatgcctgccaccacgaacaccatggcaaccgcgaacaccacccaccccgccgtgccggccccgccccagatggcccacgcgagcaggcttgcgccgatgaggatgctgcccgggaggaccggaatcaccgtacccgccacgcccacaaggattgccaggccgcacaggatggtcaccacggtttccgagttcatgggtcccagtctatggttggcgcccatttaacccccgacggcggcgcctcccgcgcaggggaggcaccgccgtcgtacgttcttttgagggaaggggcgctactgggcttccaccgcggccgccactgccgccgtcacagcgggggcaacccggggatccagggggctgggcacgatgtagtccgccgacaggtcctccgccgcaagatcggcgatggcgtaggctgccgcgagcttcatggccggggtgatgcggcgcgctccggcgtccagggcgccgcggaagatcccagggaaggccagtacgttgttgatctggttggggaagtcgctgcgcccggttgccaccacggcggcgtacttcacggccacctcgggcaggacttccgggtccgggttggagagtgcgaacacaatggcgtcctggttcatgagcttcaggtgcgcctcgtccagcctggaggaggagacgccgatgaagacgtcggcaccggcgagagcctcggccgggccgccttccacgccgcgggggttgctgcgtccggcgatgtccgccttcttgctggcggtgtccgcggcgaggtccccgcgtgcactgttgatgacgccccgtgagtccagcaggacgacgtcggtgatgccggcggccagcaggatttcggcgacggcgatgcctgcggcgcccgctccggagaccaccacgcgcaggccttccaggccacggccggtcaccttggcggcgttggtcagggcggcgagggcaacgacggcggtgccatgctggtcatcgtgcatgacggggcagtccagcgcctcgatcagcttttcctccagttcgaagcagcggggcgcggagatgtcctcgaggttgacggcgccgaagctggggcgcaggcggaccagggtctccacgatttcgtccacgtcggtggtgttgaggaccagggggatcgagtcgaggtcgccgaaggtcttgaacagggcggacttgccctccatgacggggagcgaggcgctggctccgatgttgcccaggcccaggacggctgtcccgtcactgaccacgacgacgagccgctcggcccaggtgagcgtacgggcgagttcgggcttcgcatggatggcccggctgacctcggctacacccggcgtgtaggcgatggacaggtcccgcttgttggagagcgggacggtgctggcgatagagagtttgccgccctggtgggcgtcaaagatctcggcttcggtcagggcggtggctgcggaattgtcagttgctgcaagtgcgtcaatggacacgtcgttgtctcctggtgctggccgtgggcgcacggctcgtggggcatgagccaatggctcgggcggtggctagggtgcggcaggatacccaggggtggcgggcccgtgggagcttggaggattggtccccgctgctccgtttggtcaatcgtagggcccgccacccggggcagcgtccggtttgacatgggtcagcggctgcctaagcgctttaccgcgcggttatgtggtccaattcacggcattatggctgatttaaggccggattggtctagacctgttacgcgctgtggtggagtgtgtagccgggttcgctggctggcgagaggcgggcgcacgcccttttgaggtcctcttccgcctcgaagagggacagccggcggttccggacggactggaccagaccagtgatggccagcagcagcacccgggcggcggtggcgtcaccgcaggctgaagcgaccgcttcttcgctcagcgcgtcgatttcacgcagcagtccggtggtgtcccggtccgggaggtagacaccgcggctgaggcactgctccactgcaggctgcatcacgcgcatatggaaaatctccatcaccaggttcccgagggccctgccgcggcagcgggccgccgtggttcgtccggttccctggagttcctccagctggtggcggtagagcgcgagcatcagatgcaccggggaaggaaagtaccggtaaagggtccccagcggcacgtccgccctcgccgccacatccgccatgtctacggaatccagcccctttcgcgcaaaccctcccgcagcttccaggatcttggtatagcggtgcctctggcgtggggcggagggcctcggggccatgggcggttggtctgaaatggtgtcgggcatcagcgttccggggttgtgttcctatggtgcggcagccacgatcgtcccctgctggaccgccgccaaatccggatcaactatacggcacggcagtgtgccgtaattagtcagcggccttagttccggggccccggcaggtcagcggacactcttgattttcacgacgaaaacggcgccaaggaggccgatgacggcagcggtaacgaacagcgacatgtagccgccggcatacctcacggcgacgaatgccagggtcggggccaccacctgtggaagggaattggccacattgatgacgcccatgtccttgccccggtcaacagcctgcggcagcacttgggtcagcaacgcgaaatccaccgcaaggtaagccccaaacccgattcccaggacggcagcccccgccagggctccaggccacacggggaagaacgccaggatcagggcggctagagcgatagtggccgaggaaccaatcacgaacggcttgcggcggccaaccctgtcgctccaggggccgaccaccacagcggtgaccatcaccagtatcgcgtaggtgccggtgaggaccagcacgcccgccgcggggtcctcatggttcaggatgtcccggaggaaaaagagcaggtagacgatggtcagctggttgccgacgtttaccaggaagcgggtaagccaggcccagccgaagtccgggtacagccgggggctgatccagaagccccaaaggaacgcctttaaccggaagcgcggcaggacgcccttggggagcacgggatcgtcccggtggaagaggtaggggaacaccgacaggagaagggctgcggcgcaaagccagtagccaaccatgaagttgccggacaccacggcgccgaagacggctcccgtgaagatacccagcgtctggcccattgctgccaggccgcccacctttccgcgctggggcaccggaaccctgtccgggacggcggcggtgatggccgcgtaggccgcgtttgcccccagctggaccaggcaccagaacagcaccatgagggccacggtgcccgctccggacatgcccaggagggccgccgttgccagcaccgcacccgccagtatccagggcgaacggcggccaaagcgggatgtggtgcggtccgagagggcgccgaagagcgggtttgccaccagtgaaaccgcggccccgcacgctgtagcaagggacagaatggcttccttgttggcttcatcgaaactgatggcctgctgcccgatgaagatgttgatggggccgaagaacgcggtgttaatgcccaggttcaccaggaccagcccggtcacccaccgtgcggtgaccttccgtgttggttcggcgagtgccgccaccgcaccgccctgcagaatggctccgtggccttggcgtgcggggtcgaggggtgcgggcgtatcggacagactcatgacgtgttcccccggctgcggctaaatggcgacggagtcagactatcgtgggcggtaccgccccgccgggtatgacggcggcggccaccaggacggccacgagcaaagaggagaacaccatgagcgcagcgtcaacgccggcggagggcaccgccgccatcaatacggcggacctgtacgacgaacgcggagacgaactggcgtccgtatcgctgcagttccagtccctgggcggccgcacccacttcagtggacaggcgcggaccatccgctgcttccaggacaacgccctggtgaaatccacgctggccacgcccggcaacggcagcgtgctggtggtggacggcgcaggctcgctgggcaccgccctgatgggggacatgatcgcggagagcgcagtggcaaacggctgggccggcgtcgtgatcaacggggcgatccgcgaccgcgaggcaattgccgccctggacctcggtgtgaaggccctgggcagcaacccccgcaagagcgccaaggccggggctggcgaggtggatgttgacgtggagatcgacggcgtgaccgtccgccccgggtccatgatctggtgcgacccggacgggatcctcgtggagcggtagccccgggccggaaaaagtttctccgctgggaggaataggactgggcatacgatagttactgaaagcaactatcaacgcgtgatccctttccttcccctggagtacccatgtccaccgcccctgccgcgcgcgccgccggagaaaccctgacacagcgccagattgtcaccgtgatggtgggcctgatgctgggcatgttcctggcatcgctggaccagaccattgtgtccacatccatctacaccatcgccaatgacctggacgggctctcgctccaggcctgggcaaccactgcctacctgatcacctccacggtcagcaccccgctgtacggcaagctgagcgacatcttcggccgccgcccgctgtacctgaccgccatcgtgatcttcctggcgggctcgctgtatgcaggatcggtgcactccatgaccgaactggcgctggcccgcggggtccaggggctcggggcgggcggcctgctggccctcgcactgaccatcatcggcgaccttgtctcgctcaaggaccgggcgaaataccagggctacttcatgtccgtgttcggtatctcctccgtcctgggcccggtggtgggcggcgcatttgccggttccgccaccatcctcggttttgagggctggcgctgggtgttcttcatcaacctgcccatcggcctggccgcgctcaccgtggtgttcctgttcctgcacctgccggccaagcacgtgaagcagaagatcgactactttggcgcggcggccatcacactggcaatcgtgccgctgctgctggtggcggagcagggccgcagctggggctgggcgtccttcaactccttcctctgctatggcctgggcgtggtgggcatcgcctggttcctgctggccgagaaacgtgccggcgactacgcactgatcccgttgcgcctcttccggaatatgaccttcggcctgtcctcgctgctgaacttcatcatcggcatcggcatgttcggggccatcgccatgctcccgctgtacctgcagttggtcaagggcctcactcccacggaagcgggcctgatgatgatcaccttcaccgttggcatcctcaccggctccatcacggctggccgcaccatctcggcgtccggcacgtaccggatcttccccatcctgggcacggccatcctcacggcggccgccaccgccatgggtttgtccctgggcgtggacacgggcctctgggttcccggcgtgatcgcggtgttcttcggaatgggcctgggcttctgcatgcagccgctcaccctggccatgcaggtgtccgtgccgcgccgcgacatgggcgtgggcacctcctcggctgccttcttccgctccatgggcggcgccgtgggcacggccgtgttcatctccatgctgttcagcctggcggcggcccgcattgccgacaccatgaagtcggcgatgggaagcccggagtaccaggcagtcctgcaggacccggccgtcgcaacggatcccgccaacgccaagctgtacgagttcttccagaacggcgcctccaacgagtccctcaatgacaccagctggctgcacaccgccaacagcacgctgacgcgccccatcacggagggcttcgcctacgccatcgacgccgtcatgctcaccgctgccgtgctcaccggcgtcgcgttcctgatcagtttcgcgctgcccaacaagaagctcacggactccacgtcagttccgcaggagtcggtcccggcccactaagccagaccgctccacgccccaggacgacgacggcggcgcgccccgccgtcgtcgtccgctgtttgcggacaagcggccccgcatccggcgcccgactggaacggcgccccgtggcatggaacactgtgtaacgcgtgtgcgccggcccagggccggttccgcagccgacgacgtccgcaccgcatctaccacaacccagacctagggagacccatgcccactgcacaggagcagacaaccgcccaaataccgcagcgggtgatctggctggcgctcgcgggcgcggtgggcggattcctgtttggctttgactcgtcggtggtcaacggcgccgtggacgccatgaaggacgagttcgcgctgtcagaggccgtcaccggcttcgcggtggccgtcgcgctgcttggctgtgccgccggcgcctacctcgcaggcaaggtggcagaccactacggccgcatccctgccatgaagctgggcgcactgctcttcctggtcagcgccctgggcacgggcttcgccttcggcgtctgggacctggtcttctggcgcctggtgggcgggctggggatcggcctcgcctcggtcatcgcccccgcctacatctccgagatttcgccgcggcacgtacgcggccggctggcctcgctgcagcagcttgccatcaccacgggcatctttgccgcgctgctgtccgacgcgctcctggcaaccagcgccggcggcgccgaccaggcctactggctgggcatcgaggcgtggcgctggatgttcctggccgcagccctgccggcggtggtgtacggctggatcgcctttacccttcccgaatcaccacgcttcctggtgttccaggggaaggaagacgaagcccggaaggttttcgattccatcgtccccgctggagaaacggaccgccacattcgcgagatccgggacgccatcgaggaggacaagctggccggccaaaaaggctccgtgcgcggcaagacgttcggcctgcaggcggtggtgtgggtgggcatcatcctgtctgtcctgcagcagttcgtgggcatcaatgtgatcttctactactccaccaccctctggaaggccgttggcttccaggagaaggactcgctcaccatctccgtggccacgtccgtcaccaacatcctggtcaccctggtggcgatcgccctggttgaccggatcgggcgccggcccatcctgctggttggctccgtgggcatggccgtgtccctgggcgccatggccgtggccttctccaccgccgttggttccggcgaggagatttccctgcccggcgcctggggtccggtggcactggtggcggccaacgtctttgtggtcagtttcggcgcctcatggggtccgctggtgtgggtcctgctgggtgagatcttcccgtccaggatccgtgcccgcgccctgggcctggccgcggcagcccagtgggtggcgaactttgtgatcacgctcagcttccccgtgatggccgccggctcgctgccgctgacctacgccatgtacgccctgtttgccgccgcgtccttcttcttcgtgatgttcaaagtgccggagaccaacgggatgtccctggaacaggctgaaacgctgttcgtgcgcaagggctccgccgcctaaccgctaaggcaacgctctcccacttgctgcagggtttcccaggacgctctctcacttaatgccggaaaaccgtaaaccctccttcgctatttcttgtgcaggagggtttacgcgttccgggcacggggcgccgccgggccatcagagcggaagcttcatgccttcatggtccgccgcgaagccgagccgctcatagaagcggtgcgccgcagtccgcgatttgtgggtggtcagctgcatcagtgtgcagcctcggcggcgggactcctcgatggcccactgcatcatgcgtccgccaatgccctggccccggacgctggccgccacccgcacgccctcgatctgcgagcgccacgcaccctgccgcgagatgccgggcaggaagctgagctggaaggtggcaactacgtgactgtccgctgactcccgacgcgccaactcccccacgacgagcaagtggcaggggtcggcgtcgatcgcttcaaaggcgcgctcgtagggttccatatccccttggcgctcccgcccggcacccatggaatcatccgcgaggagccgcacgatggcaggcaggtccccgcgcagggcgggacggagccggaaagtcccgccgtcgacgtcggccgtcagcaaaaagggcggggcacctgggttgcggatcacccctccagcattccacggccggctgccacgggccgggagcgtggattccttgtgatccgctgcgccccatgtttggcttggggaccagcgttggaatgaattacctgattgggggaggtccgccatggatcagaaaactttgtcagccctgccgaaaacaaccctgcgggcaggaatcatcattggtgcggccggcgctgtcgcggtcatccttgctccccagatcctccagtcactgcagttgggaccgtcctactcgcaggcagtgggcgcgctcctcagtgtggtgttccagctggtcaccctgttcttcctgccgttctccgcggcgctgatagccggatccctggtgatgcggtacgtgggctcagtgctcaccggggccgcagcggctggtcaggcgaagtagacgccgatccggttgccgtcgatgtcctcgatgcggatgtcgatgtcgtagacgtcgcggagcatggcctgctgcatgatctgccgggggctgccctggtggaccagccgcccgtccttcatggccaggatggtgtccgaatagcaggatgcgaagttgatgtcgtggaccaccaggacgattgtcttcccgaactcatcagccaggcgccggaggagccgcatcatctccacggagtgcttcatgtccaggttgttcagcggctcatcgagcagcaggtagcgggtgtcctgcgcgagcaccatggcaatgaaggcccgctggcgctggccgcccgagagctcgtccacgaacttgtccgccatggcagccaggtccaggtggccgatcgcctcttccaccttggccaggtcctccacggtgggccggccgccggagtgcgggaaccggccgaaggccacgaggtcccggaccgtgaggcgcatggtgaggtggttctcctgccgcaggatggccatggtccgggcgagttcccggctgtccgtggcggcgacatccagtccggcaacggagacggaaccggactcaaggggctggagcctgctgatgagcgagagcagcgtggatttcccggccccgttggggccgatgatggaagtgatgccgccggcggggatgacgcagctgacgccgtccaggacggcttggctgccgtagctcttggagacgttccggacgtcgatcatggccggacacccccggccacggtgtcaggagttgggcgggtcatttcagggagcctttcaaaaggaggtagaggaacaggatgccgcccgcgaactcgatgaccacgctgagggcggtgctgaagccgaagacctgctccagcagcagctgcccgcccaccagggccacagcgccgatcagcaccacgatgggcagcagccaggcatggctgaacccgcggcacagctggtagcccaggctcaccaccagcaggccgaagaacgtaacgggccccaccagcgcggtggacacggccacaagcagcgagcatcccagcagcacgcgcatcaccaccttccggtggtccacgcccacgttgatggctacgtcccgccccagcgccagcacgtccagggtgtgccgtgcccgccacaccacagcacagacagccgcaacgatcaccgccgagacacccagcagtgccggatccacgttgttgaagctcgcgaagaacaggtcctggaggatgatgaactcgctgggttccatgagccgctgcagcagggaggacaggccgcggaagaggctcccgaggaccacccccaccagcaggagcaggtgcagcgacctggtagcccccgtgaacatccagcggtacagcagcgcgctgaacgccaccatcagcagcacttcgacgccgaactgcagcgtgggcggggcggccaccactgcggcggccccgagggtgaatgccagcaccgtctgcaccaggatgtacagcgaatcaaaacccatgatggacggcgtcaggatgcggttggcggtaacggtctggaacaggagcgtggagacgcccacggcaacggccaccagcagcatggcggccaccttgatggcgcggcgcggcaggatgtagcccacgctgcccttaaggtcgaagaacaggaagaagcagacgacgccggcagtcgccgcgagcaggatgcccgccaccagctgtggcggggcgttgcggaaggcggcttggagcttccggggcagcgcggccggccgttggcggacgggcggtgccttcaccggcggccgcagtgttgtgctgtcaggcattgcgtttcctcaggatcaggacgaggaacaggacagcacccagcacggacatcaccatgcccaccgggacctcgtaggggtagcggatggtgcggccgatgatgtcgcagaccagcacgaacgcggcaccgaacagggccgtccagggaacggcacggcggaggttgtcgccaaagatgagggacacgatgttgggcaccacgagtcccaggaagggtaccgcccccacggtggtgaccaccacggcggagatcagcgagacaacgatgagtcccagccgcatggtccggccatagttcaggcccaggttggtggtgaagtcctgccccatcccggccacggtgaaacggtccgcggccagcagccccagcagcatcaggagggcaacgatccacagcagctcgtaccggccccggaggacgccggaaaagtcgccgatcatccagttgctcagggtctgcagcaggtcatagcggtaggcaaagaaggtggtgacggcggcaatgaccccgcccagcatgatgcccaccagcggaatgagcagggtgttgcgtgccggcaggcgccgcaggatggccaggaacagcgcagtccccagcagtgcaaagacgcttgccaccagcatcttggccagcaccggcgcctgcggtgcgaagacggtgaccaccaggatccccagggtggccgattcgacagtccccacggtggacggctctacaaagcggttacgggccatgagctgcatgatcagcccggcgacggccaccgccatcccggcgaggagcaccgcaagcgtcctgggtacacgggagatccagaagacgtcagccgtcgcgggatcgccggataaaaggcccgggaaggagacgtcgctgacgcccacgaacatgctggtggccgcgagggcaaggacggcagctgcggccgcagccaggcctgcgctgtggcgggcccggctgcggcttgccggcgcaagggggcgcacggcggtggcggtcatgggtttggggcttaggtggcggcgttacgcgacggactcggcaacggcatccaccattgcttcgacgttgttgaggccgtagcccacgatgtaccagccggccgggtcaaggttgatgaccttgttgttcttggcggcattggtcgacttcacgagttcgttgtccaggatggggttggcggcggagtcttcggcgcccaccgcggtgtcgcggttaatgacatacaggatgtccgggttgacctgcttgatgtactcgaaggacacagcctcgccgtggctgccctcaaccttgacgtcggccgcagtggggacgcccaggacgtcgtggatgatgccgaacctggagcctgcaccgtaggcggtgacctcgccgccggatgtcaggacaatgagccccttgccggctccggctgctttggttttggtgtcttcgatggtggcgtccacggccgcgagcctctcctccacctcggctgacttgccgaagatggttcccagtgttgccgcctgctccttgaagctctccatcggcccggcggcatcaatggacaggtcgatggtgggggcgatcttgctcagttcctcgtaggcgccggcggtccggccggagatgatgatgaggtctggatcgccggcgctgacggcttcgaaatcgggttccttcagggagccaatcttggtgtacttctcgtcggcgtacttgctgagcgcgtccgggtaggccgcttccggtacaccggcaggttcaacgcccagcgcgttcagggtgtccaggacgccgaggtcgaacgtgaagaccttctccgggttgaccggaacgttggccgtgatgccttgggcgtgctccacggtgatggcagctgcttcgtcagcgggcgtcgccgtcgcgctcccgccgcacgcggtgacggtcaggattgccgctcccgccgcaagtgctcccacgtagctcgacagcctcttcttcactttttctccgctcgggtaatacgtcacaacttcgttggctaatagcccagagcctataagtaagggaaggctaacttcaaagcgggaggggcagtattccgccacaagtgggggacatcacaacgcacgacgccggcactcgggtgagtgccggcgtcgtgattgcaggagggttggggaaaaagccgcatcaactgcgggagcgttgccgaaaatcccgcatcaactgcgagagggtttaggccggggccttggctgcctccgcctgccgctcctccaccagagttgcaaccgcgttgaacagcgggtggtcaggctccagtccggtgatgcgggcggtggcgtccgccgggctggaggaggccaggacgccggccagctccgttgcttcggcgtcggccgggtcggtgaagcgcagggccgcggcaatggcgcccaggagcgcctccggcacaatgccccgctccgccagctcggcggccgggccgataaaccgctcatgccggctcagcttccgcaggggcgcgcggcccacccggttcaccgtgtcaggcaggtacgggttggagaaccggaccaggatcttctggacataggcctcctgctcgtcattgctgaaaccgtgcttggagaccagcagctgcttggtctcctccagcaccgcccggacgtcctcagccacgtcctggtctgccatggcctcggagatcttctccaggcccgcctcgaatccgaagtaggccgcagacgcatggccggtattcaccgtgaacagcttccgttcaatgtacggcgagaggtcgtcaacgaaggtggcacccgagatagccggtaccgcccccgcaaaggcggtgcggtcgatgacccattcatagaacgtctccacggtgacgtccaggccctgcccgggctcctggttgggaacgatccggtccacggctgtgttggcgaacacagccttcccgtccaacgcgctggcggcagcccccggctgggaggccacctccttggccaggatgtccgtggcattgatggcgttctcgcaggccatgacctgcagcggggccaggcccgcgtccctcgccgcgatgcccttggcgatggcaggggccacgaacttcaggatgtgggggcccacagcggtggtgacgatgtccgccgtcgcaatctccgcgatcagttccgcttcctgggtggtggagttcagcgcccggaagttgttgaccgtccgcactgcagggttctcccccacctcgtgaacggagtagctgtccgccgctgccagctgggcgatgaggtcctccgccacgtcggcgaacactacctcgtacccggcgtcgtgcaggagcaggcccacaaagccacggccgatgttcccggccccgaaatgaacagctttcactatgcattgacctttccgaagagttccaggacttcatccaccgaggtggccgcctcgagccgggcaacctgctccttgctggtgaagactttcgcgatggaggacaggatgtgcaggtgctcgttgttgacccctgccacacccaccacgaacttgacctgcttgccgttccagtcgatgccctgggggtagcggatcacggacaccgcggacttgcggatgtggtccttggcggcgttggtgccgtgggggatggccaggaagctgcccatgtaggtggacacggattcctcgcgctcgtgcatggcggcaatgtagccctcgtccacggcgccgcgcgccagcagcagcctgccggcctcgtcgatcgcggcgtcgcgggttgtggctgagccgtccagcaccacgctttcacgcgccaggatctccggcgtgccggcagcggcaggacccgagtccgcgggggcggaggcagcgtgggcgccgtggctggcggcggcagccccggcccccgctgcggctgccgttcccgggccagcggcggatgcgccgccgggcgttc

SEQ ID NO: 22 - DNA, 190047 bp, Arthrobacter sp. OY3WO11
cgggcgttcccgcgccggcgtccggaccttccgctgccacggcaccctcggtgttgctctcccgcaccagttccacgatttcgtcgtagcgggggctgctcatgaagttgtcaacggagtagtggacggcactggacgtggcgggcttggcccgttccgtcaggtcctggtgggtgatgacgacgtcgtagtcgtcgcgaaggttggcgatggccgcgttggtgaccttgacctccgggaagccggcagcctttatcttgttgcgcagcaccgaggcgcccatggcactggagcccatgccggcgtcgcacgcgaacacgatgttgcggaccggtccggccaggacggccacaccacccccagccgcgcccgcacctgcacctgcacctgcacctgtcagggtggaggagacggagctcttcttgcccttcatctgctccatcttggaagtggcagcattcaggtcgccctcatcgctgtgcttcgtggtcttcatgatgatggaagccaccaggaaggaggcggccgtggccagcagaaccgcgagaatcactccgaggtaactgtcccgggaggtctgggcgagcacggcgaaaatagaacctggggcggccggcgctaccaggcccgagttggtgatggccagggtggcgatgcccgtcatgccgccggcgatggctgcaaggatcagcagcggacgcatcagcacatacgggaagtagatctcgtggatgccgcccaggaagtggatgatggcagcaccgggggcggacgccttggctgcgccgcggccaaagaacatgtaggcaagcaggatgcccaggccggggcccgggtttgcctcaagcaggaacaggatggacttgccctgctccaatgactgctggacgcccaagggggtgagcacgccgtggttgatggcgttattcaggaagagcaccttggccggctcgatgaagatgctggtgagcggcagcaggccgttgtccaccaggaactggaccaccctgccggcgccctcgctgaacgccgtcaccaccggggcaatgccgtagaaaccgagcagtgcaagcagtgctccccagatgcccgccgaaaagttgttgatgagcatctcgaacccgggccggatcttgccgtcccagatggagtcgatcttcttcatggtccagccgccgagcgggcccatgatcatggcgccgatgaacatcgggatgccggcacccacaatcacgcccatggtgccgatggcgcctacaacaccaccccggacgtcatagaccatcctgccgccggtgtaggcgatcaggagcggcaggaggtaggtgatcattggtcccaccaggccggtgtttgctacgccgtccgtctcgccgaagccgcccagctgcggaacgggcagccagcccttctcgataaacagcgcggtaatgaggccccacgcaataaaagcgccgatattgggcatgatcatgccggacaggaacgtcccgaacttttggacatgcacgcgcgcgctggtgcggggttttgcaactgtctctgttgccatgtgatttcctaaccgtcattcctgcggcttcgcaggatggtccgatatttacgacgacgtactgccgggcttgtgccttttcagccggccgggctggtggagatgcggtgaagccattcgaggaaaagcttgagttccgagcttgagagctggtcagagtgcgaggcctgaagtgcggcattcagggcgatcgctgccaccaccaccgaggatttcccggctccgcccggggccgcgccgctggcgggctcggcggacaccgcaaagatcatggcgtcccgggtcatggtggacaattcgaggttccggtcggaggcgggctccgcaatcagcatcagcgtcacgcccacgttggccgccaggatggacctggccgcttcccggggctggacgttcaactggcccgccaccgctgccttgttcagcatctcctccatgagcgcctcggcatctgcaacgattgccgggcggctttccgggcggatattgccgaacatcaccaagtacagctccggctgcttcagcccgaactggacgtggttgtcccacattctccggatatcctcgatcggctgcccggagggggcgaaatccctttcgcccgcaacatactcttcaaaccctgcggcgacgacggcgtcgaacagaccttccttgtcaccgaagtggtggtacagcgtgggggcagtgacccccgccagctgggtgatctggcgggtggagacgggagctcccccggagtttgccagcagctccgcggcagcacgaagcagcctcattttggggggaagctggccatccaaactcataaccgctaccctaacacctatagcattgctatatgaactgaatcacatacaatttttttcaggcacgtttcacgcctccggacgcagcagtcttccggcggaccggcatggcgccggacatatcgggcgggcctggcaaccggcagagaatgaggaccttcagtgcagaacttcccaggagtaggcgtcagcccaggccgcgtcatcggcaccgtccggcagatgcccaaacccatcagcgaacctcctgccggcgagcagctggcgccagggaccaccgccgaggaagcaaccgcagcgctgaaggcagcctcccaggcggtgcacgatgaactgaaggcccgcgccgcccatgccaccggagacggcaaggcagtcctggaagccaccgcgctgatggccaaggacaccatgctcatcaagggcgcggccaagcttgtggcgcggggaatgtccggcgagcgcgccatctgggagtccggctcttcggtgtccgagatgctccacaacctgggcggctacatggcagaacgcgccacggatgtcctggacgtccgcgcccggatcgtcgccgaactgcggggcgtgcccgcccccggcatcccttcgtcaagcaccccgttcgtcctggtggccgaggaccttgccccggccgacaccgccaccctggaccccaacaaggtcctggcactggtcacggccggcggaggcccgcagtcccacaccgccatcatcgcccggtccctgggccttcccgccgttgttgccgccgtcggcgtggatgaactcccggacggtaccgacgtgtatgtggacggcgccgccggcaacatcacctcagaacccgacgaatccctgcgcgcagcagcggaggcgtgggctgccaccgcgtccctgctggccgagttcagcggaacgggcgcgacggcggacggccacctggtgccgctgcttgccaatgtgggcgggggcaaggatgccgaggcggccgccaagctgggcgcccagggcgtgggcctgttccgcaccgagttctgcttccttgagcgggacaccgagcccagcgtcgaagagcaggccgcagcctataagagtgtctttgatgctttcccgggcaagaaagtggtcctgcgaacgctcgatgccggcgcggacaagccgcttccgttcctgactgactccaccgagcccaatccggcccttggcgtccgcggctaccgcaccgacttcaccaccccgggagtccttgaccgccagttggaagcaatcgcgctggcagagaaggattccgaggccgatgtctgggtcatggcgcccatgatctccaccgcagaagaggccgcacgctttgcctccatgtgtgcagacgccggcatcaaaacgcccggcgtgatggtggaggttccgtccgcagccctcacggcggaagcgattctccgcgaagtcggcttcgcaagcctcggcaccaacgacctcacccagtacgccatggccgcggaccgccagctcggcccgctcgccaacctcaacaccccgtggcagcctgctgtcctgcgcctggtggggctgacggtggaaggatcacgtgcggaagggaacaacaaacccgtgggcgtctgtggcgaggcagctgccgaccccgccctcgccgtcgtcctgaccggcctgggcgtcagcaccctctccatgacggcccgctccctggctgccgtggccgcggtactgaagaccgtcacgcttgaggaagcgcagcagctggccaagctggcactgtccgctcccagcgccacggaagcgcgggcgtgggttcgggagaagctgcccgtcctggacgaactcggactctagggcgcggtccggctgcgcggcgtcgcccgtcctaggcggtgacgccgaagccgtccagggcgcggacccagccgctgatggcctcggccgacgcgcccggggcggtgtgctgcaggacgtggccctccccggggatttcggccatggtgccctgccgggcgactgcggtgaggtgttcgcaccaggggcggcgcgcgatggggtccctggcgccgcgaaggaccaggacaggttggctgaccgcggccaccctttcctccatgggatagtccatcatcacgggcagctcggtcaggtaccagcgcgggccggccctgaagtaatcgctgaacacgagggcattcgaggtaaggctctccccgaacagggcatcgcgcgtgagtgccgccgcctgcctggtgactgtcttcctgggcgaatccaccacgggtcccatcagcacggcgccagtcacccggccgggttcccggagcgcgagttccaccgcggactgcgtccccatggagtggcccaccactacatagctggaaactccggcctcagccaggacagcgcccacgaaggccgcaaagtcaccgatctgcagctggcgcgggggccttgcagcttttccgaaacccgggaggtcgaaggtgtagacgtccgcttccctggccagttcgagatgcagccgggcgaggtaccggtgggacacgccgatgccgtgcagcaggacgtaggcgggcctgggcgggtcgcctgcgggccttaccgaggcgtacagcttgccccggagcccgcccgcctcgacgtcccggccgccactgagttccatcagccgagcataccgtccggcgcagggtggccgccggtaggctgggcgcatggcactgatagctccccgaatcgctgacgcactcccgtcggaggacgctgagaagctgggccgcgcactcgcgggcagcgatgacatcaccgtcttcgtggacggcacggtccaccggttgccgccccaggcgagggacgccgtcgtcgatctcctgcaccggttcagccgcggtgacgcggtgacggtcagcagcgtggaggatatgctcaccacgtccaaggccgcggaacttgccggcatctcgcacacctacctgcgcaacatgacggaccgcggtgagatccccgtggagtaccgcggcacgcaccggcggatcccgcgggccgccatcatggcctggctggagaggcagaaaaaagccgagcttcgcgaggcggggacggattccggggccggcgcctagatcctgggcctggctgcccagcggcgcatcttcagcgcggcgtgcagctccaaccggggcatccccttgagcggatccacgccgagcagctgccggatccggcccagcctgttgtagatgctgctgcggtgcaggtgcagcttggtggccacatcctggacggagccgtcattgtcgtagaggagttccaggaccggcaaaagctccccgttgcggtcgtggtcctcgagcatgcggaagtagaccgaacccgagtcagcccaggcgctggcgccgccccctgcggatgcgaggagctggtagacgccggcggcccggcagtcaacgagttcgccgagttgcgggtccacggctgcggcctgggccgccactttcgattgccggtacgccgcggcgagctcccgcggacggccaaagccctcactgaggcccaggatgatccggtggaccggacggccggagcgcttggcgagttccagctggtaatgcaccaggacctgcgcgtggttcgccctgccggataactcgcggaacaggacaaccgagtgcgtctccgtgccggcgctgaacaaggcggagtccacgccaatggttgcctgcagcgcggccgaccggtggatcagggtggacgcgatagggtccgggcccccggaccagccgtcagcgtcaagcactgtgaccacctgccaggggccgcggccctggacttccttccagcccgcgacggcggccaccgcgttgggttcgccggcgcaggcggccaggaactcccgctcacgcccgcgccggaactccgattccgcggtgttcgagtcgagcaggagccctgacagcatctcgagctcgtggttgacggccggcagctgggtgaggatcgccgtcggactttcatctgccgagtcctgctgcacccacaggtatcccacccggaaaccgcgcaccatcagcggaacacagacgcggcccagcatgcccaggtcctggttggcgggaaccaccacgggccgcaccgccgtggcgatgccatgcgagagctgccaggcgctcacatccgccgggacttttttgctcagcaggaagttcacccggacccggtctgcgtgggactggttggagctgtaggcaagcagcacaccgtccaggtcctcgagcgacaggccacggcccagcttctgcgccacctgctcaaccagttgttccacaccctgcagctgcatgcgccaacactactgcccggaaggccccctgaacgaacggacatgaggcgacacctgccgccctgcggctcgacaaacgtcgagctggaaccagtgggatccgcggaatggcgcggatctgattccgaggccgccttgctttcatgtcagctggctcacaaccggatttatcgttgatacacgaaatccttccgcactttccggctgaccaggccgagaatatggagcccacgatgatcatcggcgtccccaaagaaatcaagaacaacgagttccgggtggccatcaccgccgccggtgtccacgagttccgcagcaacggccacaccgtgctggtagagcgcggcgcggggctgggctccggcatcaccgatgaggaatactccatcgccggcgccgagatcgtcaacgaggcggacgacgtctgggcacgcgcggacatggtcatgaaggtcaaggagccggtcaaggccgagtaccaccgcttccgcaagggcctgatccttttcacctacctccaccttgcggccgagccagaactcacccgcgagctcatcaactccggcgtcaccgccatcgcctacgaaaccgtccaggagggccgcacccttccgctgctcgcccccatgtccgaagttgcgggccggctttccgtgcaggtgggcgcatcctcgctcatggcccctgcaggcgggaagggcgtgctgctgggcggcgttcccggcgtccgcccggccaaggtagtggtgctcggtgccggcgtggcaggcaccaacgccgccgccatggccctgggcctcggcgccgacgtcaccatcctggacatcaacatcaaccggctgcgcgaactggacgcccagtaccagggccggctcaagacagtggcatccaacaagtacgagatcgaaaagtccgtggtggacgcggacctggtcatcggctccgtcctgatccccggcgccaaggcccccaagctggtcaccaacgacctcgtggcccggatgaagcccggctcagtcctggtggacatcgccgtggaccagggcggctgcttcgaggacacccaccccaccacccaccaggaacccacgtacaaggtgcacaacaccatcttctactgcgtggccaacatgcccggcgcggtgccgaacacctccacctacgcgctgaccaacgtcaccctgcggcacgcggtagccctcgccaacctgggcgtcagggctgccttcgaccgcgaccccgccctcgcagccggcctcaacatcgccgccggccacgtggcgcaccactccgtgtccgaggcgcacaacctgcccctcgtagcggactggcacgaactggtttcggcgtaatccggactccggccgcaacggcgcccatccccgcgtgctgctccttcgtcgctctgacgcacgcttccggatggcctccgttgcggccgtttaacgaaccatcgaagccagttcccgtgcttgttctattaacttgagggactcgacggcgtcctgtgggtttactgggaggggcagggctgatgctgcgccgccgtcgaggattttgtctgccagttgccggtagaactccgggtaggcgccgcgctcggtgggcagggcatccaggtggccgtcgcgccccaggagcccagcccactcgggtgcctcctggccgtactccgcgtcaagggggctgccgcccgcggcgatatacggctcctgcgggtccaccccgttcttagtgaagccgccgacggaacccagcacgcggaaccgcgggccctgctgtgcgcaaagcatgttcatggtgaggtggctgatgaccccggactcatgccgcaaaaccaggaacacgtcgtcatctgcacgctcgtcggaccggcgtgccttcagttcggcgtggatcactgcggccgggccgaagagctggagggcctggtcgatcaggtggctgccgaggtcgaacagcgttccaccgccgtcggacgccgtggcgtgggccttccaggccttggagatggcgggtgaccaccgctcgaagcgcgattcgaaccgggtcacctttccgagggcatcggccgccaagagtttctgcagcgtcaggaagtcgccgtcccagcgccggttttggaagaccgtcaatacacggcccagttgttgggccagtgtgatgagttcccgtccctgcccgctggtcacggcaaagggcttgtccaccaccacatccaggcccgcctccagtgctgccttggccagagggtaatgggtggcgggcggggtgcccagcaccaccaggtccacatcatcggcgtgttcaaggactgcctgaccatccggcacggtcttcacatcctggtactgcgcggccgccgcggcctccctcccggcattggacgtagcgatcatgctgagcgagtagcgcgggtccgctgctatcaggggcgcgtggaacacgctcccggacagcccgaaacccacgacggcggtgcggatggtgcgtgctgaagcttcagtcccggtcatagtggctaggctactcccccacatccggtgaaagatggttacggaaaatcacacctcaagtgagagagcgtcctggaaaatgccgcaccatgtgggagggcgtgtgggacggcgaaggccggcaggccctggatgttccagaagctgccggccctgccacgctgctgctattcagttgtgccccgcgggggcaggagggttacttcttttcccagccgagggcggtccagtccggaacctgggacaggctgcggaacagggacgggccgtagttggccagtccggtgcggacgaaggagatctgcgggccgttcatgaccacgcccatggagaagtacttcgccatgtgctccttctccacttccatggccgccttgttgcgctcggcgttgtcctcgatggacgccaggtcggcgatcttcttgtccagttcggcgtcgcccagctggttctcgttggtcttggagtcgtagtactgcttgacggcttccgttgcgtccgcacccacggtgtagccggagacgctcatgtcgaactcacgtgcaccgaggaccttgccgaagtcggccgaggcgcgctggtcaatgcctacctccatgccgccggcctggagctgctgctgcagggtctgggtgaaggcgagggtggtgggatcgtcaccgaagttgctgatcttgaaggctgcgggcttgccgtccttctccatgatgccgttcgcgttctcggtgtagccggcgtccgtcagcaccttcttggcggcctccggaccggtttccttcacggggtagttgtcctggtagtactcggagaacggcaggagcatcatggaaccggagctgggctcttcccagttcaggccgttgaagcgcaccttgcggagggcttcacggtcaaccgcggcgaagatggcctcgcggacggcaacatcggtgatgcgctgggcgttgaggttcatgccgccggcgaacaggcgctggccgcggcggacctctgagttgttggtgccctcaagctgcttgtacagggagatggtgttggcggacatggcgtcgatctcgccgttcttgaaggcagcgatctgggcgctggtctccagctgacggaatacgacgctctccagcaccggcttgttgccccaccacttctcgttgggaaccagggataccgtcttggcggcagtgtcgtactggtccagcttgaagggcccggccatccattcggggtgcatgtcgccgttgaacccctcgttgaaaatttcaggagagttgacggcggggtggatgaggcccgtgaagagggagtccagcgggtagaccggctgggtcgtcttgaccactacttccttgtcgttgctgccggcttccaccgattcaacgaactcgtagttgccggagctgacgatgtcgtagcctgcatccgggctcttgaggatgttccaggtgttctggaaggccttgacgtcgatcggggtgccgtcgttgtaggtggccttctcgttgaccttgatggtgatggtctgcttgccgtcctgcacttcgttttccacagactcgcagaagtccttgttcggggtcacttcgccgtcgaacgcaatgtcccagcagccccaggttcccgcctggtcgatgggacggtgcagcgcggtgttgtctgcgctgttgccgttgttggagaagccattgaagtccggcccgatgttgcccagcggaagggtgaccttgccgccctgttcaagatcggctgccggcttctcgttgatgctgatgagcttggacaggtcgctgcctgcctcctgtcccttggccgtttcggggccagtggacccgccaccgccgccgcaggccgtcagcgccagagccgcggtgatggccgccgctccgccgatcctgttcagattcctcatggtgttcccttcgttggtgcgagtggtggtgcttgtgatgggtcgaagaaatctagggcgcatggtggtccgccgattcgtggactaccagcatgtcctcgtccagttctccgtcagggaagaagcaggcgaagcgttggtccagggcgggcagtggatccgccgccagggtttgggccgccggggagggtgctacatgttccagcggcggttccagggtcaggcacttttcctgcttggctgccggcaacgctgcaaagacagggcagcgggtggcgaagttgcaacccttgggggtgcccagtggagacggcaggtcgccctggaggatgatgcgttcccgggtgcgctccaggtgagggtccggcacggggatggcggagagcagggcgcgggtgtaggggtggcgggggttgtcgaacacccggtccacttcgccgatttccacgattttccccaggtacatcaccgccacccggttggagatgtgccggaccactgaaagatcgtgcgccaccagcaggtagctgaggcccagctcggcccggagcttgtccaggaggttgatgacgccggcctgcacggagacatccagggccgagacaggctcatccagcactacaagcttcggattcacggccagtgcgcgggctatgccgatgcgctggcgctgcccgccggagaactggttggggaagcggttcacgtggtcaggctgcaggcccaccagcttcatcagttccatgatgcgctttttggtgtcggccttgttcatgcccgcgttctccagcggttcggcaaggacttcatacacggtgaaccggggatcgagcgcgccggtcggatcctggaacaccatctggagctcccggcgcatcgcgctcctggtcttgccatcggcggcctgcttgttgctgatcccgccgatcaccacctcgccgtcctggtccttgtggaactccatgatttccagcagggtggtggtcttgcctgatcccgactcgcccacgatggaaaagcattccccttcgcggatatcgaagctcagcccgtccacggctttgacggtgccgatgcggcgcttcagcagtgcgcccttgttgagcgggaagtgcttgcggacatccttcagctggaggacggtggagcgctcctcccgcgggatagcatcgaagcgggataccggcaccggcggagcggcgaagacgtcatggacatcaacgtcgccgcccagcgaaccggatttgatgcaggcggcgcggtgggcggccggccccgcaaccggcgccagcgccggttcaccctccaggcacgcgtccgaggcgagcgggcaacggggggcgaaggagcagccggtgggcgtgtggatcaggttcggcggcataccctcgatgggaaccaaggacgacttctccgctacgtcaacgcgcggaacggcgccgagcaggcccatggtgtacggcatccgcgggttgtaatatatgtcatccaccgccccggtctccaccggcctgcccgcgtacatcaccatgatgtcgtccgccatgcccgccacaacgccgaggtcgtgcgtgatcatcacgacggcggctccggtctcctcctgcgccgtatggagcacctccagcacctgcgcctggatggtgacgtccagcgccgtcgtcggctcatctgcgatgaggacccgcgggttgttggcgatggcaatggcaatcatcacgcgctgtcgcatgccgccggagaactcgtgcgggaaagccctgagccgttccttggggctggggatgcccaccatggcgagaagttggacggcgcgggcttctttcgcctgcttgctcatggtggggttgtggatggtcagcgcttcgatgatctggttgcccacggtgtagaccggcgtcagcgaggacagcgggtcctggaagaccatggccagctcattgccgcggtactcgcacatggccttgtcgctgagtcccagcagttccttgcccttgagccgtacggagccggagacctccgccgtggtgggcaggaggcccatgatggcaagggacgtgaccgatttgccggagcctgattcgcccacgatgccgagtgtttttccgggcataaggtcaaagtcgacaccccggactgcatgaaccacaccgttttcggtgttgaagcgtacgttcaggtcccggacggacaggattgcgtccgccggggcgtgaaggtcggcgacgtgcaggcgctccactgctggctggggctgttcaaccggtccggcggcaatttcgctgctcatgaggcgttccccttaacacgggctttcagggcggtgcgctttttggcgctgccggaggagctggagcttggatcgaaggcgtcgcgcagtccgtcgttcatcatggccagtgagccggtgagcaggaacataacagtcaacggcacccagaacatccaggggaaggtctgcacctgggatgtggctccgccgatcagcacgccgaggctcacatccggaaccttgataccgatgccgatgaaggagaaggcgacttccgcgaggatggcaccggtgactccacgggtgatgtccaggaccaggagcgacccgatgttgggcacgaggtggcgccacacgatcctgcgcgccgggacacccatgtactgggcggccttgacgaagtcccgctgcatcagggacatggagagggaccggatgagccttgctgttcccatccagctgaagacgagcagcacaatgatcagcagcagccaggacggcaggtcccgcctgagtccttcgcctccgccgctggtggccacagccaccaccaggagggccggcatcatgatgagcgcttcgaggatgaagagcatcaccttgtccaccttgccgccgaagtaggccatggtgcacccgtagacggcggcgacgaggactgacaccagcccgacgatcagtccgatcaggatggagatccgggtgccttccaccgtcattgcgtagaggtcgattccggcctgggaggtgcccaggtagtgttcggccgacggcggcatgccgatgttgaagggatcgatggtttgcttgtcccactgggtgaagtacccgcccacgaaggagaaaacggtcagggtgaggaagatggcaagccctgccacggctgtcttgttccgcatgaagcggcggaagatgatggtgttcttaccgatgacgacgtcggcgctctccaggtgggcgtcctgcgcgacggcggcggggtctactgcgttgaggttggtcacggttactgcacccgcactctcgggtcaacaacggtggtggcgaaatccgccagaatggctcccagggcgaagatgacggaaccgtaggccagcgtggccgtggcggcgttgacgtcctggagtgagatggcgtcgatactccacgaacccaccccgggccaggcgaagattttctccgcgaagaagccgccggcaaagattgccgggatggtgaaggcgatgctctgggccaccggaatgaatgagacccgcagcgcatggcgggagatcgcctggttgcgggtgagccccttggcgcgggcagtccggacaaagtcggcgttgacgttgtccaggaggtactggcgctgggcaatctggtaggacccccagcccaccagcgtgatggcaaccgtggggacggcgtagtgcgccagcatgtcgatgaactgggcccagcccggttccatccccggggtggagataccggtgacaaagaagatgcgttcgcccacggtctcgttgatgttgatggcacccaactgcaccaggaagtatgcaataggggctggcacgatgtacgcaaggtagctgtacgaggtgatgacgcggtcctggaacttgtactgccgggcggcggaatagacgccgagggcaactccgatcaccagggtcaggatgatggaagccaggaaaaggcgggtggagatccagacgcggtccccgaactccgcgttgatgtaggcgccgttggggctgcggccccagtcccagcgcgtgaggatcgcagtaagccattcgacatagcgttcccaggggctgagatcagggtccaggcccttcaggcgcatcgagtttgccacctgctccggggtgggacggggaatccgttcctgttccagcagcgcgggcttgagggaactgaccgcaaggaaatatcccgctgacgttgtcaggaagatcatgaagacgtacgtgatgccgcgcttggcgaggtacctgagcatgcgggagctacttctggatcatcgccgccggcagctggacggtcagacaccgcgtcatccgcaggcgggccaggctgttgggcaaatcaacaatcacgtgctggatccttccgttttccccggatcagcggggggttgcgccgcctaaccgggtccttgccagcgggtagctggcgtcccgcagcctttcaggcttagtccttgtggactatgtcgcgggtcacattccagaggaaactatcacaagccggaaccgaaaatgcgggccaatgccccgaaagttacccgcccgtatcagatcgttatgaatagttctgtgaagttggtgtgactggacacacattcggcctgtggcctactctacgcgccgcggaccactcgtgtgacaagatcccgccaggaagcggtaagcctgtcaggcgagatcccgtggactttgacaaggcttagcagccgctccggatcgagggtggccgccagggacccggccatcagccaggggtcaggcccaaagccttcttcccgcaggaggatctcgatatggcggtgccacaggacggcggcgggggcttcaaaacgccggcgcgaggcatgctcggcggccagcaccaggtccccgaactccatgacgtaggagatccgctccaccccgaaggcgatgaggcgttccagcccggacgcgccggggcccagcggtggcggcccgaacatgaaccgggactggaagtcggcctcggactcgctcagcagcgtcagcatcagccctgcccggctgccgaaccggcggaagaccgtgcccttgcccaccccggcatgctcggccagccggtccatggtcaggccctccgccccgcagtcagcgattagctcccgggcagccgcaagcaggcgctcccggttccgtgcggcgtcccggcgttccgcagccgcccccgccggcaggccgggccgcggtgggatggaactcacatccgacattccagacctcgggaataataagcggaccgcagtccgtttagatgggtgaaggcactgacaagcctcagcttagaccggcccgcgaccctcccgcggacccagaccccaggagttcccatgactaagagcaccgtcctcaccctcgtcggcagcctccgcgccgagtccaccaaccagaagctggccgaagccatccagctgaacgcaccggaacaggttgacgtggtgatccacgggaacctgggcaacatcccgttctacaacgaggacatcgacgtcgaaggccaggtacccgaggcagcggcagccctgcgtgccgcggcgaatgcggcagacacgctgctgctcgtcactcctgagcacaacggaaccgtgcctgccgcactgaagaacgccatcgactggctgtcccgccccttcggtgccggcgccctcgcaggcaagcccaccgccgtcgtcggcaccgcgttcggccagtacggcggggtctgggcccaggacgaggcccgcaaggcagcaggcatcgccggcgcgcggatcctcgaggacgtcaagctcgccgtgccgggatccatggtccgcttcgctgaggtccacccgaaagacgacgcagacgtggtagagcagatcaagggcgtgttcgacgcactcaccgcttcccagcccgcggcctaaccaaggtctcaggtacccggcgccgccaatgcgccgggtaccgctttttaagcccgaccggccagctgatccagccgtccggccgcaccagcgcggctctggctgccgcacccgatcgttgctaccgtgaccgcatgagtccgtcaaagaccccggccgagatcctcaccatcgccgggaccgaggtccgcatctcaagtccggacaaggtgctgttccccgaacccgggctgacgaagctcgacctggtggagtactacctggccgtagccgacggtgcactccgcggcgccgcgggccggccgatggtcctcaagcgcttccccaagggcattgatgcggagccgtttttccagaaacgcgtgcccgaaaaccacccggacttcatcgacaccgccaccctgcactacgcgtcagggacgtcagcggaggaagccgtcatccgggacgccgccggcctggcttgggtggtgaacctcggctgcctcgacctgaacccccaccccgtgcgcgcagaggacctggaacaccccgacgaactccgggtggaccttgatccgatgccgggcgtggactggtcccggatcgtggacgccgcccttgtggcgcgggacgtgctcgacgacgtcggcctggtggggtggccgaagaccagcggctcgcgcgggcttcacatcctggtgcggatcgcgccgcaatggacctaccgggaggtccggctcgccgccgaaacccttgcccgcgaggtggagaaccgcgcgcccggccttgccaccgcacggtggtggaaggaggagcgcggcgagagcgtgttcgtggacttcaaccagaacgcaaaggaccgcaccgtggcatccgcgtactcagtgcggccactgcccgacgccagggtttccacccccctgacctgggacgaggtccggaccgccatgccggaccagttcacggtgctcacggtgccccggcgcttcgcggacatgggcgacccgcacgccggcattgatgacgcggcgggcaccctggatggactcctggcactggcagcagagctcggtcccgccgaaaagccaccgcgcagcggtgacagctccggccgccggcagtccgtgatgccgctcatcgaagttgcccggaccaggacaaaacccgaagcgcaggccgccctcaacgaatggaaatcccggcacgcggacctagtcccggccctgcatccggccgatgtgctggtggacgggatgcgcggatcgagctcgctctggtaccgggtgcgggtgaacctgcagcacgtccccgaggcagagcggccgcctcaggaggaactcattgccgattacgacccctgggcgggcaaggagtggccgggccggccaacgtcctgacagcggggccggctcgggtccggcagccggcgctcccgtgatcaactcttgtcccaaccggtaccgtcccggcattaccgggccgggacgccagccgtaacgttaatccaccaaaccagaacgggattgcggtggaggcatgcgggcaccgagtgcaggaaagcgcagggcagggcttcggacggcagcagcagccagcctggtgcttccgctatggctcggcggctgcgtggcagaggcacccctggagtccacgcccgcaccgtccgctccgcttgccatcagcagaagcacaccggccgctccacagccgcaggatcctgcccgcacggggactgccgctccccctgcccggtccctggaccaggcatcggccggcgtctctgccggggccggcgggccaagcgccccggcaacaggtttctccgcgccaggtaccccggggccgggcaccccggttcccggcagctcagctccgccggaccctggcgacgctgcggtgctgcgggcttccgaccggcctggtcccaccagcagcccggccgcggcgcctacggtgacggcgtactacgtgctcctggacgacggcggcaggaacggtgtgcgttttgggtgcaacgacagcctggtgggcatctcccatgaaacttccgttgccggggaggcccttcctgccgcggtcggtgcactgctggactcaaaaagcagtccggctgcggggacgcacgaaccggagctctacaactccctcgccagttcgcgcctgaagttcctctcgggcagctttgacgggaccacggtcacggtctacctggccggaaccctccgccccggcggagtgtgcgacctcccccgcctggaagcacagctcacgcagacagcagtggccgccgtcggtgccatcagggcggaaatctacgtcaatggccacacgctcgcggaagtactgggactcgattagcgggcgcgggcggaagcgtacagctgtggcgtatatataaacaggtgttgcttttagggcaacacctcgctgtatcctgagggtgtgagccacgaaacactcgacgcggcagcagggacgctgccagcagaagccattgatgccatcgagcgggcggcgacctccgcgcaccgccacgaagaactcttctcggagcgggccgcaaacatccggcagtcggcagtgcgggacgtcttcgacatctccatgcggccgggactcgtctcgctcgccggcggaagcccctacctgcagtccctcccgctggaccgccttgccgccacagccgcgaagatcattgcggaggacggcctcaccgccctgcagtacggcagcgggcaggggtcggcggaactccgcacgcagatctgcgacgtgatggccgcggaaggcatcacggacgctctgccgcagaatgtggtcatcacagccggttcgcagtccgcccaggacgtggccacgaaggtcttctgcaaccccggcgatgtcgtcctggtggaggaccccacgtacgtgggcgcactcaacaccttcgaggcgtaccaggtccaggtggagaccgtggagatggacgccgcaggcctggtgcccgagcagctggaggcacggattgccgcccttcaactggccggcaagaacatcaagttcctgtacaccatccccaacttcaacaacccttcgggaattacgttggcggcggaccggcgccagaagatcgtagatatatgccgcaatgcgaatattctagtggtggaggacaacccctacggactgctccgcttcagcggtgaaccgctggcaccgctgcgggcggcaaacccggacgacgtcatctatatggggtccttctccaagatcttcgccccgggcctccggatcggctgggcgctggtcccggagcacctccagcgccgctactacctggcagccgaagccgtgacgctctgcccgccggccttcaaccaaatgctggtctcggcctatctccgcgactacgactggaaggcccagatcgaaacataccgcgggctgtacgccgagcgctgcagcgcactgctggcagccctggaggaacacatgccggcggggaccacgtggacgcgtccggaaggcggcttcttcgtgtgggtgacgctccccgagggtgtggacacgtatcccctgctgcgcaaggcgattgacgctggcgtcgtgtttatcccgggagccgcgttcacgccgtcggacgagccttccaacaagctgcgcctcgccttcagcgccgtgccgcccgaggccattgccgaaggggtacgccgcctggcgccggtgcttcagcaagccatcgccgcgctgtagccttggcgtgaccagcgccacagaaaccaagcaaaggagcacacatgagcggaatcatcgttgtaggggttgacggcagcgcaactgccaagaaggcagccgaatcggcccgcggcctcgcagcagcccttggcgcctcgctccacgtggtgtcggccttcgacagcgaccgcaccgaggtgttcggcagcggcagcgaccggtggatcgtgtccgacgccgatgcagcggagcatgtggcgcggacggttgcggaatcccttggcagggacataaaggtcacctactccgccgcccgcggcaggccggccgacgccctcatcaaggaagccctgaggatggacgcccggatcatcgtggtggggaaccgcaggatgcacggcatcgggcgcgtgcttggcagcgtcgccaacagcgtggcccacaacgcgccctgcgacgtctacatcgccaacacctacgacgccgaatagcaggattttacggacaccatgcgggggcacgccccgcatggtgtccgttctcacgcccgaaaacgcgttcccggcttcaacccggcgataaaattgaagaagcccccaaaggtgcggacacccagcatccaccaccatcaaggggccccagtgataacactccagcgccgccagcttgccggccacgacatcctcctcgcccgccatggcaatcacatctgctccatgcgcgttgaccgcagcaacgaccgcgtggtggctttactggatgatggcagcgtggacagcgcccccaacctgatcgcaccggggatcaagctccccgagacggtgggcagcgtgctgcgggaggactggaagctcctgacggcctggggcggcatggcagcggccatggctgtcctcatgacaggcgctgccgtggccctgggtaccaccacggatccggccacccttgagatgctgaccgcctacaccgcctactgaggccggctaagccaccatccggccctgcaggatccaccagatcccggccatcaccacgccgccgaacagcgaaccggcgatcacctgggccacagtgtgggcgcgaagcaccaccctggaccagccgacagcgggcaccaggaacaacaacggaagccacgccggccccagcacgagtacgcagatcactgccgcggaggacattgccgctgcgtgcccgctgatcttccagaacgggcttactcccgcgagcaccacaacgcccgccaccacggcgaggaccatcaccaccacactttgcggggcacccgctgcccccagcaccaggagcccggccaggatggaggccagcgccatcagcagcactggggcccgttgccggcggtcgctgacgtggtggtcagtgaccttgccccgcctcaccagcatcagcagcagcaacagcggaagcacgcagacaaacagggccgccagcgcaccgtatcccacggttccgggaaagcccggctgcgtaatgggactgagcagcagctggatgctgaccaccacgggcggctggaatacctccgtcagccaccgcgcggccctgttcttcacctggagggtgctgccgttgattgccagtgtcctgtcctagtcgaggaggagcgcaggctcctccaggatggcggcgacgtcggccatgaagcgggcggacaggtcgccgtccaccacgcggtggtcaaacgatccgcccagggtggtgatccagcgcgggatgacttccccgtcaaggacccacggcttctgcttgatggttccgaaggccacgatggcaacctcgccggggttgatgatgggtgtgccggtgtcgatccctagcgctccgatgttggtgatggtaagcgtgccgccctgcatttcggcgggcttcgtcttgccggaccgggccgtgacggcgaggttgttgagcgccagtgccagttccttcagggaaaggtcctgggcgttcttgatgttgggcaccatcagcccgcgcggtgtggcggccgcgattcccaggttcatgtagtgcttgacctggatctcggcgccgtccgtcccgtcggcgttgtccacccacgtggcattgacgctggggttccgggcggccgcccagatcactgccttggccaggatgagcagcggggaaaccttgatgccctcgaagtcccgtgacgacttgagcctcttgacgaactccatggtgcggctggcgtccacatcaacgaagatgctgacgtgcggtgccgcgaacgcggaatccaccatggcctttgccgtggccttgcggacgcccttgacgggaatgcgctcgatgcgctggtcctggggcttgcccgccttgccccaaaacccgtcagccttgtccagctccgcgtcccgctgggcctggtagctcaccaggtcctcacgggtcacctcgccgcgggatcctgtggccaccacgtccgccaaatcgatgcccaggtcccgggcgatcttgcggacaggaggctttgcgagcacgcggttgaccagcccggtgatggtgccgcccagggtggggcggttgtcgacgtcggctgccggacttattgccgggcccgggtcctgcgtcacttcggccggcgaatggggctggacgggctccacttcaggggcattgggcgacagggcggaggcgggggacgtcttccgcggccggcgtttgacggcgtcggccttggggccggagcccacgaggggcccgccggcaagggcactttccgtggcctgcgcactgtctgctgcgccgccgtcggacgctggaagcttgccgtagaggggctgcgcgggcgcctcaggcgcgcggacatccgccggggtggggtctccggagacgtcgtcgctgacgctgatgatggcagtgccgacgtcgatggtcaccccttccgggaccagcagttcggtgacggtcccggcgaagggcgagggaagttccacgagggatttggccgtttcgatctcgcagaggacgtcattgatggcgacggcgtcgcccggcttgaccttccaggagacgatttccgcctcggtgagcccttcgccgacgtcaggcaggttgaacttgttgagagtcatggtgtcctcggttgggaagcctcagtaggaaagggcgcggtccagcgcctccaggatgcggtcgatgtccggaaggtagtcttcctccaccttggcaaccgggtagggcatgtggaagccgcccacccggatgaccggcgcctcaagcgagtggaaggcccgctcactgatccgggcagcgatctcaccgccgattccgccgaaggtgggagcctcatgggccaccaccagccgcccggttttctgcaccgaggctgtgacggtgtcgaagtccagcggggagatggaccgcaggtcgatcacctccacgctccggccgtcctcctccgcggcgttcgcggccgccagcgcaaccggcaccagtgggccgtacgccacgacggtggcgtccgtcccctcgcggaggacgtgcgccttgaagggatcccctgcccggcccggcgcggccgtgtccacctcacccttgagccaatagcggcgcttgggctcgaaaatgatcaccggatcctggcattccaccgcctgctggaccatccagtacgcgtcatgcgcgttggaaggggtgatgatgcgcagcccggcagtgtgggcgaacagcgcctccggggattcggagtggtgctcaacggaaccgatgccgccgccataggggatgcggataactaccgggacggtgaggttgccgttgctgcgggcgtgcatcttggccagctgcgtggtgatctggttgaagccggggaagacaaatccgtcgaactggatttcgcagaccggccggtagcctcggagcgcaaggccaatggcggttccgatgatccctgattcagccagcggcgtgtccaccacgcggtcaggcccgaactcgccgatcaggccgtccgtgacgcggtagacgccgcccagcggcccaatgtcttcccccatcagcagggactttggattgctggagagtgtttcacgcaggccctcgttgatggccttggcgatggtcatggtggtcatcagtggcctgcctttgctgcgggctgtccggaagattcggccggctggtctccgccttcgaaccctgcagtgtattcctcaaaccatgcgagctcctccgccaccaggggatgcgcttcggcgtaggtgttggcgaaggcggagcggatgtccagggtttcaaggtcatgggtggtgcggcggacgtacgcggcgagttcatcgccgtcggccttcactttggcgaagaacgcgtcgtcggcgaggccttcgttgcgcaggtacttttcaacgcgggccagggggtcctttgcccgccacgcatcttcttcggcggactggcggtacttggtggggtcgtccgcggtggtgtgggcgcccacgcggtaggtgaaggcctcgatcaggaccgggcccttgccctggcgtgcgtgttccagtgcccactcggtgacggcatggacggcgatgacgtcgttgccgtccaccctgatccccgggaagccgtagcctttggcgcggttggacagcggcacgcgggtctggacgttggtggggacggagatggcccagtggttgttctggcagaagaacaccacgggcgcgttgtaggaggaggcgaagaccattgactcgtggacgtcgccctcggagctggccccgtcgccgaagtaggcgatgacggcggcttccccactgctgccctgcgctgccgccagtttctggtcgcgctggattcccatcgcatagccgacggcatggagtgtctgggcggccaggaccagggtgtagaggtggaagttcgtgtccttggggttccagccgccgttcgacactccgcggaactgccggaggagttcggcaaggtccacattgcgggtgtaggcgacgccgtgctcacggtaggtggggaagatgtagtcctgcggccggctggccctgccggagccgatctgcgcggcttcctggccggtcagcgggacccagagcgcaagctggccctgccgctgcagcgcagtagcttccacgtcgaagcgccggatggcggccatgtccgcgtagaggccgcgaagaatctccggggtaaccttctccgcgtactcggagaagacggggtcgaaacccagctttccgtcggggcccaggagttggaccatctgcgcgggcggctcgcccatgaccgcttcggcatcggcctcacgctggtcgtctaccgctgttccgtcgaactcggtggcaggcagatgtgtgcccataccgtctcctcgcttgccgcatgcggatgcagtgcaatgtcgctgggatatatgcctcaagaggaatcgattcccggcgcggcatatattttgctttactgatcctaactttatcttcagtaggtacgcgccgagctacttgttaagcgctaggaaccccgtggcgcgtttgtatagttcgcacacagctggaggaatctggagttagcctccgcctcgccgatgctcacccgtaccccttcgccggggaacgcccggactgacagcgcctgggcgcccgcaagttcagcaaatccggtactgtgttcgcccaggtccagccacacgaagtttccctgcgcatcaggaacagcccagccaaggctccgcagcccggccgtgacacgctcgcgttcgtccaccaggctttgtaccctttctacaacctgggagtagttctgcagcgaaacaatcgcggccttctcggcaatctgggaaacggcaaagggtgtggctgcaaccctgaggtgctgcgtcagcgcagggttggacacactgtagccaaccctgagccctgccagaccgtgtgccttcgagaacgtccgcagcaccaccacgttgggatatctgcggtacagggcaatgccgtccacggcaccttcagccctgacgaattcctggtaggcctcatcgatcaccaccaccacgtggggtgggacgcgcctcatgaaatcctctgtttcggcggtgcccaggacgggtccggtgggattgttgggcgtgcacaggaggaccattttggtccgggcggttatggctgccgccatggcctcgaggtcatgcctgccgtcggcagtgacggaaacgcgcacgctttcggctccggagagtcccacgcttatgggatacgcctcgaaggagcgccaggcgtagaccacttcgtccggcgtcccgtcgtcgttccgtccggcaaacgtggccagcaactggttcagtgcgcccaggctgcccgcaccggtgacaatgtcctcggcaggcacgcccaggaagccggacaactccgcacgcagcctgctgctgagcggatcggggtagcggttgaagtctgtctggtgcgctatggcttcaaggacggcgggaagcggcggcagcggattttcattggaggacagcttgtagctggccagcccgtcgacggcggcgggtggcttcccagcggcatagcggggcaggccggccaccacgggacggggctggacaccacccctgagggtctcagaagacgtcatgcagaccagcctacttcccacgctgcaggagggaagcaggctggtcgcacgctgttggcctaggtgccggacgctggtgcggtgctgtccgccctggtgcctgccagctgcggcgcccagccatctgcgccgcgcaggtaagcctccagcgtgtactcaccggccagagccgggtcgagctggggccgggtgggagtgacccgggatcccggcccgttgttgttgagttcatggaagcgcgcttcccgccaggagaacccgctcatgtccgtccatggcgcgccggaaatgtgggcacccagccaggagtccctgatgagcacctgggcaatcgcctccacgtcgccgcccgggtgccaggggcggcccagatggaccgtgccggccgcggcatccgagacgaaccggcagccggtgaacaggtagccgtgcttgatctggatgttgaggctgccggctgacacgtagccgttgttgctttcagacccccggtccaaggaccggatctcgcagccggaaaacaccgctgttccacggccaaagacgaaatccacatccccttccacgtagcagtcgctgaagaagaaccgtgactgcacgccccgggagggtgaatcaaccagcagggtgtcctggtttcccaggcaccggacattgcgcaggacagcacggtctcctgtcaggaagagcgccaccgcctgccggttcttcatctcatggttggcggcttcgtcgaagtcgttgctgaatgtgaggttcgccgccgtgaagtccggaccgtcaatccgcacactggcgcttccgcccgtgccataaggtccggtgccgtcgggtttcggagtgccggaggcgttgttgtagaccagcacaacatcctccgccctctcccccagaccgatgaacgagatcctgggcttgttggccggcactctgatgagttcccggtaggttccgggagcgatgcgtatctgggtgcggcgggtgcttccggctggtacggcgtccacggccgcctgcaccgtccggaatgcggatcctgccccgacctccaggaccacgggcttgtcgactggacgttcgctgggccagtggattccgcccagggggtccagttgggcatcaacgtactggaagtatcccggcgggactgcctgctgcgcctgcagctccgaggccaccagccgggccacggcaagggcgccttccgcctggaagtgggtgttatccgccacgccctccgggtattgcggatattggccgggtgacgcgtagaggaagtgcgactttgtcccttctgcgccgagcttctgccacaggtccttggaggaggcggtgagatccacaaggggcgtccccgtcgcggcggcaagttcccgaacagcctgggggtaggcgccgtgcgaatcctgggcaacgccgagggcgctgaaccggcggcgttccacaggcgtgaccagcacggccttcgcaccgcgggccctggcactgtcgaggtacttctgcaggtattccttgaacgtggtctgggggtcggtacccctggccgggtcctggactttttcgtcattgtgcccgaaggagatcagcaggtaatcccccggctggagcatggccgcgacctcatcgaggaggccggcgtcggcgaaactctttgacgaagccccggaccacgcgtagtcgaacacccctgcctgcggccccagcagcagggggagcgcctggccccagcctgcgcggggccgttccgactgctggtaggcggacgaggttgagtcccccaccacgaatatcaccgggtgggtccggccctgagtgggcgcgttgacggggcggacggcggcctgcgagcgcgcagcgcctggtccggagagtcccgccgcggcggttgctgctcctgctgcaacagcagccaggatggaacggcggctgggtttaaggcggcgcatcatttggcctcccctgcggtaaagacgggcccgacggcgtccgcgaggagggcgggaacggcctcagcggcgttcacatgggtccgcagtgccggtgtccagctgtcgtcagcgcccagctgccggtccgccggagcttccgcgttgtaggctgcccggagatcgacgattttgccgttgacagcatttccggtggtggcgatgacctttcccttgaaatatgcgatgagcgaggcggcgggggtatccgcaggaatcgtgaaggcgttggcctcggcgtagaggtgcgattccacacctgcaccgaaggtgtatccgtaggggaccccggagtccgcggaggtcttgaagtggttgttatagacgtcaacctggccgtaccggacccggggtgcgcgttggcctacgttctcgaacacgttgtggtggatcgttacgcgcagctttcccacatctcccctgctggtggagtccgtggatccgatgagcaggagcttgtcgtggtccgagaaccggttgtaggacatggtgacgaggtccgagccgttggtgacgtcgaccgctccgtcgtggacctggtagggccggccaaagtaggtgggctgggcgctgtccaggttgggggcgtcggtgaagtgggaatggtcaacccagacgcgggtggaaccgttgatgatctgcagcaggtcatactcgctgttccagttgccggtggcgccgtcggtgggatcccaagccgggaagcagtctgcggcatcgcgcacggtaaggttccggaaaatcacgttttcggcgcggttgatccgcagtgctgcacccgtgatgctgctgtccgggcctgcgcccacgatggtggtgttgctcgggatgtcccagcggatggtggcagcctgttgtgccgctgctgcgcgccgcgcagtttcctgggcaccctctggttccctggttgttccgtaccgggcgggatcgaagtcgtagaggtactgcgcaagggagtagccggtgccactggcatagtcttcgcagctgagcggagagccgctcgcgtccatgttggccgcgatatccccgtggacccggatgatcttggggtctgtaccgccgctggcaagagtagccaggagttcgttcttgctggaaacgtcgtacacgcggtcagcgccggcggcggacccgcctgtggtgccggcaccagccgccgcccagccgtcgttttcaggcagtacctggcgttcaagcggctgccgggccgtctgggctgttgggtccgcctgcggcgcgggcgttgcgaacgcggggacgggtgctgcgagcagtgaaacggcaatggccgccaccacagacacgggtggtaggagcttcttgtgacgcatgatctctcttcctccattggaatgaaccacgcttcggcgcaggcgacggcctgcacgtcggaaagcgatttctctactatgagaaaccgttttctgattgtcaaggcttaagtcgagacttgacaagattcattgcccgcatgtcataccgccaaggtaaacgtgtgacatccgccgaaagcggcagcctgcgccgggccggctgcccaagggaaccgtctcctgcacctatctcacaggcaggtgtgaaagcatgggcgcatgctttctttcattggccgggtcctcatcaacgggttggcgctgtggattgcaagctggatccttcccgggctggaaatctccacctcggcaacaacagacgcggtagcccagacgggtgtctcgcagggaacggacgtggccggaacggctttggcgtatgtatttatcggcctgatttttggtttggtgaatgccttcatccgcccgctggtgagcttcctgtcccttccgatcaccatcctcacgctgggcctcttcaccatcgtcatcagtgccgccatgctgtacctgacctcctggatcagcagtttcacgccggtgcacttcaccatcgattcgttcttctggacggccgtgttcgctgccatcatcatcaccctgatctcgcttgtggccggccggattaccggagtccgccgctagctgtactcagctggcaggcaggcctaccgcccgccatgtccgcgctcctgcctgtggggatcagcggctgggagatgaggggcggcggtcttcgccctcgacagggaaaaccgcgtggctttcgcggtgccgccgacgcccaggatggcgcccagcgccgcagtggattgcaccagcgaggggtcgctgcttgctgcaaccagccgggcaccgtgttggtaactgtgtagctggtggccagggccaatgcctacgtcctcccctgtctgaacgtacaagtcattggtcatggtgaccgtgacttggtttctggtgtcccggttgggtgcgccatcggccccggggacccagtccgtccggtgctccaggtggaggctggtgacgtccggcttcgacgcgatgtgggcaacgggcgagcccgcggtcaaaacgtactgcaagttgtactcactaatgaagtcctcgcttgctgccaagttcatggcgtggatacctccttggctgtaaccaactcccaccacgggatcgccccttctggcgccggccgcttgaagcgcgtcccggactgccttgttgacgctttctgagttgtctcctacgccttcgactattccgctcaggtcaaagggatttgtgccccccggtggggcgtgcagttgggttccaggaatcaccaccacgtaggccctacgtccgccgttatcgacttcgataactccgatatatccggtgccgcgttcatcaatgacccggacacgttccagcaggcccgacggggaaggatccaggacaatcggaacactctcttccttcgtgacttccaccgggcgaggccttatcgctggaatcacgacgtccgccagggtcttgaggaggggagagacgaacgcggcattgccgaggatgttctcggcggcgctgcggttgagaaaccctgtcctccagaaatccgcatggcggtccagctcacctgcggtgtccggaattccgagggcgcgcgcagtcgctgcccacgcctccgccacctcgtactcctgcctgcatgcccggacctggctgctgatgtgctggagttcggtccgcacggcctggaggctccgccctgactcgcccaccgcgctcatggccatggtcccggtccaccggggcaggtcctggaacggaatgagctcttcccagatgcggcgggcctcggcctcgatcccggcaagctttcccgccagggcatccactttttccgcaccggcggcaagctcctccagctggaagctgatgccgcccacaccgccccggatttcgaggggaccgtcctgcgccgggccggtgagccgaatggggccgccggcgccggacggcgtggcctcggccatctagaacctgccgccgtaggagcatccggcaaccagggtctcccggctgtgccgttccacggcagccctggcttccctcaatgattcgagggagcgccgcagggacgccgcctgcagagccacggtgtcccggtaggcccgccctgccggcgactcccactgcagcagctggatgtccctgaatcctgcaagcacctcctctccccgaaccacgcaggccgccacgcgggcagccaactggtccacctgggcaacacggtgcaagttggcccgcaggtccgcccctgccggctcactgctcaccctcccaccccacggacgccctgcaccgccaccacaagtcccgttcccatcccgcagctgccccttccatgccgccccctcttccttaccccgacgctacgaaagaacttccccgggctgtagggccgccgtcggctatgtggacaagtaacgtggagggccgccgcttaaggggccgccggagttcgtgaaagaatcagcacatgcctgaaactgccgccacagctgacacccgtacgccctcaggacgcctggcccttgccgcgtccccggaaaagatcgcgctcggcccgctggacggccgctaccagtcagctgtcgcgcccctggtggactacctctccgaagcggctctcaaccgtgaccgcgtggctgtggaagttgaatggttgatccacctcaccagcaacaacgtccttccgggggcggggccgctgaacgccgcgcagcaggaccagctgcgggccatcgtcaccgagttcgacgcctcatccgtcactgagctcgccgacatcgaagccgtcacggtccacgacgtcaaggccgtggagtactacatcggccgccgcctgccggccatcggcattgaaaacctgaccgccatggtccacttcggctgcacctccgaggacatcaacaacctctcgtacgcgctgggcgtcaagggcgctgtggaggacgtgtggctgccggccgcccgctcgctggtagcccagatcggcgcaatggccgaggacaaccgcgcggtccccatgctgtcccgcacccacggccagcccgccacgcccaccacgctgggcaaggaactcgcggtcatcgcgcaccggctcaaccgccagctggaccggatcgcccgcactgagtacctcggcaagatcaacggcgccaccggcacctacgccgcccacgtggcgtccgttccgggcgctgactggcaggaggtgtccaagtctttcgtggaggggctggggctgacctggaacccgctcaccacccagatcgagagccacgactggcaggcagagctttacgccgacgtcgcccgcttcaaccggatcctgcacaacgtctgcacggacatctggagctacatctcgatcggctacttcgcacagatcccggttgcgggcgccaccggctcctccaccatgccgcacaaggtgaacccgatccggttcgagaacgccgaggccaacctggagatttcctcgggcctgctggacgtcctcggctccaccttggtgacgtcccgctggcagcgcgacctcaccgactcctccagccagcgcaacatcggcgtggcattcggccactcactgctggcaatctccaacgttgccaagggcctggagcgcctggacgtggctgaggatgtgctggccggagacctggacaccaactgggaagtcctgggtgaagccatccagatggtcatgcgcgcagaggcgattgccggcgtcgaaggcatggaaaacccttacgagcgcctcaaggacctcacccgcggccagcgggtggacgcggcccggatgcacgaattcgtgcaaagcctcggcctgtcagctgaagccgaagcccggctgctggcgctgacgcccggcaagtacaccggcatcgcggaccagctggtggaccaccttaagtaactcccgctgcagtaccgcgggcggtacggcagtgaagtacgacggcggcgccgggctcccaaggggcccggcgccttgtggtgcgggtcattcgaccgtgccgggagtgcgaaactggaagcatgaagttgctgctcatccgccacggacaaacacccggtaacgtgctcggccagctggacactgagcacccggggcccggcctcacagaattaggcgaacgccaggccgaggcaatggcccgctcgctggcgaacgaacccatcggcgccctctatgcgtccacgctgatcaggacccagatcaccgccgcaccgctgggccgggtgcacagcctggaggtggaggtgctggacggcctgcacgagatcgaagccgggtccctggaaaagctgacggacgaggagtcccacaagcgctacatgggaacggtcttctcctgggcggcgggggacctggaccggaggatgccggccggccccgacggccataccttctttgagcggtttgacgccgctatccaccgggtggtggagcgggcgctcgaccagcagcatgaggcggcggccgtcgtaagccacggcgcggccatccggacctgggcgggacgccgggccgaggatgcggaccatgagttcgcggcacggcatgtgctggccaataccgggatcgtggcgctggagggcgacccggaccgcggctggaaactgctccactgggacggcagcccggtgggcggactcgccctggctgatccaaccgcggaggaccccaccgggcaggacaccgccggggcttaggtcagctgccggatccggcgggcgggaaaaaccgccatcctgcggcagctgctggtggcgtcgccgacgggtacgggcatgagccgcgcggccatgccggcggcctccggcgccgtcggccgttccgcactgtccatggcagtcagggaccggaggaaggaagaccacccggggcccagggagtccggcacctggggactgcgaagtgtcctggccacgagcgactcgatggccgtcccgggaaacgccttggatcctgtgaggagctccaggaggaccaaacccatcgcgtagacgtcccaggaaggacggacgggaccgcccgaggcctgctccgggctcatgtagtgcacagttcccgatgagacacctggttccgcaggtgaaccggcggccgcgacgatgccgaaatcgacaatgcgcacagggctccgccgcagcccgctcagcatcaggttggcgggtttgatgtcccggtggaccagcccttcaccatgaaggtggcccaggccttcgaagagcccccgcgcccagccggcaatgacgtccgggtggtgccggccggtgcgggcagcctccgagaggctcgggccgagggccagctcctccaccaggaacggccgccccgccagcggtgttccgccggggacaacgcccagtccgatgaacctgacaattgaggggtgccggagggctgccagcaccgcggcctcgttgctgatcctctcgaagtgcttcgcggaatcgtccacggccaccttgacggcaacatccggcccgccctcaaggtcggcggcccggaaaacctgcgccagggtgccacggcccaggaggtccttgagctggtagcggcttgccacgacgggtccgccgagtgcgagtgcgccagccggctgccggtgcgccggggacggaatgctcatgcggagagggctgcggagtgcggcatatccagcacagcggcaccgatcttggccccggcctgggatccgcgggcgtacggggaccggatccaggcgtccagctggaagccgcaaccgcagcgccacacgggcggaagctggacggcaccgccgtcctcaggttcaaacgaatagccgacggcggccggccccacggcgggcgtgacgaggtccatggcggttccacaatggaaggcaccgccgctgcccgtgccgcccgacggccacggtgcactgaaggctgggtcggttgcaggggaatccaagggcaaaagctcagtaaaggtaaccaacaggctcacgactccggctgtaaatgttcgggattattcgtaagcatacatattgctagtccatctagctagtcagcctagttacttttttcgtcatggtgcgatttctggagcgcttcggtcatccggctcaggaattccaccaccacccgggcctcatccgccgagagtccctcggctaccgccatcatttcccggtgcatgttgccaagggtcacccgcacctccctgtcggactcgacggtggggaccacaataacggagcgcctgtcggtggggtgggcctcgcggcggacatgcccgctggccacgagccggtcaataagggatgtggtggaagcgctggtgatgccgaggaactggctgatgtccttgggtaccaccgactttccggaggcctggacgcgcagcaggtagcggagggccaggatgtctgtctcacccatgcccatggagtcacgggtggagcggcgcaccgcagtttcagcggtccggtagtcccgcagggacttcaacaccgcggcgctgtaatccaactgaccgtccggcccgtaccaataaccggacccctcattacccgtagaacgcatgcaatcatattagaccagctgataactagacggccaagtaagttgcggaggcgagccctgatgcgttatccgggaactaaccggcaggaaacaccggcgtaaccgccttctcatagcctaggtttgcataacccttcggcgaagcgaggcagaatgcagaccaacccgcggttgaacatcaggcaggtgccctggtcaaaccccgtaggcgccgacctgcggcgtgcgcagcaggccgaactcgacgcccgcttcggtacacctgaccacgaacctggcccgccgccgtcgagcgcggactgtgccgtgttcctggtggcctatgacaaaggctcgggccagcccgtgggctgcggcggcctgcggatgatcgacgccaccaccgccgagatcaagcggctgtacgtcatcccgtacacccgcggctcaggcgtggccagctcgatcctggcggccctcgaggcagaagcgttcaggcttggatacacgcgcatcaaggccgaagcgggatctgcccagccggacggccggaacttttacgaaaactcgggctttgaggccgttcccaactttggcccctacattggggtggcacactcctactgctacgcgaagagcatcaatgcccgcagcgccgcccagactgccatggcctaggccggcgaccggcattcggggcgggctttgtcacagtgggtgcggccgcagcgcctcggctaacctcggcctatggaaacagcagacatcaccttccgcacccgcaagtgggtccggcccgaggacctgaacgcaaacgggacgctgttcggagggagcctgctgaagtggatcgatgaggaagcggccatctacgcgatcctccagctgggcaacggccgcgccgtcaccaagtacatctcggagatcaacttcgtaagctccgcggtgcagggcgacctgatcgagatggggctgactgccacgcgcttcggccggacgtccctgaccatgcgcgccgaggtccgcaacatgatcacccgccagagcatcctcaccatcgaggaaatcgtcttcgtgaacctcagcccatcgggccggccggagccgcacggctacacggaaatcacctacgaccgggacaggatccccacccaccatctgactgagacgcacagcggagacgcacagtaaccgctgacgctgtcagcactgacccaagtcagagctgacgttttaccgcctgtttacccgcacacccccgaccgttcctttgactggaccagagtaaccagccgggctgtttatcgaatcgatagccataacagccgtgaatttcgcctgcccggcgttaggcttgccggacatgctccgattccagtccagaaatgagtccagatcgtgcgtacattgaagactttggttgccgccgccgtcgccgtcaccctccttgccggatgcggcggaggtgaagcatcgcccggggcctcgggtgatgcctcctcagccccggccggcggctccggggacaccctggtggtttacaccaactccaacggtgagggccgcggggaatggtggaccgccaaggccgccgagtccggcttcaagatcgagatagtcggcgcgggtggcgcggacgccaccaacaagctgatcgcggagaagaacaacccgatcgccgacgtcgctttcgggctcaacaacatgtacttctcgcagatccaggccgaggacgccctggaggcgtatgaaccgtcgtgggcgggcgaggtggacaaggaactgggcgacggcgaaacgtactggccgctggtcaagcaggccatcctcctcggctacaactcggacaagatctccgcggacaacgcgccgcaggactggaccgacctgtggaccaaggacgagttcaaggaccgctacgaacgggtaaccggcctgggtacggccacggcgcagctggtcttcgccggaatcctcagccgttaccaggacgactccggcgaccttggcgtctcggacgaaggctgggagcaggtggagcagtacttccagaacggcagccccgccgttgcgaagacagacctctttgcccggatcgcgtccggtgaagtggacatgggccagatgccgtcctcgatcatcgccgaacgcgaaaagtccttcaacgtcaacgtggaaacagtgatcccgtccgttggcgtcccgctggccgtggaacagatcgcgctggtaaagggcacggagaagaaggaacaggcgcagaagttcatcgactggttcggcagcgccgaggtccagggcgagtttgcccagcagttcaacgcaatgccggtcaacaaggaagccgaagcccaagccaatcccgaggtagtggacttcttcgcggacctcaagcagcaggacatcgactgggacttcgtgcaggagaacatgggcgcctgggtggaaaagatcgaactcgagtacatgacgtaacccggccccgtccaccccttttcgcttcatcagacaggtttgccatgatccgcttggacaacatcgaagtttcctttggtgatttcaccgccatcccgaatcttgacctgcacgtgcttccgggggagttcttcaccctcctggggccgtccggctgcgggaagacgacggcgttgcgcaccttggcagggttcatccagccctccaaaggaacggtgcgggtggatggcaaggacgtcacccagctccccagcgacaagaggcaggtgggcatggtgttccagaactatgccctcttccccagcatgagcgtgtgggaaaacatcgctttcgggctgcgggtccggaaggagaaacctgcggacagcgaccgcctggtgcgggacattgcccggcgggtggagctcagcgatgagcagctgtccaagaacgtcgctgagctgtccggcgggcaacagcagcgcgtggcggtggcgcgggccctggtgctgcggcccaaaatcctcttgctggacgagccgttgtccaacctggacgccaagctgcgccaccagctccgccagcagctcaaggacctgcagagcgaattcgggatcaccacggtgtacgtcacccatgaccaggacgaggccctagccatgagcgaccgggtagccgtgttcaacaagggcgtggtggagcaggtggggacgccgcaggagatctacgaccattcggccaccgaattcgtctgcaacttcatcggggacagctcggccctgacgccggagttcgtggcggagctgaaccggctctcaggtgcggggcttagccctgacgccaattcctacctccgggtggaaaaggcctccttgagccccgcgcctgaaggaggcgccgccgtcggacttcccggcacggtggtatcacgcacctaccacggcctgcacagccggtacgtggtgcggagccacggcgctgacatccgcctcctggtgagggaagaaggcggcgcccaccacgaaccaggcaccgaagccactgtctaccttcagcccgcacacgttctgcagtaccacccggacacaggcgccgcccttcggcagcgggacccggcagcagtcctgccatgagcagcacggcggtacgcgccatggtccgctcccccttcgtgctgatcgtgggggcggtcctgacctggttcatcgcggcattcctggtctggcccaacatcaacgtgctgatcgcaacgttcttcccggacggcagcttctccgggcgggccgcggagaagctcttctcgtcccagcgagccatgaaggcgctgggcaacagcttcctgctggcggtggccctgtccatcacggtgaacctggtgggtgtgttcattgtcctggtgacgcactacttccggatccgcggttccaggatcctgttcctgggttacgcgtccactttcatctacggcggcatcgtcctggctgccgggtacaagttcatctacggggacaagggaattgtcacgtccctgctggtcaagatgtttcccggcatggacccggcgtggttctccggtttcttcgccgtcctggtggtaatgacgttcgccaccaccaccaaccacatgctgttcgttgccaatgccctcaaaggcgttgactaccagaccattgaagctgcccggaacctgggggcctccacgtggaccatcctgcggcggatcgtgctgcccatgctcaagccgacgctgttcgccgtcaccatcctgtccttcctgaccgggctcggtgccctgagcgctccgcaggtgctcggcgggcgcgacttccagaccattaccccgatgatcctgacgttcaccaacagccccacctcgcgggacctcgcggcgctgctggccgtgatcctgggcctggccaccatcctgatgctcgccgtgatgtcccggctggaaaagggcggcacctacttttcggtgtccaaggtgtcctcggcgctgcagaagcaggacatcacaaaccctgtggccaacgtggtggtccacgcggtggcttacctgctgtttgccgtgtacacgctgccggtggtgctgattgtgctgtactcctttgccgatggcgccgcgatccagacgggcgagctggcattcggcagcctcacgctcgagaactatgagcgggtcctgacccagccgtccgggctgcggccgttcaccgtgagcgtggtgtacagcgccctggcggcagtgatcgctgtgggcgggctgctgtttgtggcccggctgctgcagaagtacaagaactgggtggcctcagtcttcgaatacctgctccacattccgtggatcctgccgtccgcgctcctggctttgggcctcatcatcagctacgaccaccccaaccccctggtgggcggggcagtcctgaccgggaccaccgtgatcctgctgatcgctttcgtcacggtcaaaattccgttcacgctgcgcatgctcaaggcgtccttcgcctcggtcaactcctcgctggaggaggcggcggccatcatgggtgctaaaaccctgtacgtgttccgacggatcctgctgcccttggtgctcccggccgctgccgcgattacggcgctgaatttcaacagcctgctggacgactacgacaccgctatcttcctggcgcatcccctggtccagccgctgggcctggtcatcaaagccaacacagacggcgcggagggcgtcgacggagtcgccaatacgttcgtttacaccgtgctgctgatggtcatcaccggtgttaccatgtatctcgtttatggccgctccagcagggagaagtcccggaagaagcggctgccggccgttccgccggcctcccaggttcccggttcgggaattccgggaacgccggtttccggggaggacgccgcgcagcctgcagctcccgtccgctgatcagccggcggaaccgctgacgacggcggcgcggccgttccgccgtcgggccagcttgaggaggccatcacgcaggggctgggcgccgtccgcgagggcgaggcgccccattgccgaggatgccaggctgagggcgcgggtccttggccgccgctgccggtcgtaggcatgcagtgcctgggcttctggcagcgtgttgaggaggtcggccagcgttacggcatccaccagcgactcgcaggcgccgcgccccagggtgggcatcatggcgtgagcggcgtcgccgatgagcacggtccgcccgcggacgtaggagccaagacgcggaactgtccagagccgctggaccaggcatgcgtcgggtgtggctgcggccagcgtgcggcggatggcgggcgcgtggccggcgtagcgctcccgggcgtattccagggctgatgctgcgtcaattccgtacgggcccatcgcggaccggtagctggcccaccagaaggaccctccccgggcggcagccatgccgaacaggtcgccgcggccccagtactcgcccacctcgtcctggctgaccggagcaggcagggtcccgcggagggcgaggtacggggtgaggcgggcatccgttccggcgccccagacttcccgccggactgcgctgtgcacgccgtcagcgccgaccaccaggctgccgtcgtcgtgaagtgaccgcacgttgctggtgatccggcggacggttcccgggacggcaccgtccatcaaccgcagcaggtcaacccgtgaaatgccgaacatctcccccgcgtttacggtgatccagggctccccctgggcgttacgtaccgatccgctgccgatcaccggactgaccgcccgcgcctcttcaaggatccccagccgcgccagtgcacgttgggcattgggccacatccccagtgcgttgcccacggccggcagcccgggccgcttctcgtacaccgtcacctggaaccggctgtggtccaggctcgcggccagcgccaggccggcaatgccgccgccaacaatcgagattgtttccatgcaggtaattttactacttttgtagtaatgtgaaaggggtcaattacactgggcgcatgcctgaccgccggacccaactcttagatgccgccctggctgttgtggcggacaagggcatgaaaggcctcacccaccgggctgtcgacgccgctgcgcagttggcccaggggacaacctccaactacttccgcaaccgcgccgccctggtggaagcggtgctggaccgcctggagcaactggacggggcactcctgcaggaccaggggacggccggtccgccacggaccatcgaggaacttgcgggccaactggctgccctgatgctggcactggccggcgaaaatgcggccctgacccgcgcccggctggccctctccctggataggccggaagcggtgacggcagggcattttcggctggtgggcggactggaacaggccctcaccgctttaggggtgtccgatgcggctgcccgggcacgggaccttgcagactacggcgacggcgtgctgctccacctgctcacagtcaggcgggacgcgccgcccgatgctgcagccatcgccgccgcagtccgtcggctgctcgccccctaagctgcctcccggcgtcgtacctccccggagtttttgtccagatatgcagggtggaaggccgccgaagcctgcatatctggacaataaccctgcccgtcagacgtggcccggccagccggtgtaggcctccgccaggtaggccatgccgtgcctggatgacactacggagttcagctccccgagctggcgcgcccgggagaagtcgtccgcctcggccggggtgtgcagcatggtggtcatccagtaggaaaactgctgtgctttccacaccctctccagggcgcggccgctgaaggagtccaggaggtggtccgagccggagttgtaatgggtgtccagcccctcgaagagcatcttgacgtcgtggatggcgaggttgaggcctttggcgccggtgggcgggaccgtgtgggcggcgtcgccggcgaggaacaggttgccgtggcgcatgggcgtatgcacgaagctgcggaacggcaagaccatcttgtcgatgaccggaccctccttgagctcaaaaccgttgccgttgacccggctgcggaactccgcccagatccggtcatcgtcccactccgcgacgttttccttgggatcacactggaagtacatgcgctggacggtttcggtccgctggctgatcagggcaaagccgttggcggagttggcgtagatcagttcgtcggcgctgcgcggagcctcggccaggattccgaaccaggcaaacgggtactcgtggaagtaccacttgcggctggcctcggggatctggaagcggcagtggctgcgggacccgtcggcacccaccaggaagtcggcctggatctcaaactccacaccttcggagtccgtaaaccagaccttcggcctgccttcgaggtcgtgcacggtggtgtccgtgacgctgtagcggacatccccgccgtcggccttcctgcgggcggcgaggtccaggaacacgtcggtctgcgggtagagccacacggactcccccaccagatccttgaagtccacgcggtggctctccccgttgaaccgcaattcgatgccgtcgtgccggtcgccgtcgcgcagcacccggtccgagaccccgctgtccacgagcatgttgacggtgccgtgttcaaggatgccggcgcggacggtctccgagatgtccttgtggctgcggacttcaatgacggtggactcaatgccggccttggccagcaggtgggacagcatcaggccggccggacctgcgcccatgatggcgacctgcgtggtgatgattgtgcggggcatggcgttctcgcttcgttgcggggccgctgctgcgcggccatgtggtgcttctgccaacagtgtgcgctccggcaggtgagcggcgttacatggattccgttcaacggaagaggctgaaaactgagggccagtgttgccctacgcgtcgcccagcctgcgcgctatgcccctggctgctgtctgcagtgcgggcaccagtgcctgcaggcgcatctcgcgcagagggaccacgacgccgagtgaggccaccgcgcgctggcgggcgtccagcacggggacggcgatcccccacgtgtccgggtccaccacgcccttcagctgagcaaagccctggtggaaagtctcgctcagcagcagccggacagcgtcggtggcgacctttccgtccgggtccgcaaactggtccaggtactggctttgcagcagcctgtcctggtgggccatcagggcaagtcccgcggacgaggtatggacgggcatccggccggcaaccctggccctgttggccacggacccgcggcgggacagccgttcaacaaaaagcgcatcccagccgtccagcacggccaggttcacattttggttgaggacctgctggatgtcctccatgaacggcatggcggcctgccgcagggcaagggtgggggcggtgcggttgaccagttcccaaagccgcaggccggggcgcaccaggccgccgggagcggcgtccagcaggccatggtccgcaagctggcggaccaggcggtgggcagtggtgagcggcaggccggagcgctccgccagttcggacagttgcagggcgctgacgtcctcggggaaggcggagagcagacggacaatgcgatccaccaccgaatcacccgaggcagaattcgccaccgcacgcaccgcttccgttgaatgggacgctcccagcctaccttcgcgtcagctgcggcggctaaggcacctgggcgggggccgccgtcgtacgtccgcggaaacggcgccacgcgccgggggccaggaccacggcgatgccgacggcggcgccgatcaccgtttcgatgatgcggtcccggagcaggatggccggcgaggagggaaccacgaggagggtggacaccagcgccaggggcgtgacgaagatctgggccaggagatactgccggatgatgaacatctcggcgccgaactggcacagcgccatgaccaggacggtctgccacggctgcaggcctaacagcaggatgcccgccatcaccaccagccccagcacggtgccgatgatcctctgcaccccgcggcggacccggtgccgggttgtgtggcccaccagcggcacgacggcggccaccatggcccagtagttgtggccgaacccgaggcggctgccggcccaggtggccagcgcaccggccaggccggcagctaccaggtagcccaggccctcaagcagggcagcacgcttctcgtcgggggtgcggcggatgggacgcggccgggaccatgctgcccggcgactgggcaggatccgggaggagaagccaatcagcaggcagaaggcggtggtgagggcagccaccagcatgccctcccacagcggcggctggttggggatggaggcaatggccgcgaacgcaaagatgtggaagagggacccggccgggcgcaggcggaaccatgagatggctaccgaacagccgcctgccaccagcgtggtggccaggaccaggagccacgtggttccggcttcgtccagcccccaggccccgccggcccgggcagcgagcgctgcgaggagaatgaccagcagcatcagcaggccggcccgcagctgcagcgcgaagcgggtcccgtggggttcgccgcgcccgtagatgccggtgaaagccccgaaggacgcgaaaatggcaaggtccagccggcccagcagcaccagcgtgaagagcggaacgaagacccctaccgcgcacctcagggccgggtggtggtccttgttggcgggggcaatactgaacatctcggtgagcatcttcacgtggaatggggccttcctgcggtgccgggtgtctgggtggatcagtttctggtgagacgggcggccgcgctgacgttccaccaaaaatcctacgcccggcatgcttcgcacgatcggaacggccgggcaacaccgccgaaacagcaccacgcgatccttggaccatgaagcccggtgcaagcaagactcccgcgtctgaactgagctgcgaagtctgcggcctgatgcccgaaccaacaaggacccggctgaccctggccaacgtagccgtgatgctgccgatcgagctcctggtccacgccctggtggtggacacccagcttccctacctggccaaggtccttgtgctgactgttaccgccaccgtcctggtgatctgggtggctgagccctccgcggcgcgggtgcttcgcggatggctgcatgcaccggcgttgcggcaccggcgccggctcgccggggcgccggcgttgtggcgggcacgcaccgtcctgcaggatgagccgggggcgctgcagagagtcaccaaggccctggcccgcctggacaccaacatcctgagcatccacgtccacccggtggccggcggcgtgctggacgagtttgtgctgtccactcccggcgatgtggacgaataccagctcctggaggcgctgcacctggccggcggcacacactcccacgtctggccaaccaccgcgctggcgatggcggacggtcagacaaaggcgctgagcctggcggcgcggatcgctgatgcgccggacgagcttccgctggccgtggcggagctgctgcgggcacgggtcctttcccctgccgaggcgctgctggaaaggcacgacgccggaacccggcttaagatccccacggcctggcacggcccgatcacttttgcgcggcccggggaaccgttcactcccgctgagtcagcccgcgcccaccggctcgcggagctcgccgaaatcctggcgcaccggcccgccccgtccccgcccaactaggtagcgctaagtgtcgttatgaccctccaaaacgacacttagcgctacccagttggggttcgcggcagtcacaaaccgaatttatggggcagagcaaccccttggcggtcaaagccttgacagtggcacgggtcacttctacctttgattttgggatcccaaattgggatcccaaaactgcaggaaataacccggcgctccggatcgccactacctccttgtattgaagcaagccggcccctcctcttgccggcaggcgcactcgcactcttaacccccatccgtaaacttccccgtgaaggagaagctgtgtccatccccaataccgaaacaaccgccgctgacggcaccctggactcatccaccacgaatgaaccgcagaaggacggtgtgcaacggcgcaccaccgtccgctggaagctcttcctgctcctgttggtcctggtggcagtcaactacatcgaccgcggctccatctccgtggcgctccccatcatccaggaagaattcaacctggcccccgaactggtgggcctgctcctctcggccttcttctggacatacgccctgatgcagatccccgtcggctggctgatcgacaagttcgggccccgcaaggtaatgaccgcatcctgcgtgggctggggcgctgccactgccgcttccggcatggcaggcggattcctgagcatgttcatcgcccgcatgggcattggcgtcacagaggccggcgtcatgccggccggcggaaaactcaacgcgatctggatgcacaagtctgaacgcggccggggagccaccattttggatgcaggggcacccctcggcgcaggcctcggcggcatcatcatcgccggactcatcgcttccacgggcagctggcgcatggcattcgttatcgccggcgcagccacggtcctcatgggcgtggccgtgtggtggtacgtccgtgacaatccgcgtgaccaccgcggcgtcaacgaggccgaagcggcctacatcgaagcctcacacgccgcagaggacgccgaggcggagctcgacggcagccagggcaagcgggcactcctcccctacctcaagttccgttccttctgggccatgtgcttcgggtggctgggattcaacggcgtgttctacggcctgctgacctggggcccgctctacctcgcccaagccaaggggttcgacctcaagaccatcggctggtccacgttcgtgatcttcggagcaggattcgttggtgagatcatcggcggcaccatcgccgacaagtggcgggcctccggcgcctccgccaaccgggtgatgcgcaccctcctgggcatctccagcgccgtggtgatcggcggcctcatcggcgtcacagtcgtccccgaccccaccaccgccgttgtcctgctctcgatggtgatgttcttcctccgctgggtcggcctcttctggagcatcccgtccatcctgggcggccgcaccaatgccggcgtgctgggtggtgccatgaacttcagcggcaacatctccggctttgtcactcccatcgccgtgggcctgatcgtcggcgccacgggttcctacacctgggcactgctctacttcgtaggctcagcaatagtgatgggcgcctcggtcctgaccctgaactacaacaagcggcttcctgtctaagctagccatccaaggcatcacccgatccacgccccgccgggagccgtgccacaagaaattcgaatggagcaccatgcttaccgcagaagatacccaggacaaggaacgcccgctgcgcgaggccgtccgggataccctccgcacccggattttcgaaggacactacgctcccggcacgcggctggtggaaagagacctggcggcggaattctccgtctcaaggctgcccgtgcgcgaagcactgcgcatgctccgccaggaaggactcatcagcgaccgcggcgcgcggggtgcagaagtaagcactctgagccccaaggatgtggaagacctctttgacgtccgccagtcccttgaagtcctggcgtgccggctggctgccgtgcgggcaaccacaaaggacctcgcatacttgaaaggcctgctggacgacgccgatggcttcctcgccaagggcgccgtcagggaggcccaccgcgccaacagcgaattccacgacgccatcacccgcattgcggacaacaacttcctcaagtccgcactggagccgctccagggccgcatgcactggctgttccgccacgtcagcgacctgcccgagctcatccaggaacaccgcgacctctatgccgcgatcgccagcggagacccggacacggcggcggcccagtccgcctcccacatcggcaagtaccgcgagcagttccccgaggacttccagaaaaccgaaccccaacttcaccggaagaaattatgagactcctggtcatcaaccccaatatcagcgacgatgtcaccgccctgatcgaatccgaagccctccgctccgcttcacctggcaccgatctggtggtccgtaccgccggccacggtgtgcaatatatcgagacccgcttcgaatccctcatagctgccggcgccgttgccgaaatcatcgccgaacacacccgtcccggcgctgagcccgtggatgctgtggttgtggcggccttcggtgatcccggcatgcccgccctcaaggaactggctgatgttccggtggtcggcatcaccgaagctgctatctgcgccgccgccctgcagggccaccgcttttccatcatcgccatctcggaccggatcaagccctggtaccgcgactgcgtggaacggtttggcctggccgggaggctggcctccatccgctccatcaacgagtcactcaacagcatcagctcggtccagcaggacttcaaggacaccctcctggcactgagccgccaggccgtcgcggaggacggggccgacgtcgttattctggccggagccccgctcgcaggactagcccgcgagctcacagggcagatccccgtgcccgtggtggacggcatctccgccggcatccggatggccgaagccgtggtgggactccagtccggcccgcaccgggcaggtgctttcgcgccgccgccatccaaggagcgcaaagggctgagcgggaacctcgacgccgcactctctgccgcccaggccagcgccgcccccgcggtacccggcacctagaccaagaagctttcgccagaaggaggacaccgatgtcccgccaaccagaccttgtcattgccaacgccaccgtagtcaacagtttcgggcggcagaacgcccatatcgtgatccaggacggcctgatcaccgatcttcccgacgcctcggaagcggtacccgccgccgcccggaccatcgatgccggcggccgcctggtgattcccggcggcgtggacggccactgccacgttgcccaggtgaccggacgcttccgcacgctggacgactaccgcaccacatctaccgcggccctgtggggcggcaccaccaccatcatcgacttcggcattccccgggacgcccaggaaacaccgctcgccgcggtcctgcacaagaaggaactggccactgaatccaggtgcgacgtcgcccttcatggtgctgtcatcacctgggacgaaaccgtgccgtggcagctggaacagcttgccgccgaaggcgtgcgctcggtaaagatgtacaccacgaaccgcggcaccaccatggcggacggtgacaccatcctcaaggtcatgcgtgaaatggtcaggctggacgggctgacgtatatccacgccgaacatgaccccatcatcagcgactgcacggagcagcatgcccaggacggcaggatcggcattgagcacctgcacaggacccgacccgaactcgctgaagaaatctcggtcaaggaaactctggcgctggccgaatacaccggtgctcccgtgtacttcgtccaccagtcaacgccgggggcagtggacctggtgaccgaagcacgcgcacgcgggctggaggctttctcggaaacttgcccgcactacgtcaccctggacgacaccgtgtacggctccacattcccggaatggttcgcctgctgcccgcccatgcggaacgccgaaacggtggcggcattaaaggaacgcctggcctcaggggacatccacaccatgtcctcggaccactcctgctacgacctgtcccagaagcgcgagcgtaccgacgacgttcgggccatgccgcatggcctgccgggcgtggaaacccgcatgcccgtcacgtttaccgccatgacgtccgccggtgccagcgtggaggacttcgtagaggcattttctgcaggcccggcccggatcaacgccctgcccggcaaaggccgtatcgcagaaggattcgacgccgaccttgtgatgttcgaccccgctgaggagcgcactgtagacggcgccgccctgcacatgggtactgatttctctcccttcgacgggatggcactgaccggctggcccgccgtcgtcatctcccatggccgggtagtgctggatgccgatggtttccacgatccaggcgcggccgggcgcttcctggcccgcaacggcttccgccagcaccagtccgccacttccaccggcgttgcccacgcctcagcactctaggagcaccgatgccatctacaacacgcccccgccgaatcggtatgatcgtgccgtcctcaaatacctgcctggaaccgcagacgtaccgtattctcggcggccgcaccgacgtcaccgtccatttcacccgcattccggtcaccaggattgccctggacaagtcctccgaccggcagttcgatccggcagtcatgcgggaggccgcagggctacttgcgacgacggacgtggacgtcattgcctggaacggcacctccggttcctggcttggatccgcccatgaccaggacctggtcgaggaaatcaccggtgccaccggagtaccggctaccacgtccaccctggcctacctggaggcgttccggacttttggcacagagcggatagcgctgttcaccccctacacggaggatgtcaaccaccaggtgatcgcctcctatgagcgtgagggcatcaagacggtggaccaccgcgccttgggcctgagcgacaacgagtcctttgcccgggtaacggacgatgagatgcggcccggctcgctggaactcgcagccgcggcgccggacgccctggtctatctgtgcaccaacctctacggcgcgaatatctcggccgaaatcgaggacggaacaggggtgccggtgcttgattccgtggccgtgacgctgtggcacgccctgaggcttgccggcgcaccactgctggacccgcggtggggcaggctgttggcctaggaaggggctacatccggacggtcagggcgcccgggtccatggtcatgaccacgtgcttgctctgcccttcgtggtcgccgtccagctggtagtcgtccttgtgttccagggtgatctccacggttttgccctggaagtattccacggcggtgtccttcccccggcccttgccgatcatcccggcaaccaccgagagccagcccagcttgccgtggtggggcgccagcacggcaacgtccagcaggccgtcgtccatctttgcctcggggaagatctccaggccgccctggaccttgccgcagttgcccaccatgacgctgcggaccccacggcggaccgcggctttaccatcgatcacaatggtggccttgaccggcttgccgggcaggttccggatgccggcgtccacgtaggccagccagcccaccttgtccttcagttcctcgttggtgtcggccatgatggtggcgtcgtaccccacaccggccatgaccaggaacagctgctccatgtccgggtcgctgcggcgggcacggacaacgtcgatcttccgctcggtgccgatcagggctccagccatggcgccgtcgtaatcagtgacgtccatgccgaggttgcgggccaggaggttgccggtacccagcgggagcagccccatgggcacgtccccgccggacagcacctcggcgacgcaccggacggtcccgtcgccgccggcggcgatgacgatgtccgccccctgcgcgagtgcttccttcgcctggccaacacccggatcttccttggtggtttcaaaccagagcggttcgccccaaccgttttccacgcagtgctttgccaccaggccgcgcacatcaatgtctacaggcttggcgggattgacgatgattgcggcgcgctggggtgaagtggagctgttggcagtcatggtgtcctctggtggcaagtgaaaaggctacgtctgagagaagactagcctgcccagcgcgggcttcgaagcaggttggcggcaggtcagcggcaggactgcagctacagtgccttcacggccccgagcacctgggccagcgagtccttggcgtcgccgaacagcagcgacgtctgcggctcgtacagcaggtcattctcgatcccggcgaacccgggccgcatggaacgcttgaggaacaccacctgccgggcatccgccacttccaggatgggcatgccgtaaatgggtgagccggcggacgtcttggctgccgggttcacgacgtcgtttgcacccaccaccagcgccacatccgccgttttgaactccgggttgatctcccccatttccttgagggactcgtacgggacgttggcctcggccagcagcacgttcatgtgtccgggcatcctgccggccaccggatggatggcgaagtccacctcgatgccgcggctttccagggccagcgcgagctcggccgcggtgtgctggccctgggccacggccagtccatagccgggaacaatgatgacgcgctgcgcgtagccgagcaggaccgcaacgtcctccgcgctggaggaacggacgggacgctcgctcacggcggtggatcccgccgtcgaacctccccggaacgctccgaacaggatgcccgccacgctgcgtcccattgcagccgccatggcacgggtgaggatggtgcccgaggcgcctaccagggtgccggccaccaccagcagcacgttgcccagcaccaggccggaggcggccacggcaaggccggtgaaggcgttcagcagggagatgacgatggggacatcggccccgcccacgggcaggaccagcaggattccggcggccagtcccagcaccagcagcagcgacgccagcggcagggaccccgtgaaaacgacgacggcggcggcggccactgcggcgagcagcaccgcggccatcaccgccgggagtccagggaacaccactggccgggtggtcatcagttcctggagcttcgcgaacgtgacccccgaacctgcgaaggacacggcacccaccaggagggtgaagacgatggccagccgaacccagggatcgccggtatggctgagttccaggagcgccaccagcgctgcggcgccgccgcccacgccgttgaagagggccaccagctgcggcatctgggtcatcttgacccgccgggccaccggggcagccacggcagaccccacggcgatggcggccaggatccaggggatgttctcaagccgcgaggacaggaacacggtgaggacggcgatcagggcccccgcagcgccgatcaggtttccgcggcgggcggtccgcggggaactgagcccgcggagcgccaggatgaagaagacggcggcgacgaggtaaaggagcgacgtccagaccggatccaggaggctcatcttccgtccgccttccggggggcctctttggcacccaccgctttgcgcgcatggaacatgtgcagcatccggtcagtcactacaaaaccgcccaccaggttggcggtggcaaggccgacggcgaggagcgccaccgcgagcacccaggggtcggcggcctggccggcaacaatgatggcacccaccaggatgatcccgtggatggcattggcgccggacatcagcggcgtgtgcagggtgctggagaccttggacaccacctcgaagccgacgaagacggccaggaccgtgatggtcagcaggctcattccgtccatcagagcgctccttcccgccgggcgccggcccgctcggccagcaggtccgccgtcggctggtgccgcaccgtgccgtcgtgggtgaggcaggccccggcgataacctcgtcaccgaaatcgggaacgagcgcgccatcccggaccatcaggaccagcaggttggcgacgtttttggcgtacaggcgggaagcgtccgacgccatggcggagggggcgtccttcaggcccaccagccagacgtggccggagccgtccgcggtggggatgggaacgtcctggcccgccacgacgccttccacgttgccgccagactcggcagcaaggtcgacaaccaccgaaccggcccgcatgccctgcaccatctcccgcgtgaccaggagcggtgcccgcctgccggggactgccgccgtcgtaataagaacatcggcctgggccacgtgcggtgccagcagctggcgttgccgggtgccggcgtcggaactgagctggcgggcgtagccgccggcagcctccgccgtttcgaggtcgagccggatgaaggtgccgcccatggaggctacctcgtccgcggaggcggggcggatgtcgttagcgaagacccgcgcgccgaggcgtttcgcggtcccgatggcctgcaagcccgccacccccgcccccaggaccaggacccgggcgggcgggacagtgccggcggctgtcatgtatagcgggaagaacctgggcagccggatggccgcctccaggacgcagcgatatccggccacgagtgcctgggagctgagggcgtccatggactgggcccgggagatgcggggcacgagttccagggcgaaagatgtgacgccggcatcggcgagcgcctggacggtaggcagttcggacgacggcgacgcgaggcccacggtgacggctccccttttcagggacctggcggtgtcggggtcgaggggccggacgtgggcgaggacgtccagctgggcgggatcgagctcagaaacaatatgtgcgcccgcctggctgtaatcgaggtccgggtacccggccgccgcgccggcgtcttcctcgaggagtatctcgacgccgagcgctgccaactgcttgaccgtttccggtgtggcggccacccgccgttcaccctcccggcgttcccgcggtatgcccagtttcacccgccgactcccctcgctgcatggatgcggcagcgccgccctgccgggccgttcctggttcacgtggaccaggaggcttcgcggagcggcgctgctgcacgtagttggcttgagtctatggcccgcacccctgccacgggagtagggctgcgtgcttgggtggcaaacagttaccttacgtatcgcttggacgtccgcggctgccgtgttccccgcccgccagccggtaggagtcctgcagcagttccgccagcagcttcccgtcgatccggtccagccgcaccaacaccagctggggagaacgctcgtgatgcggggtccagaagaaggtttccggctccgttccggccagcgcctcgcgttcgtcagtcttgacggtgaggactccgggttcccagatgcgggccatcagggtccgggcgaaccaggcgggctggccccagctcagccgctccgtgacgcccggcatcgacagggcaatcctgcggacctcggcttcagtggccatgaaccacagttgcacccgccattgcgggccgcagtacatccatcccgccgaggcgtcttgccgggcggccctggtagtccagccctatgtcacgggctgtttcctgcaggagcgggacaactgtctgttcaatcacgtcctggctggagcggtgcgtctgcaatgagacgttgacagcgccgacagcttcgtctccgcaccagatgggaacggcaacgccgcggaggccgttctccagttcctgggacaccatggaccacccctgtctccgggcaaggctgacctcgtttttaagggcctccaggctgccgacggagtgctcggtaaaacgctgcaggtgcactgattcgtagtacgcctcgagcttgtcggccggaagggcagcgaggagaaccctccccatggacgtcgcccacgctggaaacctggtgcccacactgatggaaacgttgaggagccgcggagacgggacacaggcgacataggcgacgtccgttccatcaagcacgcaaagcgacgccgtctcgccgagctcggacgccagcaatttgaggtgcggctcggcaacacggggaagggacaggatggagaggaaggaggaaccgagctccagggaacgggcggtcaactcaaaagattgcccgtcggtccgcaagtacccgaggtccgccagcgtcaacaggaaccgccgggcagaagcacgcgttatgtctgtcgccgccgcgatttgggagaccgtcaggcggggggtttccgaggtgaacgccctgaggacgtcaaaggccttccccaccgacttcacaaagtacgccggatgttcttccatgaacttcttgcccctccgaaaaatacaggacaccgggcccacctgggtgggccccggcgtccttgagcgtatctagctggaaaccttcgcctggtccgctccggcgcccactgccttgcgccgcttcagctggacgcggaggggagggacaaccagtgccgcaacagagatggcaaggagtaccagcgcaatgggactggtgaagacggatgcccacccgtcggtgatgagcgcgcggcgcaggtttgcctccgccaggggccccaggatcaagcccagaacagcgggtcctgcagggaaaccgaaacgcagcatgaacagccccacggctccgaaaatcatcatcatgaagacatcgaagacactgttgttgatggaatacgtccccaccatgcagaagatcaggatgatgacccacaggtagtggctgggcagttccagcagtttgaccatgccgcgcatgcgcagcaggctcaggccgagggtcaggatggtggcgatcagcatgatggtgaccagcgaggacacgaggtccggccggctgctgaaaaggctgggtcccggctggatgccccagatcatcatggacccgatcatgacggccatgacggaatcaccggggacgccgagggccatggtggtggttacgctgccgccgagggttgccgtgctggaggtatcgccggcagtcaggccctccagggagcccttgccgaactcctccgggtgcttggagactttcctggcattgtcccacgcgatgatgcctgcgatgtcaccgcccaccgccgggacaaggccgacgacggatccggtcaccgcgccgattcccatcggcttgaacagccgctgcatcagtttccgtccgggcatccactggcccagctgggtgacgggcttgacgtggtgcaggtgcctgcgcctggtgagaatctggttgaggacttccgctacgccgaagaacccgatgatgaccggaatgaacggtacgccgccgttaagttccaggacattgagggtgaagcgtgcgtcaccggtgatgggatcacggcccacggtggccagcaggagaccgaaggctccggcggcaaggcccttgaggacgcgtcccgaggagacacccaccatcatggtcaggccgaaaaccaccagcgcgaacatttccggcggcccgaactggcgggcgaactcggacaggggcaccgcggcaaccgccaggatgaggatgccaaaaagcatgccgaaggccgagccgaaagcggacgttgtcagggcaaggcccgcttgtcctttcagggcaagcgggtagccgtcaaaggttgtggaaatggaggcaggagttcccggggtgttgatgaggatggccggcacccggtccccgaactgggccgccacatagatggtcagcaggacagcgaggccctggataggttccagcgtcagtgtgaacccgctggccagggccacggccatggtggcggtcacgcccgggaatgcacccacgagcatgcccaccaggatgcccaggcctatgtagaggagggtatccacctggagcacggtcatgatgccgtccgtgacgggtgaggctgcgatctggatcataggttcacccgcaatgcgacgacgaaaaggaaatggaggagggccgtaacgatggctgggaacacgagcagtggcctccagccccggccgccgtacagggccgtcagcgcgacgcacgctgcgaacgtgatcaaccagaactggaggacgttccacagcaggaggtagcccaccaggattaccgccgtcagcaacatccggccgatgccccacccgctgagcggatcagggaggttggcccggctgacgccgcgcagcacgttgacccccacctgcaggacgccgaagacgataaggctccatgcgagcatggtgggccagaaggggggcccgagttccacccggacccccgaacggatgccctgggcgagcaccagaaccaggacgccgaggcctatggtgaccgcggccggaaccagttccctgagccggtgcgcacggtccgtaaccagcacctcggacgccgggtggatatgggcttcggcatggtcctgctcagggtctgttgggttgaggcctgccggcggccctgttgctgtgtgatcgttcattgcggttcctcagtaggggccggccagtggaaggctggccggcccgtctgcctcgaagggtgtgcctggtgctacttgccctgcgcgagcttgatccacggtccgtaacggtcggcttcctcgtcaaggaacgccttcatcgcctccgcgtccttgaaggtgggtacaaggttggaaccttcgatgaccttcttgtactccgcgtcctcaacagccttgcccatggcgtcagagagcttgctgacaacttcctcgggtgtaccggccggagccatgatccccacccatgaagcattctgcaggtcaatcccttcttccttggcggtggggacgtccgggttctttggatcccgttcctcggtcagcatggccaggtagcggagcttgcctgcgtccacctggttcttctgcgtgccgatcgcatcgatcgagaagtcgacgtcacctgccgccgcagcagcaacggccggggcggagccgtcaaacgggacagacgtgagctcgattcccgcaagttcctggaggccctgggcgggggaatcccagaccgagccaacgcccgggctggagtaggttaccttgccgggattggccttggcgtccgcgacgagatccttgagcgacttgtaggggctgtccaccgggacagcgatggcaccgggtccggccaggccctggccaatcggcgcgtagttggacgggtcgatgtcgtaatcctggaactgcagggtggctacctctacgcccatcatcgaaaggttgtagccatccggcttttggtccttcagccagttgtaggccaccgatccgttggcccccggcttgttttcgacgatgacctcgacgcccagctctttttccagcaacggtgcgatggtacgggccgtcaggtcccctgagccgcctgcggcccaggggacggtcagccggatgtcctgtgcagggaagtcggcttcggaactgccgttgctgcccgaggcgcaaccagtcagcgcaagcaaccccgccgtgcccactgcgagtgattttagaagggttttcactacggttttctcctttgatacccgtaatccgacaaggctgctggctgtcatctccgacagtccacctcatctgggactttgtgcgcattacgaacatgtgtgcataaaacgtacagtagttgtaatctagttcacatcgaggcccggaacaaggccgcggccgaaattgtgaccaagcagtccgaccgttggacgcttcgcactggcggggccggaaggtggacagaatgagtactccggcggagtcgtacctggtggggttgatcggcgaaggaaccacgcactcattgacccctgccctccacgagcgggaagccgatcagcacgggctgcggtacatctaccggaccgtcgacctgaccgtcctggcacgtccggccggagacgtgggggccctgctctcggccgggcgcgacctcggcttcaatgctttcaacatcaccgttcccgccaaacaggttgtccttgagtacctagacgatctttcggatgatgcggcgcggctgggggcggtcaacaccgtccttatccatgatggcaagttcatcggccacaacaccgattactccggatttggctccgccctcgaggaaggcctccctggagcgtcccttggacgtgtggcgcagctgggtgccggcggcgccggagccgctacggcctacgcgctccttgcagcaggagctgagcacctgtacgtcctggaccttgatcccgcccggtcccgggagcgggcggcggccctggcggggcacttcccggacaggatcatcgaatggcggccgatgagtgaggtggccgatgtgatgtccgacgccgacgggctggtgcatgccacccctgtggggatgcacgcccatccgggcatgcccctggacggggacctgctccaaccccggcactgggtggccgacattgtctaccgcccgatcgaaactgggctgctcaaggcggccgctgccaaagggtgccgcgtgctggacggcggccacatggccgtgggccaggcagtggacgccttccgcctcatcacgggcgtggaaccggaccgcccacgcatgagggagcatttcctgtccatgctcaggcagggggcctaagcatcaacagtgtgcgccccggaccggctacccccgtgcgctgagatcggcggagatgagtctcgccgtcgcaatgatctcctgtgccaccgaatccaggaaggcgtccgggtccggcttggcagcgacggactgggcctgcagtgacacgttgacagccgccacaaccctggacctgtcgtacacaggggcggccacggacatcaggcccagctccagctcctggtccagcaagcaccagccctgcgcccggactgtctccaggactggcaggaggtccttgacggtgcccagggcgcgcggggtcagcggtttgatctcagcggcggccaggtaggacttcaggtccgccggcggcagcccggcgagcaggacgcggcccatcgacgtggcgtatgccgggaagcgggtgcccacggtaatgcccacattcatgatccggcgggtggtcacccgggcgatgtaggcgatgtcagtcccgtcgagcactgcggcagaagtggattcccccagcttcagggacagttcctcaaggtgcggctgcgccatctgcggcagcgacagcccggacaggtacgcgtagcccagctggagcaccttggccgtcagcgcgaatgttttcccgtcggtccgcacgtagcccagttccaccagggtatgcaggaaccgccgggccgtggcgcgcgtcagcccggtgcgggctgccacctccgtcagggtcatcaccgggtggtccgtatcgaatgcacggatgacggcgagcccgcgggccagggactggacgtactggtcactggcctgcggggcacccgctgatgctgcgtcggtcatggttaccaatcctagggccggctcaggccgcggcggccgccttcagcggaacaggcaccagttcctggagttcctccaaagtgcagccgaaggtttcgcggacggtgatgccgccgggaccggtgaggaagacggctttgtctgtgtagacgcgggtgacgcagccgacgccggtgagggggtaggtgcaggtctcgacgatcttggaggcgccttcgcgggtgagcagggtcatcatgacgaacacgtccttagcgccggtggcaaggtccatggcacctccgacggcgggaatggcgccgggtgcgccggtgtgccagttggcgaggtccccggtgactgatacctggaacgcgccgagcacgcagatgtccaggtgcccgccgcgcatcatcgcgaaggagtcggcgtggtggaagtacgaggcgcccgggagttcggtgacggggatcttgccggcgttgatgaggtcctcgtcaatctcatcgtctttggcttccgggcccatgcccagcatcccgttctccgtgtggagcgtgatgtcctggtcctcggtgaggtagttggacacgagcgtgggctggccgatgccgaggttcacgaacgagcccggggcgatgtccctggccaccaggcgggcgaggtcatcccggctcagtggggcctcggaggttttgatgcttgattccataacgcccatctcaggccaccttctcttccgtgccagtggtgctgccggcggtagtgtcggcggccgcggggacacggaccacggtattgacgtaaattccgggagtcaccacattttccgggtccagcgccccggtgggaacgatctcggcgacctggacgatggtgtgcctggccgccgctgccatgatcggtccgaagttccgggcggtcttgcggtataccaggttgcccttcccgtccgccttgagcgccttgatcagtgcgacgtcggcatggatgggggtctcgaagacctggccgcggccgtcgatgatccgggtttccttgccttcggcgagcatggtcccgtatccggtgggggtgaagaacccgccgatcccggccccggcggcgcggatgcgctcggccaggttgccctgcggcacgagctccagttcgatctgcccggccttgtacctggcatcaaaatgccaggagtcggactggcgcgggaacgagcagatcatcttccgcacccggccttccttgatcagcagcgccaggccctggtcgccctggccggcgttgttgttcaccaccgtcaggtccgtggcgccgcagtccatcagcgcgtcgatcagctcgaacggctgcccggcgttgccgaacccgccgatcatcacggtggaaccgtctttgattccggagacggcctcctggaccgactctacgaagttcagcattgcctatgcctttcctgtgctggtgcctgcggagggggtgacgttttcgaggacgacggcgaggccttggcccacgccgatgcagatcgcggcgacgccccagcgttccccggaggcctgcagggaccgggccagggtgcccaggatccgggttccggaggcaccgagcgggtggcccatggcgatggcgccgccgtgccggttcacgatcgaggggtcgatgccccaggcgttgatgcaggccagggactgcgcggcgaacgcttcgttaagttcgacggcgcccacctggtcccaaccgatgcccgccttcgccagagccttgtttgccgcctccacgggggcgtacccgaagtactggggatcattgccgtgcgcgccgcgcccggcgatgcgggccaggggctcgagccccagcagcccggcggcgctctcggacccgatccaggccgcggaggcgccgtcggacaacggcgacgcgttcccggccgtgaccgtcccgtcctcggtccggaacacggtcttcagcccggcgagcttctcagccgaggaaccggcccggataccctcgtcccgcacaaggtcagtacccggcaccggggccaccaggttgtcgtagaaaccttcatcccacgccgcggcggacagattgtgcgaggcagcggcgaactcgtcctgcgcttcccgggtcacgccgtacttctcgcggagccgttcggtggcctcgcccagggatatggtccattccttcggcatggctttgttcaccagccgccagcccagcgtggtggaggccagggtcatgtctccggccgggtagggcttttccgtcttcggcagcacccacggggcgcgggacatggactccgcgccgcccaccagcatcaactcggcgtcaccggcattgatctgccgcgaggcgataatcgccgcgtccagcgaggacccgcacaaccggttcaccgtggtccccggaatcgagaccggcaggccggccaacaacgtgcccatccgggcgatattgcggttctcctcacccgcgccgttggcgttgccgaacaccacctcatcaatccgctccggatcaagggcaggcgcccgcttcacggattccctgatcacgtgcgcggcgagatcatccgggcggaccccggcgaggccggagccgaacttcccgaacggggtgcgcacggcgtcgtacacaaaagcctgattcattactgttcctcaaatctgtccaaggttcccaactaggtagcggtaagtgtcgttttggaggctcataacgacacttggcgctacctagttgggcggggtgggggtttcgttggtgggtgctgcgctgtccatagcggcgctgtccaggtccttaaacacctgctgggcggtcttgaaagccgtattcgcggagggcactccgcagtagatggcggtctgcagcaaaatttccttgatctcgtccctgctgaggccattggtgagggcagcccggatgtgcattgccagctcttcccagtgcccgtgcgccaccatggcggtgatggtgacggcggagcgcatctgccgcgttagtccgggccgggtccagatcccgccccacgcgatccgggtgatcatgtcctggaagtcgtcggtgaattcgtccttggtggcgttggcccggtccacgtgcgcgtcgcccagcacttcgcgccggaccttcataccgccgtcataaatgtcctggctggtggcgccaggctggacggcgccgttacgttcggggttcttcccgccagtgccgttcatttggctgctccctgtgattcggtccaggtgatgaggctgcgcatcagctcggccacgtgggcgggggcttcggccggggcaaggtgggccacgccctccagggtgacagcggtggccgtccctcctccggccgtgatgccggccgccacttcttcagcgaacgacggcggggccaccccgtccagcgccccggcgatgacctgggttggcacccggatgctgcccaggtcctcccggacgtcgaacgcggccagtgcttcgcagcagaaggcgtagctgaaccggtcggcatcgcgcagggcgtgcagcagccggctgctgagctcgggctcgcgttccatgaaaccgggggcgaaccagcgttcggccgagccctggatcatcaccggggtgccctggctgcggactgtttcagcccgttccagccacccttcgggcgtgcccagctttgcgccgctgcactgcacggacaggcttttgaggcgtttcccgtgcttgatgcccagctgcaggccggtggcaccgcccagggagacgcccgcatagtggaatgcctctccgggtgcgatggagtccacgaggtccaccacggcatcagccagggcggcaacgtcgaaggcctccgcggcagcgggtgagaccccgtggccgggcaggtcccaggccacgacatcgacatcgttgccgagcaccgaggcggtgcggttccacaggatggtggaggtgcccagggagggtcccaccaccagcaggggatgatcgcccaggggccgctggggcgagagcagggcggctttcagggcaggtttagccacgggggtctccgttcacgtcggtatcgggaagtgcagtaggtgccgcaaattccgggaaggcggcctgtatgcggcgggaaatgcctgctgcctcgcccaggtagctggcggggtcgaggagttcctcgagccggaggtcggtgagtaccccggcaggcacggcgtcgcggagcagcctgcggtaggtggccgcctgctctccggagggtgcctgcagggtctggtccaccacggcctgcagctgttccttcccggtgaggccgtccttcgccccaagcaggggcgccaccgccgcgcccactccctcggccaggagcagcgggcccgcgaggtccaggttgcggcgcatcgcgtcggggaaggattgaaggccctcagcgagctcacggacgtgtccggccgccccgagcgccagggccaggagctgccggagggccggccattcggtgtgccacgcggcgtccgggcgctcatcgttgaagttggctgccgccaggtgcagctgggccacgagctggggtgcctgcagcgcggcactgcggaccaggacggacagcacggggttctgtttctgcggcatggcagaggagactccgcggccggcggcacgcggctcggccagctcgcccacctcgggcctgctcaggaacaggacatccgcggcgatcttgccgaacgcgtccagcacggcggcgagggcattgcccagggacgtgaccaccagccggttggtgtgccatggcgccggagccgcggcgaggcccagctgtgccgccagggcatcggccaggctgaagggggtgcttgatgagccggaggccaggacggttccggcagccagggtccccgccgcgccgccgaactggaccggatatgccaggccttcgagctggcgtcccgcggcggcgacgccgtggaaccattgcgcagcccgcaggccgaacgtgaagggcagggaatgctgggtcaggctcctgcccacgcacagcgtgtccgcatgctcttccgccaaactggcgagcgccgccgtcgtccttttcaggtcgccgagcaatgcctccacggtgttgcgggccagcagcatcagggcagtatccagcacgtcctggctggtcagggacgtgtggactgccttccccgcaccgatgccggtaccgtccagcgcctggacgtttttccgaaggtccgccagcagcgggatcacggggttgccgccgccctgggcgcggcgggctatgcctgccacgctgtacctgccgggctcggccgcggcggagacgacggcggcggaaccggcggccgccaggcccgccttctccagcacggcggcccagccggactcgacggcgaggatcgccgccagcacagcctggtcacccgtcagcgcacccaccaggggcgaggccgagacggggctgagcaggccggcgtcgcctgctcccccgaacgtgcccgtatctcccaggccggcggacccggtcactggaagtccaggaagactgtctcgccctcaccctgcaggcggacgtcccaggtgaggccgccgtcggcgtcgcggcgggcgatcagcgttttgcggcgctcgggatccagggagcgcagcagggggtcgttggccagcgcctcggtgtcctcggggaggtagatacgggtgaagagccggttggtgagcccgcgggcgaagatggccacggagataaagggcgcggccgctggttttccagggacctgcttggtggggcccgggttcacggtggtgaaggtgaagactccggagttgcccaccgcgccgcggccccacccggtaaaggtgtagccgtcgcggaccagggaaccggtcttcttgaggatgttgccctcggcatcgggctgccagatttccaggatggcgtccgggatggtgtgcccggcgccgtcgtacacagtgccctgcaggcggatggaccccggtgagccgggggccaggagctcgttgtccttctcgaacggcagggcgtacccgtagaaggggccgacggtctggccgggggtggggacaagtttggtctggttactcatgtgcctgttcctctgcctattcctcgtcgcctgctgcaccaagtgcttcgttttcagtccacgtccgcttggggcccgtcaggacgatgtcccagttgtagcccagggcccactcgggctcggtgaggctgtggtcgtaggtggccaccagccggtcgcgggcgtcctggtccacgatggtctggtagatcgggtccagcgggaacagctggtcgcccgggaagtacatctgggtgatgatccgctgggtgaactcggttccgaagagggagaagtggatgtgggccgggcgccaggcgttcaggtggttcttccacgggtacgcgccgggcttgatggtggtgaagcggtaggacccgtccgggccggtgatgcagcggccgatgcccgtgaagttcgggtcgatcggcgccgggtgttggtcccgcttgtggatgtagcggccggaggagttggcctgccatatctcaacaagctggccggcaacggggcggccgttcccgtccaggacccggcctgccacgatgatccgctcgccctggggctcgccgttgtgctggatggtgagatcggactcgagggcgtgcacgtcctggtggccgaaggccggcgagtacagctcgatggtttccgggtctgcgtgatgcaggctcttggtggggtgccgcaggatgctggagcggtagggcgggtagtccagccgcggctgggtttcggcggaggaaccctctttgagggcccgtgcgtaggcttcgcccagggcgttgatctctgcgctgaggtcagcctgggtttcaatagcgcggtccaggggcatgtgggcagccttcggctcggcgggcggcacagactcgtcggtatcaagctgggcgttggtttcttccggcacggctggctcctttctggttttcgttgtgattcgttgggcagttggggacagtggttcgacggcccggctcaggttcggtgcagcgagtcgtactggaccgcgtgccggaccggggcgttgggcgccccgtacccgtcgtagccgccgcggcgttccaccatttcaaagaacacactgcccaccgtggcggtgtagaagtggaggaattcgccgtcggcgtcgcggtcatagaggaggttgagctcctgcagggtggccaggaacccgggttcgaggtcgaaccgggcgtccaggtcctcgtagtagttcgccgggatctgcaggaattcaaggccccggtcccgggcggcccgggcggttgccacgaggtcatccacggcgaacgcgatgtgctcctggtaggtcttgcggacttcgctgcgggcctgctgcaccggtgccaggttcagcaccagccggacggcggcgtccgaggtggtcatcacctgcgagcgcaccagcccgctggggctgggcacttcggcgaagggctgcggttccagcgcaagggcgctggcgtagaagaggacggcctcgtcgaagtgctgccacggctgggcaaggttgacgtggtcgatgaccgcagcggcacccggaccgccggaaggagtccggtgctccaggccttccccgaattcacgggtccaggcggccgtgccgtcagggctgccctggcacaggaagatttccgttgagtccggtgcggagatgccctggaagacttcctcgtcggcctggaccttgcgggcaaccacgggagccttgagctgctgggcccgcgcggaggcaatcacgggtgaatcgacgtcgaaccccaaagcggcgatcgacggttcagcgtgcgatgccgcctgctcgttgatgatcacgcgcgcctggcccatggtccacagctgcacgtccttggtgcggtgccggccctcgaacccgaagccgagctgccccaggagcttctcaagctgggcggtatcgtccgctttgacctcggcgaagttgaatcccgccggttcgctgaccttgggcagcgtggcgagttccataggataacgacggcgggaggcagcactgccgccccctgcggcttccgcgccgcctgccagccatgtggcgctctgttcctccagccagatgagcgagcgcatggcgtccacggcggtgcggtccacgtccgactggcggaagacgtcgttgaagacctccagggagaccgggccggaatagcccgcccggaccacgtggcccatgaacttggccagctcgaactgcccctcccccgggaacacgcggtagtggcggctccaggacagcacgtccatggagagcttcggggcgtccgcaacctggacgaagaaaatcttctccgggttgagcatttcaatcggcgcggtgtcccagtcgcgggacaggatgtggaaagagtccaggcaggtgccgaagttggggtggtccaccatctccaccaggcggtaggcgtgctcgtagtcgttgacgtacttgccccaggccagggcctcgtaggcgaccttgattccgtggtccccggccagctgcgcgagctcggtaagctgcgcggcgcggagggcatcgtcgtcgatggtggccgtggcgacgttcgagcagaccaggatggtgtccatgcccaggcgggacatcaggttgaactttgcttcggcccggcggaggttggccttcagcaggtccggggtgacgccgtcgaaatcccggaacggctggtagaggtccagccccagtccaaggtctgcggccatggcccggacgtccccggggctcagcggtgaggtgaccaggtcctgttcaaagatttcgatgccgtcgaaccctgcgatggcacaggcctgcatcttctccttgagggtgccggagaggcagacggtggcgattccggtgcgcatcaggcagccaccccttctgcggccacgagctccaggaagtgcgagcgcatgcggtccggatcgggttccaggcccgtgaagatgcggaaggcgtcggcggcctggcccacggccatccggccgccgtccaggacctcgcagcccttggcgcgggcgccccggacgagttcggtgtcgatggggcggtacacgatgtccgccacccagtgcctggactccagcagctccaggtccagtgggacgccggggtgggcggccatgcccacgggggtgcagtgcaccaggccgtcggccggcggcatcagctgcggcagctccgccgtcgtgcgcgccacaacggcgctgtccgggaagaagccggccagttccgctgcccgggcggcgccgcgggcggcgtccatgtccacgaggtccaggtggcggaccccggcggtgaggagggcgtaggccacggcggaaccggccccgccggcgccaagctggaccacgcggtccagcttggcgccgggaagtcccgaggagagggccgcggcaaagccggaaaagtcggtgttgtggcctatgaaccggccatcatcgatcaccacggtattaacagcgccgagccgcacggcgtccggggttacctcatccaggtgctgcaggaccagctgcttgcaggggtgggtgatgttcaggccgttgaagccgaggttcctggcactgcgcagcagctctcccacggattcgccgggaaggccgagttccacgaggtcgatgggccgatagaggtagcgcaggccctgcacatccccttcacgctcgtgcatgggcggggtgagtgacggcatcacaccatcgccaaccagtcccaccaggtaggactcagttcgattactcatccgtgcagctcctttggtacggcaccgggcaggagcagtgcgccaagcgggtgctgctgctgcgggtgttgaaagttacggtactacatttgttcactcagcgcactcttgttctacattcgaacaaacagtgggtcagcgctgcggcaggcgggctgcgagctcggcagccgcctcctgcagcagcgggacgcacgccgccagttcctccaggcccatgcggaagacggggaccgcggtcgcaagggaagcgaaggcgtgtccttgggagttgaggaggggaacggcgacggcacgcatgcccatctcgttttcctcgtccatgacggcatacccctggcgccggaccttctctatttccgcgcggaaggcgtcccggtccgcgatggacttttcggtgagctgctccaggggcaggtcctccagcagccgctcgcgttcggcgtcctccgcaaaggcaaccagcacttttccgacggcggtagtggagagggagcccaggtggccggggtcactggtcacccggaacatctgcggaccgtccaccttgttgaccgtgaggtggtggtggccgtcgcggacgctgaggatggtggcctcgcccgtctgttccgtgacccggcgcaggaccggcatcgccgtgccggcgaaaccgtggtggttggagacccgctggcccagctggaagatccgcagccccaggtggtagcggcggccgtccggctcgtagtccacaaagccgtcgcgggtcagcgaacccagcaggcggtacgtggtactgaagggcagctcggcccgccgggaaatctccgcagcactggccccgcgcggctcatcacccaggaggaccaggaggcccagggccttgcccaccatgtccgtgcggtccgccttggccgccttggtgtccgtgggggtgtcagcagatacgtcattgtccgctgtggtttggttcacactcatgcatcgatgttcccacatagtgagagttatttctagatagtgattattttcttgacaggtgaccgcactcacagacactattgctgtatcgcacaagtagctcccaccatgtggctactgcccgggttatcccgcacctatgccgagccgcgcctccacccgaaggcagcgccggctgcgagccccctgatccatccgcgacaaagtcgtcacatctaaggaactccatgagccagacacttccgtccgccgagccaggcattgccgccccggccgggacgccgaagaaggccgccctcgccagcttcctgggcagcgccgtcgaatactacgacttcttcattttcggatccgccgccgcgctgatcttccccacggtcttcttcccggatgctgacgccaacgcggccatcatgtccttcgccacgttcgggttcgcctacgtggcccgccccgtgggcgccgtgatcctgggccacttcggcgacagggtgggccggcagaaggtcctgatgttcaccctcctgctgatgggtgcctccaccttcctcatcggctgcctgccggacttcaacaccgttggctggtgggctcccgccctgctggtcctcgcccggctctgccagggcctgtccgccgccggcgagcaggccggcgcctcatccatgacgctggaacacgccccggacaaccgccgctccttcttcacctcctggaccctcaccggcacccagggcggccagatcctcgcagcactggtcttcatccccgtcctggccctcccggacgagatcaagtacggcatcggctggcgtattccgttctggctgagcgccgtcgtggttgttgttgccttcttcatccggcgcaccctgcacgagccgccggccttcgaggaagcgcagaagaccgcccagatttcgaagctcccggttgccgacctgctcaaggcccactggcgagacgtcctccgcgtgatctgctgcgccttcatcgccgccgtgtccacggtgttcggcacccttgccatcagctacgccaagaccgtggcgggcgtggacggaaccacaaccctctggctggtcgtcggcgccaacttcgtagccctgggcacccagcccctcttcggcatgctggcggacaggatcggccgcaagcccgtcttcatttacggagccgtggccagcgccatcctgacgcccgtcttcctgctcagccttgaatccggcagcgtgccgctgatgttcctggccgcaatcggcttcttctccttcggctacgcagcgtccaacgccgtctggccctccttctatgcggagatgttcagcaccagggtccgcttctccggcctggccatcggcacccagctgggcttcctgatggcaggtttcgccccggcgatcgttgcggccatgggcgggatccggcccggcggctgggtgcagatcagcatcttcaccgccgtgatctgcggcatcgcggccatctcggcgctgacggccaaggagtcctacaagacccccaccacgcagctcggcctgaagtagcacttccaccggacaggacaccgttccagcccggttttcagaccggaaagcccgccattcccccaaatggcgggctttccccattgaaaaacgggctgtactggcgccgctaaagcaagcacggacgacggcgggtggccggggagggcacgccgcctgccggacgctaggcccggccggtctccagcaccgatgccaggtcgaagctgaccggctcctccagctgcgcgtacgtgcatgattccgggtcccggtcaggccgccagcggttgaactgggccgtgtgccggaaccggtccccctccatgtggtcataccgcacctccaccaccagttccgggcgcagcggcacaaaggacaggtccttgccggcgctccagcggctgccctcggcgttgcgtggcgtccgttccccctccgcctgcttggcccacgcccacggatggttgtcgaagtcggtcaccagcggctggagctgctcgaacagttcccggcgccgcttcatggggaaggcgccgatcacgcccacgctggccaggccgccgtcgtccttgtacaaacccagcagcagcgaaccgattacatccggcccgctcttgtgcaggcggtaaccggccaccacgcagtcggcggtgcgctcgtgcttggtcttgaacatcacccgcttgtccggctcgtacgtaccgtccaggcgcttggccacgatcccgtccagcccggcgccctcgaactgccggaaccattgctccgccgtgtccttgtccgtggtcgcggcagtgaggtggacgggggccttgcttgcggcgagggctttttccagggccgcgcgccgctcggtgaagggccggccggtgtagtcgtcgtcgcccagggccagaagatcgaacgccacgaaggaggccggcgtctgggaagcgagcagcttgacccggctggctgcggggtggatgcgctgctgcagcgcgtcgaaatcgaggcggtcaccggcggagcccaccaggataatttcgccgtccaccacgcagcgcgggggcaggttgtccttcagcgcctcaacgagctcggggaagtagcgggtcatcggcttttcgttgcggctgccgatttccagctcgtcgccgtcacggaagatgatggaccggaagccgtcccacttgggttcgtaactgagctccccgtccgggacgccgctgacggccttggcgagcatgggcgggacgggcggcatcacgggaagttccatggtgcccattcttgcccgcggacgtgccccggcgtaagaccaccgcaaacaaggttcaggctcagcccgccagcagccacacgatgaggatcagcgacggcgccgctgccgccgtggacagcaggatggtttcccgtgccacggcgaccccccgcccgtatttgcccgcgaacaggaacacgttctgggccgtgggtagggccgccatgagcaccacgcccaggagcatctgctggtccaggttgaagaggaagcgtccgacggcgaacgccaccgcgggcatcaccgcggacttcagcgcggtggccgtaaggatctccgccgtgtgcccgccgctttgcagcatccgggtgccgtgcagggacatgccgaaggccagcagcaccaccggaacggctgcaccgcccaggaggttcaggggtgccatcacaggaccgggaagttccaccttgaacgcggccaggaccacgcccagcagggaggcgatgatcatcgggttgcggaagggctgggagagcagcagtcggggtgacacccggccggccgcggagaagtccagcagggtgaggaccaggggcgcgaacaggagcagctggaccagcaggaccggtgccaccggagtggcatcgcccagggcgtacagggtgatggggatgccgatgttgttggcattgacataggaactggccatcgcgccgatggcggtctcggccagcggccgccggaaccacagccggctggccagcacgtacagcagcgccgtggcggacgccgtgaccagggccagcggaacgtaggcggaaaagaccaccgtgaggtccgattccaggaccaccgtaaacagcaggacgggattggtgatgaagaaggccgtacgggtgagcgccgagaccgtgggctccccgcccagcccgcagcgcgcggcaatgtaccccacagcgatcacggcgccgatcaccgcaagccccaccagcacaccgcccacgcgtggtacttccttccagctccgccgcctgcgcaggagttccgggaagcgcagtactacaagcctaaaacttatcggacaagtggcgccgggcaggccagccctcgacacggcacccttccggacggtagaggttaacgatggttaccgtcggcttccacgcctcacacgaacagatcagtcccgcccaactgctcaaggacgtccagcacgcggaacgggcaggcttcgatgccgccatgtgctccgaccatattgagccgtggtccgcccggcagggccactccggcttcgcctggtcctggctgggggcggcgctggccaccaccagcctgcgcttcggcgtggtgaccgcgcccggccagcggtaccaccccgccatcattgcccacgcctctgccaccctggcaagcatgtttccggagcgcttctggatggcacccggcagcggcgagaacatgaacgagcacgtcaccggcgatgcctggccgcccaaagaggtgcggcagcgccggcttgaagagtgtgtggaagtgatccgccggctgcaccggggggaggaggtgacccaccacgggcttgtcaccgtggaacaggcccggatctgggacgttccggactcgccgccgccgctgatcgccccggccatcagcgtggagaccgcccgccgctctgccgcctgggcggacggcctggtaaccatcaaccagcccgccgacaagctgagggacatgctggcggcgtaccgggacaacggcggccgcggcaaggccgtgctgcaggtgcacctgtcctgggccccccgtgaacaggacgcggcagccattgcactggaccagtggcggaccaacaccttcgccccgccggtcccctgggacctccccacagccgggcatttcgacggcgtgagcgggcacgttggcgaggaccaggtccgcaaggcggtcaacgtctcggcgagcctggagcagcacgcagaatggctggcaggctacgcagccctgggcttcgatgaaatctacctccacttcgtggggcaggagcaggccccctttatcgatgcgtttgccacggacgtccttccgcagctgcgcggctcgcgggcccaggcacgggcgcaggcaccggcatgaggctcgccgaaacctcggacctctggtggaagaacgcggtgatctactgcctggacgttgagaccttttttgacgacgacggcgacggcaccggggacttcgccgggctcacccagcgcgtggactacctggccgcgctgggcgtgacctgcatctggctgatgccgttctacccctccccggaccgcgacgacgggtacgacgtaacggacttcttcaccgtggacccccggctcggcaccatgggggacctggtggagttcatccgggcggccagggatcggggcatgcgggtcatcgccgacttcgtggtgaaccacacctccgaccagcacccctggttcgtcgaagcccgcaaatccacggacaacaaataccgggactactacgtgtggcggagcgacactccccccgatacgtcctccgaagtggtgttcccgggcgaagaggactcgctgtgggagaaggatgacgccaccggggagtggtacctccacatgttcgccaagcaccagccggacctcaatgtcaccaaccccgacgtgcgcaatgagatcgccaaggcgatggggctgtggctggaactgggcctggacggattccggctggacgcagtgcccttcttcctggaaacccgcgggcagcccagggacgaggccgccaacctggatccgcacggcttcctcgccgccctgcgcagtttcgtgagccgccgcaacggcagcgccgtgctgctgggcgaggtcaacctgccctacaaggagcaggtggagttcttcggcggaccggacggcaacgaactgaacatgcagttcgatttcatgtccatgcagtacatctacctgtccctggcccgcggggatgcccggcccctggctgaaacgctcaagagccgcccgccgctgcacccggacaaccagtgggccatgttcgtgcgcaaccatgacgagctgacactggacaagctcagcgacggcgagcgcgaagaggtcttcgaggctttcggaccccggaaaaacatgcagatctacggacgggggctgcgccggaggcttccgccgatgctgggcggcgatcctgaacgcctccgcatggtctattcgctgatgttcgccctgcccggcacaccggtgctgttctacggtgaggaaatcggcatgggcgaggacctccggcaaaagagccgggcagcggtgcgcactcccatgcaatggaccgacgagaagaacggcggattttccacagccaaggccgcggacctggtggtaccgctggcccgcggagaatacggcccggagcacgtcaatgccgcggccgccaagcgcgatcccggctcgctgttcaacttcatggtcaccctgatccgccgctaccgggagtccgcagagcttggctggggggacttcgcgatcattgagcagtccgagccggcggtcttcgcgcacacctgcagcacggacaccggcgcactggtgctcctgcacaacttcggcgaggagccggtgaaggtcagcggcacattggcccacgaggatgggccgcgcaacgccttcagggacgccatcctgctggacctgttcgacggcgacaacataccgctggagcccgacggcggtttcaccgttgagctggaacgctacggctaccgctggtaccgcctccaccgcaaaggcgaccggctgtcgccttagctgcgcgtcggagccgggacgctccgtcagctcatgccacgctctccagagtgcccggccgggagccgagccctacgtaggcacccttgaagaagacaaggggctctgctccagcccgggcactcaaggcacgaactgcgcccacaacgatggtgtggtcgccgccgtcgtactcctgctcaagctcgcaatccacccacgccagggcctggtccaggatcgggcttccaagcggcgacggtgagtggctgactccagcaaatttgtccgttgcagagcgcgcaaactgggctgccaggtgctggtgttcagcagggaggatgttgacggcgaaccggcccgctgcccgcagcaggggccaggtggtggaggtccgcgccgggctgaaggacaccagcgccggttccagcgaaagggacgaaaacgactggcaggtcatgccggcgggcccggtctcagccgaggcggtgatcaccgtcagccccgtggcgaagtgccccataatatggcgcaggcgccggggactgaggtcatattggtccgtcatgggtgtcctttcaagggggggtgacctcaatcaaccaccccggcatccagacctcaacttcggctgaaacctgccgaccccttgcgcaacgcggggccgccaggcttcatccggcgaccaggaatgccccctgcccggaccaagtgttacccctggtttcgtgccgtgacgcacgaggacggaaatcccccctgccatgtccgggctggcctagattgctaaaaagcccagcacattacaggaggtgtaccacgtgtcgttgactacgcagcggactactcaccggcttaccatcaaggccccggccgacctggtcttcaccgtactgcgggattcctcccactggccgttcctggacgggctgaccgtctactccgaacgggtaagcggcgatgacgccgaccatgaactccgcacgtccatcgtggccaacggtgccctgaactccagccgctgccaccgcctcttcgatgcagccgcacaccgcgccgaattccggcaggtcggtttggagcaccccctgttgaggctcggcgggagctgggtgatcctccgtgcggacggcaactcggaggtgaccctcacgcacgagttcgaagtggatggggcagcagccggggacctcccggagctgatgcaccgcacgattgatgaatacagccgtcgcgagctggaagcgctgcgcctgagttcggagcgcctgagcctgctggtgcagcagcactcggcaggtgcccacgccagcgaggcctagcacgcggcaggcgcggccgcgcactgcaggcgtccacccgctgcaggggcacccagcgccatcctgtgcacaaaggaaagtaccccgccattgccggatcagcaatggcggggcactttttggccgggactacgcagactgtagcacccggttgtgggagttggccggtatggccagcccgtagtggccgcgcagtgtgcgtcccgtatattcgctccggaacaggccgcggtcctgcaggatcgggaccacctggtccacgaaaatctccaacccggagggcagcaccggcggcatgatgttgaatccgtcggccgcgcccgactggaaccagtcctggatggcgtcagccacctgctccggggtgccggcgaatgtccggtgcccacggccgccgcccagccggccgataagctggcgcaccgtgaggtgttcacggcgggcgaggttcacgatcagcgtgtaccggcttttggcgccctcgatctggtcctccgaggggaggtctgccggaagccgggcgtccagctccagggattcaggtgccacccgcagcacgttggcgagctgccggcgggcgtgttcgggcaggatcagttcgtccagttcccgctccagtttcagggcctcggcctcggtagcggcgatgacgggaacaatgcccggcaggatcttcagggataccgggtcccggccagccgccgtcgtccgtcccttcaggtcagcgtagaagtcctgcgcatcggagagggtctggtgggcagtgaagaccgcctccgcgtaccgggatgcgaactctttgccgtcctcggaggagccggcctggacaatgaccgggcggccctggacggacctggggacatccagggcgccttccacccggaaatgcttcccctcgtggttggccgcatgcacccgggaactgtctgcccacactccggcgcccttgtccgccaccacggcgccgtcttcccagctgtcccagagtttttgcgccacgtccaggaattccgcggcccgctcataccgctgcgagtgcgccggctggccggccagtgagaagttccgggctgcggcgtcgccagctgtggtcactacgttccagccggccctgcccccgctgatgtggtccaccgaggcgaagcgccgggccaggttgtacggctcgttgtacgtggtggaagcggtggcaatcagtccgatccgctcggtgacggccgctatggccgcgagcaggacggtcggttccaggctggtgtacggccgttgggccacgttcccatgcagcaccggtgaatcggcgaagaagatcgaatccagctttccgcgctccgcaacctgggccagccgttggaaatgcttcacgtccgtgctggcgaaactgttgctctccggcagccgccacgatgcctcgtggtggccggtgctcatcaggaaagcgttcaggtgcagctgccggggtccgctttccggcgcgctcactggtttgccccggctgctgcgaaggccggtgcctgggagattccaggcacgacgacggtctcggagtaggcggacgagtcgcccttgatggaggtgctgctgcggccgtccactccgcgggggacgtcgccggcgatggtgacgcggttcagctggcggggctggccgtcgtagttgtccggcgcatagtgctgggtgatgcggttgtcgaacaggaccagctggtccggctcccagttcacccgaaccccgttctccgggctggtcacgtacgcctgcaggaggcgcaggatgtccttggattcggtgttggacaggccaacaatccggagccgctgggcgaacccgccaataaagagcccgcgctcaccggtcagcggatggatacggacaacgggatgggccgattcgaagtggatgcgcgtgaattccctgcgccgctcgtccgcgttggcatgctccaggttcttcgggacggagtagtcgtagtcgttggtgtggattgcccaaagggtgtcggcgaaattccgcagttcctcgggcaggtcctggtaggcgccggccgaggatgcgatcagggtttcgccgccgtaagccggcagggtgatgctgcgcagggtggaggcctggggcgggttcacgacgaacgtgacatccgtgtgccagttgttggcactcccgttttcgctgtccactggcaggacggccggtttgccgtccaccgaagccaccgtggggtgggctttggtgagcgggccgaagtggctggcgaatcgcacctggtcctcgtcggtgccgatgttggcttcccggaagacgagggctttgtgggtgttcagggcggcacggatctgcgccaccgtgtccggcgacaggtccctgctgaggtcaaggccgcggatttccgcgccgatgcgggcactcagcttggtgaactggagtttggtttcggtgatgacggtcattggatcttcctttgcagttcagtcggacagttcagttgggcagttcaggatgtggagccgacggcggtgcgccagcgggagaagtgccgttccagggccacgagcagagcgttgacggcgaggcccagcacggagacggtcaggatgccggcgtacatgtccgggatcaggaagctcatttgcgaattgacgatcaggtagccgagcccggccttggcgcccaccatttcggcggcgatcaggaccaggatggacgatgtcccggccatcctgatccctgtgaagatcgtggggaccgcagacggcaggatcaccttctggaagagccggaaactgttcatccccaaggatttggcggcacggatgagcagcgggtccacggtccggacgccggcgatggtgttcagcaggaccgggaagaaggcggcgtaggccacgatggtgatcttggattcctcgccgatgcccagcagcagggtgaacaccggcagcagtgccagggtggccgtgttccggaaaagctccaggagcgggttcaggaacgaattcagccagccgtaccaggcgatcaggagccccagcaccacggccgtgaccactgcaatcccgaatccggataccgagcgggtgaggctcgcctgcagatggctctgcagctgcccggcttccacgagcctggcaccggcggcgaggacttcgtgcagcggcggcaggaacacgcgggtggaggggctggccagatacagcggccccacttcccagagtgccaggaaaagcaccacggcaagggatttccagccggcgcgggccgccaggtgtgccacgtaggagagcctgcccgccttctggcgttccgccgcaggcagggctggagagtgttcgacggcggcaggcgcctccggggggcgggtcaacactgtactcatcaggctgcgctcctttcgagcggctgttcatcgggggcggtgccgtccggcaggatcttccggtggccggagtcccgggcgaggcggacttcgtcgtgcagcagcgaccacacctggtggcggcgttccacaaaggcggggtgcgagcggatgtccgcgtcgccgtcgccctcgggaatgttgatggccacgatttccttgagttttcccggccgggcgctcagcaccgccacccgctggccgaggtacaccgcttcgtcgatcccgtgggtgatgaagacgatggtcttcccggtcgccttccagatccgcaggagctcgtcctggagctgttcacgggtctgggcgtcaagggcggcgaagggctcgtccatcagcagaacctccggctcataggcgaggctccttgcgatggccacgcgctgcttcataccgccggacagttcgtgaggatagcggtccccgaacccggcaaggcccaccaggtccaggaattcgctggccttcgccgccctttcctttttggacaggccagtgttctcgaggcctattgaaacgttggccgacgccgtccgccagggaaacagcgcgtactgctggaagacgactgcccggtccgggcccggtcctgtcacttcctttccgtccaccaggacctctcccgctgtgggacgggagagcccggccagcaggtccaggagcgtggtcttgcctgagccgctggggcccacgagggtgaggaactcgccggcggcgacgtccaggctgaggctgtcgatggcggtgaggactgagggctccccctggcggcggctgcccgtacccttgcctgcccggatactgaattccttggtgacgtttcggaggctgattttgggggtcatcgtctatcctttcggggttgcggccggcgccggggtttccagcaggttgaactcgttggtgtagagcgtggaggtatcaaggtcgccggtgataattgtgataatcccggccgacttcaggtagtcggcccagcgggtgaaatcggtgtcctggatccggccgcccggcgaggcaacgcccacgctcttccagtacttcagcgcctcagtactctcgttgcggccccgtttggcgatgatttcctcgaatttggcgatcacctgctcccgtggggtgctccgctgccattcgatggccttggccaccccggtgaccagcgtccggctggtctccgggttcttcgccaggaagtcatggcgaaggacgtactgcccggcgtcgaacggtcctccgatgacgccgacgtcggtgaagagggcacggacgcctccctccgcgagcgcacggtcctgcagcactccgcccagtgttcccacgtcgacctgcttcttgcgcagggcaacttcggtttcgttcggcggaaccaccaccagctgcacctgcttgatctcctcgggagtcaggccgctgttcttgaggtgcgtggtgatcacggcctcgtggtgggcgccaagggtgttcacggcgatcttcttgccgatcaggtccctggcagtgcggatggggctgccttcctccacgtagtaccccgtgaaggtctcgttgtcctccccgtagtagttgatgacggctttgaccggcgcaccggcctcgatcagcttgatcacggctccggtgaaggctcccccgatgtccgtctggtctgtggccacggattggatgctctgcggcccgctggtggtgttgctgacccattcgagcttgacgtcgcccagatagccgaggtcttccgccacttccaccagggctactgtgttgggcgaaccctggtaccggacggttttcacctcagcgccgccgtcgctcccggcctgttgtgccgtagcgggaccgccgcaaccggacagcgccagcgtgactgccacgactgcagccatggcgaatgccgttcctgtggtgcggatagttcgtgcgggcaggaggcggtttttcatggtggtgggtctttctgcagttcgggtgtcgatccggaccatctggctcgtggcaaccactagaacagagaagaatcaccggcagaagcggcggcttaacagcgcgaaacggcaggcaactgcgggaaaacgggagtaacagaagtcctcgcggcgtagtgttcggacactccgctgcacgttgtgccgccggccgacacatggcgcatcgggacgtaaggcaatcaggtaccggaggttcatgacggttcatacgacgacgcgcaggtccacagcagcgcaacgtgtgccgtactttgagcggtggatgccggcgccctgcccgcatgggcatcacgtcagagggcgcaccgtcccagaaatgccaggtgggtgtcgccaatatttctgccggtgagcttcgtttgttacccgcggcccgccatcgcccccggcggaactgcagccggcgcgccgtcgtcgtccgggtgtgaaaaaatcaaccatgcgccccatgcagcactccagcaagctccagaacgtacggtacgaactccgcggacccatcctccaggccgccaaggccatggaggcggaggggcaccggatcctcaagatgaatctcggggatactgccccgttcggcctggaaacgccagagtccgtggtggtggacatgatccaccacctgcggggcgcccaggggtacagcgattcgaaagggatcttctccgcgcgtaccgccatctcgcagtactaccagacgcgcgggctgatgcagatcggcgtggaggacatcttcatcggcaacggcgtcagcgagctcatctcgatgtgcctgcaggctttcatggaaaacggcgacgagatcctggtacccgctccggattacccgctgtggactgccgcagtcacgctgaccggtggcaagccggtgcactacctctgtgacgagggggagaactggtggccggacatggccgacgtcgaggcaaagatcaccagccgcaccaaggggattgtgatcatcaaccccaacaaccccacgggcgccgtgtacccgcggcacatcctggagcagttcgcagctttggcccggaaacaccacctggtcctgttctcggacgagatctacgagaaggtgctgtacgaggaggcccagcatatccacacggcggccgtggccgaggacgtctgctgcctgacgttcagcggactgtccaaggcgtaccgcatgcccggctaccgggccggctgggttgccgtcaccggaccactcgccgccaccgccgcctaccgggagggactggagctgctggcctccctgcggctgtgccccaacgttccggcccagcatgccatccagacctgccttggcggctaccagagcatcgacgccctggtgcggccagggggcaggctccgcgaacagcgcgatctcgcctaccagctcctgaccgagatccctggcgtaacgtgtgttcccgccgcgggagccatgtacctgttcccccgcctcgatccggagctctaccccatcagcagcgacgagcagttcgtcctggacctgctgaaggatcagaagatcctcgtctcgcatggttccgccttcaactggcccacgcccgaccacttccggtttgtgatccttccgtccgtcctggacatccgcgaggccgtgcaccgcatctccaccttcctggcggcgtaccgcgccagtgtggaactgccgtagcctcctttgtccgcggccgccgtcgggccttacccgcctgttctgctgttgagcccgggaaccggtgccggggaaacagcaccggcgcgaagaactaacccgcgcctaaccgcggggaaacgcgggtgcaacattgcctgggcacactggattctgcaggcaagagccggcaccagccccagccaggaggccccgccatgaagcagaaagcgacaccacatgtgacccgggtccgcgccctggaccagctccaccgcggcgacgagattgaagcccgcctctcggtgggcccttcctacgacgacgttgtgatccgccgcggaagtgtccaggaaaccgctccgggcatcggcgtggtgtggatcctggaccggctcaccggcctgcgcaaagccatcaatacggacgagtgcagcgtctggcggctcgcctgaaattgtcggggtccgcggcccgggtgtagccagcaagggctgcccgccgcaccggaatcttcgactcaggggccgccgctcagccgccggccaccgactggatgaccagcacctcctggcctggcgacacctcggtgtccagcccctgcaaccgccgcacctcgtccccgccgacgtacacattcacgaagcgccgcagcgcaccggtctcgtcacggagacgccgggccagcactgcgaagtccgaggtcaccgcatcaaggagctttcccactgttacaggcccgtcggcaggcgcagtcaggacggactgcccgccggccagcggctgcaggacgctgggaagcaccacgctgatttcctgcatgctgctctcaggcaccggctatcacggccgcccggacacagagcacatccggaaggtgggacaccacctcctggaacgtcccgccttcgtccgcactggcgtagaccgagccgccgcgcgtcccaaaatagaccccggacggctccgctgtgtccacggaggcggcatcgcgcaggacgctgttgtactcccccgtgggcaggccgttgctgagcctttgccaggtggacccggcgtcgtccgtgcggtggacggccagctcgccgtccggcggaatgcgttcgccgtccgctttcagggggatgacccacgccgtgccctcgcggcggggatgggtcagcatcacgaagccgaaatccgcgggaagcccttccgcgatggagttccagctgtccgcgttgtcatccgtgcggtaaacgccgtggtggttctgggcgtagaggcggccgtcgacggcggcatccgctgcgatcttgtggacgcactggccgaactccggattgggatcgggcatgaagtaggccgaaatgccacgattgcgcggctcccaggacgtgccgccgtcgagagaccggtaaacgcctcccgtactcatggccacgtggaccgtttccccggccggatggaccacgatggagtgtgcggccgcaccgccgtagcccgcgccccactcgctgcggtggggatggtcccacagcccgcggttgagttcaaagtgttcaccgccgtcagtggatttccagacggagatgggctccgctcctgcccatacaacgccaggacgcgcctccgcatccggatagatctgccagatgcgctccagcgcggcacccgtgtcctccggaaacctgacggcgccctgctcgggctcggaccaggtggcgcccaggtcatcggagtgcgcaacggtgggaccccaatgctcgctgcggacgcccaccattatccgggtgcggccttccctggtgtctattccaatgctggggatctcgctcatgaggaaatgcgggccggtgaaagaccactggcgcctgtcctggctggtggccagccagaggccctttttggtcccgatcgctaagacaaaactctctgcggatgccatgcccaccatgcaaccaccgcgcactgcggcccgcaacggttattttgtgtcccggccgggctaactagtccacaaattccgattgggtttcgatgaagtcccagtccgccggggtcaggacggccgccggattgtccggatgggggccgccggcttccgcaattccctggagcactggaaggggcaactcctccgcccgaaggttttcccgcagccattccttgctggccaggtccaggtcaagccaccacatgtagatttccatgacgtcatgcacctttcgtatgttccaacgttaggcccgggcggatgcgcggacaagatacacccgcggcgggcaggtagccagtgcagggagtcccccagggatgcgggtacccgcaagtaaccacattggccgggcggtggaaaagacgagtaccccctactcaggactgcctttagccctccccctagcctgaaaactcaagcaagctgaccgtgttgctggggcattcggcgcaagtgctgggcctcctcttcatggtccgtttcacacagcgaactggggagaaaacaatgaaacgtacctttgtgactttgggggtcgtcgggctggggctgcttggcgtgacggcaccggccatggcagcacctgaaagggtcaccgtctgccacaatgacgggggcagctggtcgccgctcgaattcaacatcaacggcctcgaaggccacgaacagcacccgctggacatcattccgcccacgtccaagtcgcctggcaagaactggaccgacgccggaaagcttctctacgtcgaaaaatgcgcggcgttgccgccaggcgaaacaatgccggaggtgccgggcgaggagcccgtcgacgagcccgtcgaggagcctgtcgaggagccgccggctgaagaggacccggtggtggaaacaccggccgaagagaagccggccgcggaaacaccggtggccgagacgccgtcggcggagacacccgcgctgacgcctgctgctgaacagcccgccgcagtcacggcggaggcatccggcgtcgtcccgcaagccgccgcaccggctgcgcctgctccgcaggcaaccgtccagcggccggtcgccgccacgggggccaccagccacggcaccaaccaggggtacaacgcccagaccgccgtcggtggttctgaaagcaccccgtcatggctggccggactggtcgcactggcggcagcaggagcggcagtggctttccgccgccggtcccgtccgttcacccccgccggctgacacagccaagaacggcataaccgcagccccggcccgtggcttcgtaaacacggacctggctgcggcccttgacggggaaggcgtccctccagtgcccggcggggcgccttccctctttttcgtcgaagcatcgaggagcaccatggccaaggtccacagcccgcaggcagcggacgggaagcgcgtgcggcggcgctggaaccgtggggatctggctattctcctgtgcggcatcctggcgttcctgtccatcacctttggcgggcaactgctgacgcacaccgcctcggatggcagctcgcaggggtcattcacggctgttgagccggtcaccgccggcatcccgcccaagggcccggcacccatcgcggcaacgggtaccgcggaaggaacctccgcgcctttcgactcctccgccagtccagctccggctcccgtgctgcccgatgccgccgagcccctccgcatccggtacccgtccgccggcttcgacgtccccgtccaccgcctggacctggacagcgacgcccaggccaaccagaccgtcgtgccgcccgaaaccaaggacggctactggctggcgtccttcggcacccccggccacggttcggccaacaccacctacgtcatcggccacagctgggacggcgcagaggcacccttcaatcacttgagttcagcggcaacagtgggcgaccggttcgaggtggacaccgcaaccggcaccatcccgtaccaggtggacaccgtcaccacgtacctcaaggccaccctcaaggacagccccatctgggagatcgtacccaaccgcctgatcctgatcagctgctacacggaggacccgtggggaaaaaacgtggttgtcacggcctcgcccgccgttccctgacggcccgagagggcccgctctctccacccgccctatccaagagcatccacggaggctgaaaataagctatgagcccggaacagatgagcaacaactctcccctggtggtgggcatcgcacccggacagcacgccgaggtcctgcagaccgccgtctcactcgcctcccgcctggggacgcggttgctctgcgcccatgtggacgaggccagcttcctggtggactgggaccctgcgcggcccgcccaccggctctccctgcaccccgacacggacgacgcaaacatcggagccgtggcactggagcttaagtcggcgatagaggcggcggtggccggcgtcccgcccggtaccgcagccgcggaatggaccctgcagaccctggccggggatcccgcccgcgccctcgcccggctcgcagccgaaaacgacgcgccgatgatcatcgtgggaacctctgagcgtggcttctcccatcgcctggcggaagccctcagcgggtccgtgggtgcctggctcacgcaccaccaaagcaggcctgtcctcatagttccctaccggatgccggcccatgacgaccggccgtaaaactaaagcgaaagtagttattcggggtgctggcggagcggactaccagccagtaagctgattcaagcaagacgggttccagcaggatgaaacccggatattgcccaaaagctgctccggagtgcgtatcccccaataacgcactccggagcttttttgtgccccggcaggcaaacccgcccggatcagcgcataccccctgggggtacttgtgaacataccccaagggggtatatggtgtcgtcatgagcggaatcgaagaagcagtcagcgggcacgcggcggacctgcagccgccccacggctatacgggcaacaaagaggcttacctccggcggctcaagcgcatcgaggggcaggtccgcgggattgcccgcatggtggatgaggataagtactgcatcgatatcctcacccaggttgcggcggtcaccaaggccctgcacgccgtcagccttggcctggtggaagagcacatcggccactgcgtagtgggcgccgcctctgaacccgacccggcagcccgcgccgacgcaatcgacgccaaggtcaaggaagccgccgacgccatcggccggctgcttcgctgacgaataatgaccaaaccagcgccggctaccgccggcaaacctgaaggagcagccatgagcaccacttcccccaccaccacacgggtcagcgtctcgggaatgacctgcggccactgcgtttcggcagtcagcgaggaactcgaagcactggccggcgtcgaagaagtgagcgtggaactgaacgccggaggtatctccacggtgaccatcacctcccgcacggaactgtccccttcggagatcggggaagcggtagccgaggccggctacctcgtcgtcgccaacgaagcctaaaaccgtcactgaagcagggaagccccaatgagcaaccaggaactcctccaccagcccgccacccgcgtggtggaactcgacatcgagggcatgacctgcgcctcctgcgtcaaccgggtggagaagaaacttggcaagctcgacggcgtgcaggcctcggtcaacctgcccctggaatcagcccacgtcacggttccggcaggcatcactgacgagcagatcacggcaacagtggaagccgcgggctacagggcaacgatccgccagccgctcaaacagggccaaagtccggccagcgaagccggggacctgcccgcagcgaagctccgcccccgcctggtcctagcggcgatcctgaccgtccctgttttcatcatttccatggtgccgggagcccagttcccgcactggggctgggcggcggccctcctggccctgcccgtggtgacctgggcggcctggccgttccaccgggcagcggccgtcaacgcccggcacttcgcgtccaccatggacacgctggtgtccatcggcgtgaccgcggcgtacctgttctccgcctggcagctgttcgcggatccccgcatgactgaacacccgggaatggaaggcatggagaccggcggcctctattttgaggtggcagcggtggtcaccaccttcctgctcctgggccgctacctggaggccaatgccaaacagaaggccggcgacgccctgcaggcactcctgaacctgggcgccaaggatgccaccgtcctccgtgacggcaaggaacagcgcatccgggccgacctcctgcaggtggatgacgtcctggtggtccgacccggtgaaaaaattgccaccgacggcgtggtgacggacggggactccgccgtggacgcttccctggtgaccggcgaatcggtgcccgtggaggtaggcccgggaagccgggtcacgggcgccaccattaatacctccggccgcctcctggtgcgtgcaacccgcgttggctccgagacaacccttgcccagatggcacggctcgtttcccaggcccagaccggcaaggcacccatcgcccgcctcgcggaccgcatcagctccgtcttcgtccccgtggtcctggccattgcggcgctcacgttcgtcctgtggcttctctttacgggaccggatgtgaccagcgatgacctgcgctcggcgtttaccgccgccgtcgccgtcctggtcattgcctgcccgtgcgcgctgggcctcgccaccccggttggcctgctgacgggaacggggcgcggcgcccagctgggcatcctcatcaaagggccgcaggttctggaggacacgcgcaccgtagacactattttgctggacaagaccgggaccgtaaccaccggtgtcctcgccgtggacgccacgcttgccttcgggaacttcggggagggcgaggtgctgcgcctggcgggggccgtggaagcggcatcggagcacccggtggcccgggccatcgctgccgctgcccgtgcggataccgcggggctgcccacagcggacgacgacggcggcctccccgccgtggaaggcttccgttccgcgccaggcggcggcgttaccggaaccgtcgagggcagggtggtgacggcaggccggacgggctggctggagcagaacaacatcaccatctctcaggagcagcaggcatcactgtcagctgcggaagcctccggcgccacggcgatctgggttgccgtagacggtggtgttgccggcatcatcagcctccgggacaccctcaaggaaggttccgccgccgccatcgcacacctgaagcggctgggcctgcgccccatcctgctcaccggcgacaatgccgcggtcgccgcccaggtggcggccgccgtcggcataggcaaggaagatgtttacgccggggtcctgcccgaaggaaaggtggaggcggtgcgcaggctacaggccggcggcgccacggtggccatggccggagacggcgtgaatgacgctgccgccctggcccaggcagacctgggtattgcgatgggttccggcacggacgtggccatcgaagccgcggacctgacggtaatgggcaacaaccttgcccaggtggcgcaggccatcgaactctcccgcaggaccctggccaccatcaagaccaacctcttctgggcattcttctacaacgccgtgggcatcccggtagctgccctgggcctgctcaacccgatgatcgccggggccgccatggccgccagctcggtcctggtggtggccaattcgctgcgcctgcggagcttcggcaagcagccgaaggccagctagaacaagcccatgtagcggctgggctcaggcggcgccgtaccgtacggctgcccgcgccctggccttggctgcctcggcttcccggtccttgggcggcgcttgcgaaaccaaggactccaggaggtgctgggtgatgtgggcgatctcgtggacggcctcatcaaaggcctcctggttggccttggatggcttggtgctgccgctgatcttgcgcacatactgcagtgcggcggcgtgcacttcctccgaggtagcgtgcggttcgaagttgtggagggttcggatattccggcacatacagccatgctaggctctggaacgcctgggatcgaccccctccccgaacggtttgcgcaagcagcacccatggggaggcttgcatgggcagggctgcccatcgacgcttcctcagcggccggggtaggttttaggcaatggatcttccggatgagccggggggccgagggggatgccgacctggttcggatccacgattctatgaggagaaactgatggctatttggggtgcagacgttcagcagcttcgtcagctgggcagcaagctgcagtcaggtgcaaccgagatcgacaaccagaaaacggctctgaacggtcttctgaacagcaccgactggaagggaccggatgcggacaagttccgcgacgaatggtccggtacccacaccaccatgctgaccaaggtggccgacgcgctcagggaagccggcaccaaggccaagcgcaatgccgaacagcaggagcaggcctccaactagtccctgcgcactgcgcacggtcagtcaggcggtcccggacaccccatgggtgtccgggaccgccgcgtttaagagcctgtccggcctggtgccgtacccacttaagggacgggctcgacgtcgttcgcgtgttccagcggcgacgccgccctgggcagttcctggcggcgcagttcctggccgcgcggctcctccccgcccgctgcgcggccggcagccggcccccgcagctcatcgagccggaccagtaccaccccgcccacgatcaggacgccgccgaggagctggatggcccccggcagttcaccgagcagcagccacgcccacaccacggcaaagagaacctcggtcagcgacacgaaggacgccaccttggaacccagcgcccgtgcggccatgatgccggagacgtaggccagcacggttgccaggaccacgagccccgccagcgatacccaccagggcgtgatccagggtcccagcctggtgtcggccgtgctgaatgccatgggcagcaggccggtggcagcagcaagccacatcacggcggcaccaacaaacaacccgcctgaagccagcacgatgggcggcagcgtgtcattctccttcgcggtgatgaagaagtagatggcaaggcacacggcggcggccattccccagaggacgccaacaacatcgatcttgacggcgccggtcaggtcaaggaccaggaccaggccggcgagggacagcagcgtcccgccgaaagtcaacaggcgcggccgtttccggctggcggcccacagccagagcacaatgatcaccggggcgaggtattcgagcagcagcgccacgcctaccgacagccttgcgactgcgttgaagtagaagagctggcaggcagcgacgccgatcagcccgaacagcccgatggttacccagttgtcccgcagttgatgccagcggcccctgagggcggggatggcgggcacggcgaggatcagggcagcaccggtgaggcgggccgtgacggccgccccaggggtccaccccgattccaggagcgccttggcgaaggacccggacaagccgaagaccgcggaggagaacagtgcgatgcccaggccggaggcgaggaagccgcgcctggcggcgggcagacggccgggcgcgcggcgtgcagcggacattggccgcctcctgtcaggagtaaaatggggttatggtcatgacagtacgggacggcgctgtaaggagtcaagatggtttttgcccctgacactgaggtggcactgcggaccgtagttaacctggtcaactcagctgcgaacgggagcgagggccttgccacgcaggcggatctggaccatttcctggcagctgagggctttagcgggtcccgcgcccgggacggggatgagctggaaagcgtccgccgcttgcgccacgagctatcggagctgtggacggcggatgaagacgccgcggtgaaaacggtaaaccgcctgttgcaggaggcgcacgccctgccccagctggtcaagcacgacgattgggactggcacctgcatgccaccacgccggaggctccgctggtgtacaggatgagcaccgaggccgcgatggccctggcggacgtcatccgcggcaaggagatggaccggatgcggacgtgcgaggcggaaaattgtgatgctgccgtcctggacctcagccggaacaggtcaaagcgctactgcgatacgggcaactgcgccaaccgcgcgcacgtcgccgcctaccgggcgcggcaggcggccaccggctagtggctgccccgggtgtccgtgccgtcagccggcgggtcctgcgggcccggagctgcgccgaagccgtgggacggctttcgggctgaactgaggttcacaccggagcccttgcccaggtgctctgcgttctccttgtggctcatggagagcattgccgccaccaccagcgtgacgatgaatgcgatgccggccgcagtgaaggccaggtcaaagcggggggcacgggcgctgccgccggaagcgaaaatgacgacggcaaggaaagcgatcacggcccagaacgcggagaacatcagcggacccctcaccgaggtccgcagcttgcgcggttttcctggatgctggtctgccacggtggttcctccctgcaggcggcacgccggccggcctggtttaagtgttgcggtggtttgcccggcaattttttctacaagaagtagaaccgcgccttcctagtttacggcttaccggcggcgctgcgggcatcgtgccggagagtcaggcctgacaggacccacaggacacccgaaatgatcgctcctccgccggccactcccagcagcgcgtgggcgcccagcccgataaagaaaggcaggagggccgcggtgccgaggccaataattccggaggtgatccagtcgcgggccaggacatggctgcctcgaagcttcaggccgcaggaaagctcaagcgctcccgccaggcccaggcccacggcagcgaccacgccaaacagctggtccccgtgcatcagcaccaatgaaaatccggcacctgccatcaccgcacccgcggccgaaagcatcttgcccggcgccgcaccctgcggaagcccggtggcgggaacagtccggagcagcagcacgcccgtggccagaaggtacagcccgccggcccatcccatgacctcaacggaaggcgccgcccaaaagatggtgagggcaccgaacaccagggctgcggccgagcggagcaggacgggctgccaaaggccgggcccggcgtcggttccggaagtggtgcctgcgggagtccttggttgcgtcaccggtccagtttagtggcggcgcgccgccgtccgaacttcgcgccgattacggcgggcgctcatccggaccccagcaccatccagcggtccgaccgggcacgcaggccgagcgtcacggcgcgggccgccatgtagccgagggcaaaggcggcccacagccaggccaggcccgccccgccctgggctcccaggagtgcaaccgccgcaagcatcggcacgtaggcggcgagattcatcacgccggccagggcaaggtacttggcgtccccggcgccgatcagcaccccgtccagcacgaagacgtagccggcgaggggctggcccgcggcgaggacccacagggcaagggccagcgccaacctcacctcgggatcggccgtgaagagtgcaccggcccacggcgccgcaaccgccaggagaagccctgtcactgcgccaaagccaagcccccagcggaccatggtgccggtcaggagccgcgccttgccggcattcgaggctcccaactccttgcctatcagcgcctgggcggcaatagccagcgcatccagggcaaaggcgaggaaggaaaatatggtcattgccagctggtgggcggcaaggttgacagcgccctgcgaggtgaccacaaccactgttgccagaatggcgatccttaggctcagggtgcgcagcatcagccaggaccccacgcgcgccatgctgcggatgccccgccagctgggcagcagacccaccccgttgcgtacggcattccgcctaacgatgagaaggtaaacaccagccatggcccactgcgccacgctggtgcccaccgcagatccggtcacggaccagcccagcccgtacacaagccacaggttcaagacgatattgagggcaaacccggcggtggccaccaacagcggcgtccgggtgtcctgcaggccgcggaggaggccggttccggcaaaaatgagcagcattgccaccagccccggcatggaccagcgaaggtaatcgacggcgaaggcgcgaacctcgccttccgcgcccaggagtccaatgaggggatccgccgccaggaagccggcaacggcgaggagcacgccgagcagcagtgccagccacacgccgtcgcgcccggctgccagggccttccccagctggccgtcgccgatggcgcgggctaccgcgggcgtggtcgagtaggccaggaaaaccatcaggcccacagcggtatgcagcaccgccgatgccagccccaccccggccagctgtgccacgcccaggtggccgatgatcgccgaatcggcaagcaggaacaggggttcagccacaagcgcgccgaacgccggaacggccagccgaaggatttcgcgggcctgccccttgcgtggcgcagcggtggcgggggcaggcaggtaaggcacgctgccagcctaatcggccggccgcaggcagacggtcttgcatgacaagagacacattatgacgcgaatagttgactcttcaactatttcccagggacactggagccatgaatcagtcacgactcaccacgaccgccatcaccgccctccggattgtcctgggcttcctcttcgcagcccacggctggcagaagttcaacgaatggaccattgcgggcacgcaggcctcgtttgccaagatgggggttccggcagcggaattcgccgcaccggccgttgccgtgctggaacttgcaggcggcatcgccctgatcctgggcatccttacccgcgtggttgccgccctcctggccctgaacatgctgggcgccctcttcctggtgcacgccccggccgggctttttgccgccaacggcgggtacgaactggtgctgctcctcgcagctggagcttttgccctggccctgaccggcgccggccgcgcctcagtggaccgcgccctcttcggccggagtaactcaaagctcgccgtcctggcctgacccactacctccggccccagtccggaaacgtgcgacggcggatgggcaccttggtgcgcatccgccgtcgtccgttaaccggccgcaatccccgcaaccgccccagtcgccggaaccgtacacggtcgccttagcggaacggcgagccgagcgctttccggcgattttgccgctgccggtgacccgctcagcgcctgcacgcacctaacaatcccgaacatcaaacaccacaaagtcacgggaaagttgggaaaacgcttgccatcgctgcatccgggctgataaaccaagattgccgcagtgagaaccgcggcacccttcccaggtctcagccttccccgagtcagcacccggaacccttcacggtttatcgccgaccgacgcgccgccgcgtgtttgaatcgttccaaacatcctgggtccgccttaccaccgctcatcgaaggagatgttcgtgaaacgacccccgcacatgaccccgcgtccgcaggaggggcctccgccccgccgcaggctgccggctggcgcaaaagccgttacggctgccgttgcctctgccgccattgccttcacagggctcccggccgttcaggccgacactgccctcccggcggtaggaagcggcttcaagttcgacttcggccccggtgcgacggccgacggctacacgccagtaggcgccactacccagtactccgccggggccagcttcggcttcacggatacggcagtcacctccggaattgaccggggcaccggagaccccctgcggtccgactttgtgcaggcccagggaagctccttcctggtggacctgcccaatggcgactacaccgtcaaactcattgccggcgacgccgccgaagccacgaacatcgccatcaccgccgagaaaatggccaaggtccaagtcacggacaaaccggccggccagtacctggaaatggaattccccatctccctggtggacggccagctcaacctcgatttcagcggcaccgcggcgaagatcaactccctggtcattgcggcaagggctccccgcaccgccaccaccgaccccggcgtctacctcgccggcgactccaccgtccagacctacgatcccgggtacgtgccccaggcgggctggggccaaatgatcgaccgcttctttgacagcagcgtctccttcaagaaccatgccatcggcggccggagctccaagaacttcatcacgcagggacggctggacgagatcctccgcgtcatcaaccccggcgactacctcatggtccagttcggccacaatgacgccaccatcggcgtggacgaccgctacgcctcccccgccgattacaaggaatacctccgcacgtacgtcaacggcgcccgccagcgcggcgcaacccccgtcctggtgacccccgtgggacgccgggactacgacgaagccaccggcaagttccgcgtcagcttccccgagtacgtggccaagatgcaggaactcgcggccgaggagaacgtggccctggtggacctgtccgcctcgagccgcgcctactacgacgaaatcggcccggaggacaccaagtctgtcttcctccacgtcgatgccggcgtgtaccccaaccgccctaccgggacagtggacaacacccacttccaggaatacggcgccatccagattgcccggctggtggcgggcggcgtgaagcagctcagcgttccgctggcctcacgcgtcaaggaaatcgcaccgccgtcgtccgttcccgccaagccgcagggactggtggccggaagcgtgtccaacgccggcgccctcctcaaatggcagcccgttgaaggcgcggacatctacaaggtgtaccgcaagcttgcctccgagccggacagcgcctacaagctgaccaccacagcaacggttcccactgcaaaccttggcggactggctgagggcaccgcgtatgacgtccgcgtggcggccatgaacggcaagggactctcggagcccagcgacgcactcaccgtcaccaccaagcaggccaaatacaagttcgactttgggcccgtgggagctccggtcgaggcgggctacaccgaagtcaaccggaccatgggctacaccgccgggcgcggctttgggttcaaggacatctcggtgctcgccgaccgggaccggggagcggtgaccagcaacctcctgcgcgacttcgtcctcagcggctccagcttcgagttccagctggacgtccccaacggcacctacgccctgaagacctaccacagcgactggatcggctccaccaggaccgacgtcgccgccgagggcaccccctacggccaggtctcgtccggccgggcatcctcggcaaccaagatcattaaccaggtgctggtttccgatgggcaactgaacctgaccatcagtggctccggccagcggctcaacggccttgaggtcaccccgctgctcgtaggacccaccaacctgcacacaacgtccttggacgcggcctcagagccgcccaccgtggacctcgcatgggacgccgtggcggacgccgccagctacaaggtgttccgccaggcctcgtatgaggcagagccacagcttgtctccggcaacgtgactgccgcggcctttacggacaccacagccttcgccggcctgacgtacaagtacttcgtcacggccctggacagcaccgggctcgaatcggttccgtccaacacggtggagaccgccctggttgaccccaacactccggtgcccgccgccacgggcaaggtggacgtgaaggcggtggagaaggccagcgtcacgctcaagtggcagaaggtgtccggcgctgccgcgtacctcgtctaccggtccacctcacccgatggccccttcggctatgtgggccgcgccaccgaagtgaactacaccgactacacggtcctgaccaccatcaagtattactaccgggtcaccacggtgaacaagagcggcgaatccgctccctcacccgtggtgggaaccgaaaaggtcaccgtagtgaaccggcaaatggaaaacctggaccgggcaccggtggctctgctgaccggcgaaggcgtgcgggtgggctggcgcatgctcggcctggaccctgaacagatcggcttccatgtcatccgcgacggcgtccagctcaccgaagagcccatccgtagcaacaccacattcctggacccaaacggaaccgcgacttcccggtatgccgtcaagaccgtgggcaacggcggggaacagctcaccgccgagttcacgccgctggtgcagaactacctggctgtgaagctggacaagcccgcggatgactacaccaaggacgggcagccttacagctactccgccggcgactccagcgtggctgacctggacggcgacggaacgtacgagatcctccagatgtggtcgccctccaactccaaggacaactcccaggcgggctacaccggactggtgtacgtggatgcctaccgcatggacggcaccaggctctggcggatcaacatgggtcccaacatccgcgcaggcgcccattacacgcagttgctcgcctacgacttcgacggcgacggcaaggccgaagttgccatgaagacggcggacggcacgcgcgacgccgccggaacggtgattggaaacgctggagcagaccatcgcaacagcagcggctacgttctgacgggcccggagttcctcagtgtcttccacggggcaaccggcaccgtcatggacacggtggcctacgaccctccccgcggtgacgtggcagcctggggtgacggctacggcaaccgcgttgaccgcttcctcggtgcggtggcctacctggacggggaacgcccgtccatgatgttcagccgcggctactacacccgcaccgtgcttgccacctacgacctggtgggcggcaaaatcagcaagcgctggatcttcgactcggacgccgcaggcgcccagtaccgcagccagggcaaccacaacctgtccgtagcggacgtggacgctgatggaaaggacgagttcgtcttcggctccatgaccatcgacgacaacggcaagccgctgtacaacactggcctgggccacggtgatgccatccacaccagtgacctggatccgtcccgtccgggcctggagacgttcgcggcccacgaggacatgggggccagcggcaacaggggagccacattccgtgatgcgcgcaccggggagatcctctggagcatcctggccgccaaggacaccggacgcgctgccgccggtgacatcgacccgcgccacgcgggggcggagggctgggccatcggcggcgacgctgcctggaactccccggtaggcgagctgcgttccgcaaagggcgagctggtcgccaacagcatcccggcggccaacttcctggcttggtgggacggtgacctgctgcgggagatcgttgaccatgactggaacgcggcaaccagcaccggtacgcccagcatcgccaagtggaactgggagacggaggccagcgaccggctgctcacggccaccggtgcgaagtccaacaacggcaccaagggaaccccggccatccaggccgacctcctcggtgactggcgtgaggaaattgcgtggccgtcgtcggacagcacggagctgcgcatctacaccaccacggccgggaccgacgtccggctccggacgctgatgcatgatcccgtgtaccggctctcggttgcgcgcgagaacgtctcgtacaaccagccgccgcaccccagcttctacatcggtgtcgggatggaactgccggcccagccggacatcgtgtacacccgcgcaggctgacccgtcggatctgcccgctgccccgtccgccagcctggcgggcggggcagcgccatgtccggacaggttcggatgcaacccgccggtaacaccgggcgtcagtatgatcacagcatgaccgagacgcctgcctccaactcagtgacactccgctttttggccgctcccacggatgtgggccacagcggctccgtggacgccggaaccgtccttgagtgggtggacaaggccgcgtatgccgcagcggtggggtgggcgaagtcctactgcgtcactgcctacgtgggaaacatccacttcgccgatcccgtcaacagcggcgacatggtggaggttgaggccaccatcgtctacaccggacggtcctcgatgcacatccgcactgtggtttcctccggcgaccccaagggcggcccggccaccatgcgaagccagtgcatggtgattttcgtggccgtgggcgaggacggaaaaccgatcccggtcccgcagttcgaacccgtcaccgccgaagagatcgaacagcgggaccacgcgctggcacggatcaaggtacgcgaacagatcgtcgaagccatgagccggcaggaatatacggatgcgggtacggccgaacgggtcaccctgcggttcgtggctgcacccaccgacgtgaactggggcggcaaggtccacggcgggatcgtcatgaagtggatcgacgaggccgcctacgtgtgcgcctcccggtactgcggcatggacaccgtggctgtcttctccggcggggtccggttctaccgtcccctgttgattggccacgtggtggaggtggaggcgcggctggtgtacaccggcaccaaaggcatgcacgttgccgtacatgtccgctcgggggaccccaagagccgcgaaatgaacctcaccacctactgcctgacagtgatggttgcgcgcgacgcggatggcaactccgtacccgtacccccctgggtgccggtcagcgaagaggacaagagactgcacgcccatgcccgcgaactgctggaaatcaggggcacagccccgggaaaccggctgcccaaccacctgctggcccagggctaagcccggggcaccacacggaggccgttcctagaagccgccgccgccggcgtcggctgccatgttggcgaaccgtgagtagtggccctggaaggcgaccacgatgtccttggtggggccgttacggtgcttggccaccaggatgtcagcctcaccggcgcggggggactccttgtcgtagacgtcctcgcggtgaagcaggatcaccatatcggcgtcctgctcgatggaccccgattcgcggaggtcggagaccatgggccgcttgtcctggcgctgctcagacccacggttgagctgggacagtgcgatcacgggaacctggagctccttggccaggagcttcagggcacgtgaaaactcggagacctcctgctggcgggactcgacctttttgccggagctcatgagctgcaggtagtcgaggatcaccagtttgagatcgtgctgctgcttcagccgccggcactttgcccggatctccatcagtgacatgttagggctgtcatcgatgaagagcggggcatcattcatccggcccatggtggtggcgatcttggaccactgctcgtccttgatggtgcccttgcggaggtcctgcagcccgatggtggcctctgcggagaggaggcgcatggcgatctcgttccggcccatttcgagcgagaacatcactgtggccaggttgttcttgatggctgccgagcgggcgaagtccagcgcgaacgtggacttaccgacagccgggcgggccgcgatcacaatcatctggccggggtggaggccgtgggtgagctcatcgagttcgtagaaccctgtgggcacaccggtcatgccctcaccgcggtggccggaggcttcgatctcatccaccgtggactccatgacgtccttcaggacgacgtagtcctcggcagtgcggcgctctgccaccgcgtacacctcggcctgggcctggttcaccaggtcctccacctcgccgtcggagccgtagcccagctggacgatcttggtgcccgcgttcacgaggcgccggagcacggcccgttcagcaacgatctcggcgtagtagccggcgttggccgcggtggggacggtctggatcagctcgtgcaggtaggcagggccgccgatcctgtttatctctgcgcgctttgtgagctcatcggagacggtcacggcgtccgcgggctcaccgcggccatagaggtcgataattgcttcgtagatcgtttcgtgcgccgggcggtagaagtcctgaccgcggagaatttccacaacatcggcgatggcatccttggacagcatcatgccgcccagtacggattgctcggcagggatgtcctgcggcggcttgcggctggcttcagatccgcgggttgtctctaccggatccagatgcgcgattgacaaagctgccgtcctccatgtgagccggggccttggtggcaccggtggttaaccgtcctgctagggcgctgcccgaaagctgggctccgccacctgtccaggtgtaccagcggggtgtgacaatgctggggatccagccctgcagacggcgatttcgagagttatccccatatccacaggttttccacaatgggcctcttcttagggctccaggggttctacggctgctgttttcggcatccgtccgggaccacaggagccctgaaaaacaggtaccccgctacgctagtcccccctgcctcagtggcaaagtcaacaggcaccaggccctgtggaaaacctgtgcactaaggggcatagcttgtgcacagcctgtgggaaaggttgtggacagtaaaaaagtttcaccgccgctgcgccgctgacctgctaaaacactgccgccggcatgtggagtaaagatttattccaagtattttcatccacagcccgcggctgcgccagcggaggtaaacggccccctccgggggcgtgatgcagttcattgcccggcctctgcgggcgatcgctacccgggacccggagttgatgcccagagaagcgtgcactatgcgcagaggtgaatattgctgtggataaaccggatctggcataagctctatacatgggcgaactactgctggtactgctgccggcgattgtgttggtggccctcatttggggtcttgccacggccctcagtccgcgggatacgggcttgtccgatgccgagaaataccagcgtgacctggccgagcgttcagcgcagcactatgcggcccaggtccaggctgccacggcggcccgcgcacgcctggagtccatcacgcggccaagccaaaacacccaggcgatgcattcagatctggcccccgccaggaagtacacagaacggcgttagaaaatggaatcgcttgtggtccctgtcctcatcctcctggccgtggctgcaggagtcacgttggcggcccgcgccatcagcaggcgcaaggcctccgcgggcgccgagccgcaggcacccgcagccaactcggccgacctggcccgcacggcagctgccaaactttccgaggacgaacaccggcggctctacgccctgatcgcacagggccaggccatggcagccatcaagctgtactacgaagtcaccggcgacggactgcgcgcatcacgcgatgccgtaggagcgctggcagcacacccgcagccttacaggggcgcggaggcggcccctgccgaggttgaagacgacgatgacgagccgcagcggttcccctaccgttaccgtgccattgccagcaagggtgacgtgacccgcgaggtcagcagcaacatgctcaacgacgagatctatggccggatacgcaccctggcccgcaacggcgacacggaggctgctgcctcggcactcacgcggcactccgatatctccatgaagcaggcccgggagttcatcgaactgctggacgattaaggcctgctggccgggactgatgcagtcccggccagcctgattctgttagtcgatggcttaaccgaaggtgaggaccagcttgggtgcggccgcgctgccggtttccttggagctgaggtcaaggccgtcgctgctgctggaatccaggcccagcgaaagctcttggccgagctcacctgccaggccggccacggtgagcggaacgctgtagtcggtgttcgctgttgtggggccgagcgtggcgacgctggtgcccagagtggggcggttggtgtaggtgattccgccctcagtccagctgtcatcggcaacgagcttgacgttctgcgtacccttggacccgctcccggcgctgcgcagctgcaatgtcgcgctgtccagggtccggcctgcgtaggctgagaggtcgaacttcaggtacgtgacctcaatcgggctcctatcaacacccagcagggtactcgacccatagttcgtccgtgtcgatgtgcctgccacataactgtccgcggcggccgtgagggtgacggtttccggcgtcccgccgccgcccgccggggccgtggtgaacgtccaggcctcctccgctgccagcgggttgccggcaaggtccttcacaccggcggaaccgccctcgatcctcgcagtgtacgtggtgttggccgccaggtccgcgcctgggttgagcgtcgcaactttgcctgtgctgtcgagggccacggtggccgttaccgtcgtcgttcctgcctctaatgtgaacgtgcccggcttaacggtcaacgggtccatggcttcggagaacgtggcagtcacgtccgccgtcaccgccacgccggtggcatcctcaatcggggatgtgcccgtcaccgtcggagcggtcgtatcaccgccaccgccaccacccccgctggaatcgtaaaagtgccagtaccggctggtggcgttcacgtccgcgagcagcagcaggccgctgctcgccgtgccgcgtgccgcgctgttgaggttctgcttcgttgacgtcacgttgtggacatactggtcggcgtccactatccgggcagtcttagcgctgctgaagctgatgttgtccagcggcgtggacttctcgtaaatcgcgccgcccgaactggtgcagctaccagcgttcgtggtgccgctcggcttcggataggtagcgaaggtccgcagcctctgggtgctctcgtcaatcaggacgattacccggttcgggcactccgacacagtcgcgatcgtgtgcgccgaccacgtggtcccgttcaacgccagcaactggatcaacggctgggccgccgacgtgaacgacgtcttgatggcggcgaaaacctggcctcccgaggagtcaagccacttcaggttcatgtggtcgtcaccgctgcgctgccccgagacagccgctacaggtgtggtccagtcggtattcgaggctccgtcgacgtggtagctccagtacatgccgtcggaggaatcgtcgacctgccggctccacatcacacccatcttgcccggcccgaacgcgatcaccgctgacgagtcgtcaacagacacgttgcttagcgctgcaggatgcgggaacggtgtcccccacgtcgttccatccgtgcccgtgacattcaggtagatgcggtttccctgctgccaggtggcccacacccggcccgtcgagtccttgtcgatggacagggtctcgacgcggtagttgttgatgtttgtggagcttttcagcgagtacgtctttgtccccggatcgtagctataacgccgcatcgtcgaggggaagttgggctccgccggcaatccatcattgacgaagcggtagctcgccacatgcagcgttgcaccatcccacagcacgtcatgatgggtgttcgagcgggtatcggttgcaacgccggcatccgcccacgtgcttgtggcggcattgaaccggaagatatggaaatccgagctggcagtgtcccacaggttcccccaccaggacccgtcgttaaaccacaacgcactcgtcgcgcgcttggtcccggttggcgttcccgtccctgagtgcgatgggccctcgacccctacatcgccctcggcagcggacgcacccacgggcagcaccacaaaacccaggacaagcatcagcgctgccagcagtgcagtgagccatggggtccgcggccgacgcggacggccatcgttcgggcagccacctccccggcttacagcctgaatacgccgacctgtagcatgtccgcccatgtgcgctccccggagttaatcatcggtccccacgcccgttcagtgtcaaccgcggaagccttaattgcaacccccaattctgaactggacgctgtcggatcttgggtcggcccgccgtcacccgtttccggagattcccgccagcagctgctcgaagggaagggactccatcggggcgggcttccggcccggctggggcccctcgaggagccgcgtgaactcctgcgcagcccggccgatgcggtctgacagcgaagagccgccgtcgtccgtggtgccccaatcctgcggacccgcaaagacgcccgtggcaacaatcctggtgcgcaggtagctgaacagcgggcgcagggcgtaatccaggaccatttggtggcggtccgtgccgccggtagcccccagcaggacggccttgccgtcgagtgacttggggtcaaggacgtcgatgaaggatttgaacaggccgctgtaggacgcgctgaacaccggcgtcaccgcgatgatcccgtccgaggcttccacgccggttatcacctcggccagccggggcgcggcgtaaccggtgacaaagttgttggcgatatccacggccaggtcgcggagttcgacgacgtccacctgaacgctgaagcctgcgccggtcaggtgccgctcggctgcggcagccaactggtcggccagcagcctgctcgacgacggtacgccgagtccggcggaaaggactgtgatgcggcgggtctccatggcattctcctgttgctcgatcattccagcatatatgcatatgcatctaccttggtgaacggtgggagcttgtggagtattcccgctagagaagcactgatccccggatgcaggtggtggactgtccgcccacccaaatgtcgccgtcgtcggctttaatgtggacgcggcctgcgtggcccagtgccgtcccctgggcagccacatactcccgcggagcccggttgctgccgatcagccattgcgccgcacccgcattaaagctgcctgtgacgggatcctccaccatggcgccgcccggaatgaacgtgcgcacctcgaagtctgcgccgccatccgccggccccggcccgatgatcccgatcttcaggctgcccagggccgcgaagtcaggcctcacagccctgacctgttctgcggaacccagcagcacaccgatccattcggggccattcaccagccatgacgcatccaccacatcggtttcagccaggcggagccccgcagcgatccggctccggatagccccgtccactggaccacaacgggtcaagggaggagctgcgaaggcgagccccccgccgtcgcgcttgacgcggaccaggcccgcgccgcactcctggacaacgaagccgtccgattgcggagttcccccgcactcaagccacgcgtgggcggaccccaacgtggggtgcccggcgaaagggaattcctcactgccggtaaagatccggacccggtagtctgctcgcggatcggtagggggcagcaggaacgtggtctccgagaggttggtccagttggcgaactgctgcatccgctccggcgtcagcccctcggcatcaacgacgacggcgagcgggtttccgcggtaggcctcgcgggagaagacatcgacctggtggaacgggcggctgcgggctggaagttcggtgctgttcaccgtacgaagctatcaagcaaaagacccccgccgccggaatccggcagcgggggtcttgccagcagtcagggactacttgccagccacgacatcgagttcgatgacagcggcaacatcctcgtgcagacggacgttggcctggtaggaacctaccgacttgatgtgcgccggcagttcaaccttgcgcttgtcaatgctgccaaggccagcggcctcaacagcgtcggcgacgtcgccctgcttgacggtgccgaacaggcgtccggtttcgccagccttgacgacgagcttgaccggtttggaggacagtgcagcggcctgcttctgagcatcttccagggaagcgtgttcgcgggcagcgcgggcggccttgatggactcaacctgcttttcgccacccttcgaccaggtcagggcgaagttgcggggcagcaggtagttacgtgcgtaaccgtccttgacctcgacaacgtcgccagcagcaccgagaccggttacttcgtgggtcagaatgagctttgccatgttagttaatcccttccttagccgcggccagcgccggagtaaggcagcagagcaacttcgcgggcgttcttgattgcctgggcgatcttgcgctgttcctgcaccgtgacgccagtgacgcgacgggcgcggatctttccgcggtcggagatgaacttgcgcagcaatgctacgtccttgtagtcgatgacagtgatgtcagcggccttcaaggggttggactttggtttgggcttacggagttcagccttagccatcgtggagctcctattctagggagcccgtggatgttgatccacgggatggtggtggtccgacggcggcagtcacctgggtgcctggaggcacttcggctgtcccggcgtcgggccttaatgggtgtttagaagggaggttcggaatcggggccgttgccccagccgcctgcgttggagacgccgggcgttgcccaggggtcgtcctgcgcagcctgctggttgccgccgccccagcctccaccggagttgccgccctggtttccaccagagttgccgcctccgaagccaccgccgctgttgccgccgccgaagccaccctgggcgccgcttccggcacccccagcgccggagcgttgggtgcggttgaccttggcattggcgtagcgcaggctcgggccgatttcgtcgacctcaagctcgataacggtgcgcttttcgccttctttggtttcgtaggaacggctcttcaggcggcctgtcacaatcacacgcatgcccttggtaagggactcggcgacgttctcggctgcttcacgccagacagcggcgcggaggaacagggtttccccgtccttccactcgttggactggcggtcaaaggtacgcggggtggaagcgatggtgaagttcgctactgctgaaccggacggtgtgaaccgcaattccggatcattggtgagattaccgatgaccgtaatggtggtctcgcctgccatctactgcctccttgttggtcctgggtgaagagtgcgttcctgcggtaaagaatgaagaatcggtgctgaaattactcagcaacaaccttctgctcttcggggcgggtgatcttggtgcgcatgatggtctcgttaagagacagctggcggtcaagttccttggcggtgtccggcttggcggtgaagttcaccacggcgtagataccttcggacttcttcttgatgtcgtaagccagacggcgacggccccagatgtcaaccttttcgatggttccaccatcgttggtgatgacgttcaggaacttctgaagcgacggctcaacggtacgctcttcgacctcggggtcgatgattaccatcaattcgtaaggacgcatatgtgaacccacctcctttgggctaagcggttacggcatttccgtaacaggaggttcatttgcgatgccatgcaaggccccaccgccggaacggaggcaggacgcagcacagacttcaatatcttagtgcatctggaccggataggcgattcgcgcttgactcaaggctatggccctgctggcaagggcggcagcaccagtggctcctatgtggaaaagtgcaaccggcgggcccttcctgatgaagaaccgcccgcaccggcgagccaggtgcggctgcgggtacggacggttcaatgccaagcgaacggacaaggaaattacgacgccgaagcggcctccacagccgattcccgggtttcgccctcctggggctccccgccaccatgacgcgtaccggacttgcggtagcgccacacgccgacgccaaccacaacagccgccagggccacggacagcagcagggactcgcgggtggactccaggatgaccatgccgatgagcagtgccacgatgctgacgatggaaagccacgtcaggtaggggaagagccacatcttcagcgcaagatccttgcctgccgcacccatgcgcttgcggaggatcaactgcgaggacgcgatgaccagccacacgaacagggcgatggcaccggaggtgttgaccaggaagaggaataccgtgtcaggtgcaatgtagttcaggcccacggtcacaaagcccaccacggtggaggcgagcacggcagcggcggggacgccgcgccgggagattttggtccacgcggccggggcatctccccgcctggacagtgagaagagcatgcggctggcggtgtacaggccggagttgaggcaggacaggacggacgtgaggaccacgatgtccatgatggtcccggcgcctgggattccgaacagttcaatgactgcaacgtaggggctcttggcaacgctggcatcattccacggcagcagggtgacaacgatggcgatggacccgatgtagaacacgaggatgcgccagacagtggacttgacggccttcttgacggcgtccaccgggttctccgattcgcctgcggcgatggtggcgatctccgcaccgaagaaggaaaagaccaccaccaggatgccggccagcacagcgcccggtccgttaggaaggaacccgccgttgtcgatcaggttgctcagtcccggggcggggacgccggggacgaaccccaggatggcggcggcgccgaagagcaagaacagcacgattgcagcgaccttgatggaagcgaaccagaactcgaactcaccgaaggacttcacggacccaaggttggtcagcgtcaggagcaccatcaggatgagggcccagatccactggtcgatcccgggaacccagcggtgcatgatggcggcgccggccgtcgcctcaatgcccagcacaatgatccagaaccaggcgtacagccagccgatgctgaagccggcccagcggcccagtgccttgtcggcataggtggaaaaggaacccgtctccgggttggctgccgccatttcaccgagcatccgcatcaccaggatgaccacgacgccggcggccatgtaggcgagcagtatccccggccccgcctgctggatggcggcgccggagccgacaaacaggccggcgccaatgacgcccgcaatcgcgatcatggacaggtgccgcggcttaagcgacttggctaattgctggtcagcgggcatgggagcgccgtccttcggtgattatgcagatgggattgtcaggcaggggattgccggaaggattgaggaccgccccattcagtggggccggtcacacatttctctcactgtagatggcaccgagaagtggatgctctgtgcatcggcacagccttgggctgcccaattttgaccatggcccaagtgcgagtactcataagcatcgggagagtcctcccaggcaacaaggaaacacggaggaaatagtcttcagccccgtatcccctagtggttttccgccacgtttcccccattgcccccagcaaattttgaggtctacattggctccacccgcactaaagcgggggacgccagagcagcggtacgccgtcaaggactacctgcgccaccaaggacctgaatatgcatacagcaaaagttcgccacctcgttccgcaagccctggccgtggccgttgcacttgtcctgggccttatggcggcaggcggcacagcccaggcggctgagaattacggctaccagagcatcagttactccggggttgccaacacaccgacctccgacaagccgcagagcaagctgtggtggaacgacggatcctggtgggcagatatgtggaccactggaaccgggtggcaaatctaccggctggacagggcaaccaaaacctgggtgaccaccggggttacgaacgacacgcgcagcaacacattgtcagacacgctgtggcacggcaacaaactgtacatcgcctcccacgtggtgacagtttccggggactccggtgcaaaagcttcagtctcagggcagcccgccaagctttacaggtacagctatgccgccggaaagtacactctggacgccggctttcccacaaacatcaacaacaacagcagcgagtccatgacaatcgacaaggacactaccggtgctgtgtgggcaacatggacgcaggtttccgggagctcaacctctggcttcaccagcagcgtctatgtgaactcgaccaccccggacggagccagctgggggacaccgtttgtcctgccggtcgccgatccgaacccggcgccggatgacatttccgcaatcgtcgcttacggaagcaacaaaatcggggtcctgtggagcgatgctcccgcaggaaccgtgtactgggccacccgcacggacggaacctccccctcggcagcatcatcctggaaagtccagcccgccgtacagggcaaaggccaggccgacgaccatttgaacatcaaggcactcctggctgatccggcaggacgtgtttacgcggcggtgaagacgagcctggattcgtcgactgacaagacgcttccgcaattgcagttgctggtcttccggccgggaaccggttccttcacgaggtccaccattgccactcttgccgattgcgtgacccgtccccagatcctgctggatacaaccaacaacgtggtcagggccttccacactgcaccatcaacgtcggcctccggctgtgcatattcaggagtccccggcagtatctatgagaagactgcatccatggacaatcctgtctttggcagcggccgtggcactccggtaatccaggacggcgcatctgccaatatcaacgacgtcaccaccaccaagcagggcgtcaacgccaccacgggtgtagtcgtcatggccagcaacaaagccacccagcgctactggttctccgaccggtcgcttggaacggcccctacgccgggtgatacgacggctccgtcagtgacgggcacgtccccggctgagggtgctaccggcacggcagtgtcgtccaacgtgaccgccacgttctccgaagcgatgaacacctcgaccatcgatgcgaacacgttcaccctcaagacagggacgacgacggtaacggccaccgtgagcctcaacagcacaggcaacaccgcaacgctgaaccctggcacggacctggcagcaggcaccgcctacacagcaaccgtcaagggcggctccaccggggtgaaggatgcagccggcaacgcgctggcctcggacaagacctggaccttcaccacggccgccgccagcggcggcacgaccgagaccgttaccctcgcggccggcgctgacagctatgtatcggccggggcaacggggacgaactatggcacgggcaacgtgctgggcgtggacgccaacacagaggaagtcacgtacctgaagttcgacctgtcggcgtacgcgggccggaccgtggacagcgcaacactgcagctgcgcagcgccggcagcggatcgacaggtaagcagaacgtcaaactcgtcacgaatgacagctggaccgaaaccggaatcacctacaacaaccgccccccgctcggcaccagcatcgccacactcggccccacagcagccaacagcaactacagcgttccactcaccgtcacgggcctcgccggcgaactcggccagcaactctccctcggcctggacgccaccagcaccgacggcctggacctcaactccagggaaaccggcagcaccaccgcacccaaactcgtcctcaccctctccagcggtggcggcagcggtggcggcagcggtggcggtgatacgacgcctccgtcggtgacgggcacgtccccggctgagggtgctaccggcacggcagtgtcgaccaacgtgaccgccacgttctcggaagcgatgaacacctcgaccatcgatgcgaacaccttcaccctcaagacagggacgacgacggtaacggccaccgtgagcctcaacagcacaggcaacaccgcaacgctgaaccctggcacggacctggcagcaggcaccacctacacagcaaccgtcaagggcggctccaccggggtgaaggatgcagccggcaacgcgctggcctcggacaagacctggaccttcaccacggccgccgccagcggcggtggcggcacaccggaaaccgtcaccctcacagcctccgcggacagctgggtggcgggtggagcggcagcaacgaactacgggacgagtacctcgctgagcgtagacaatagccccgtggaagtcacgtacctgaaattcgacctctccgcttatgcgggccggaccgtggacagcgcaacactgcagctgcgcagcgccggcagcgggtcaattggcaagcaaaacatcaaactcgtcacgaatgacagctggaccgaaaccggaatcacctacaacaaccgccccccgctcggcaccagcatcggcacactcggccccacagcagccaacagcaactacagcgttccactcactgcaagcgccctggccggcgaactcggccagcaactctccctcggcctggacgccaccagcaccgacggcctggacctcaactccagggaagccggcaccaccgcacccaaactcgtcctcaccctgagctaggccagggtgagggggcccggctgcaggtaaccgcaatttccacattcttacccccgggcagccacaagccccccggcttatcggaccccggcgtccggcctcgtactagctttgcaacacgccaaagcggcacagagacacaggaaacccgccggaaaaggggcaatcatggcagaagaaaaggtctttcgaatcgacccggccgcaccaggcccttccgtcgcacctgcccattcagcacgtcaacctgcaggagggatcggattcttgagtaatcaggatattggcggcagcgacgtaccagctgccgggatgggactgagggactacgcccgggtcgcgaggacgtactggaagcacattgcggttgtgaccctgatcgtcaccctgctggccacggcgtggagcacattccgcccccgcatatacgccgcggaagccagcgcagtggttctcgcggtggggaccgacaacgtcagcagcctgctggccggcgacaccctggccaaagcgagggcaaagaactacaagtccttggctgaatcccggctcgtagcggacaacgtgcgcctctccactgggctgaacatgtccagtgacgccctgctgggtgccatctctgttaccgtcccccgcgatacagctgaaatccggatcacggccgagtcgccggatccgacgatcgcccaacgggttgcggacgcgtggatcgtcgagctgagcaagcaggtccaggacagggagagggccgccacagctacttcaggccagcccctcgaagccgtcaccccacccctctccctggtaccactggatccagcggctttgccaaccacacccgtttctcccggagtggccctgacagctgtatacggggcagcattgggcctccttctggcctacgcatccgcactccttcgcgaccgcctggaccgccgcctgcacaccgcagctgaagtggaacatctcttctccgtaccggtcatcggcgccctcccggtcgacctccggcttacgggcgagaacaaagtcctgggaggcgtccccgcagctccaacgcctggttcacgggcgcagagccctgccttcgccgaggcgctccgggaactccgcaccaacctgactttccttgacgtggacaacccgccccggatcatcgtcgtcacgagctcggtgagtggggaaggcaaatcaactattgccgccaacctggcctccgcgatgtcagctggaggagaacaggtcatcgttgttgacggcgacctgcggcaccccagcatggccaagatcttcgacgtaatccctggcataggcattaccgacgtgctcactggaaaagcagaggtggacgatgttctccagcagcggagcgacctgcccaacctgtcgattttgggatccggccgtatcccgcccaatcccaccgagctcctcggctcgcatgccatgaagcagctgatcgaatccctgtccgaaaaaggcatcgtgatcattgacgctccgccgctgctcccggtgactgatgctgtgctccttgccaggatcgcggacggcgccattgtggttgtgagggctggccggacaaccaaggatcagctgaccaagtcgctgggaaacatccggaaggtgcatggagccgttcttggcacgcttctcaactgcgtgccggcaaaggagtttgacggctactcgtactactcctcggatcctgactctgcggacaacgacccatccgaggacgcggacgactcacctgtagtgattgagcccgaaagcccccctgcattccgtggttccagcagggaacagacctcgcggagcgtcacctccttctaggcacccatccaacgccttcagctgccatgtgcgccgtatccgagccaacccggtcacgcgcgcaccggccgacacactcatctaggagaacccatgtccaagtctgtcgtcgtcatcgggacacgcggctacccaagttactatggcggctttgagactgcagtccggcgcctggcaccattcctcgccgatgccggctgggacgtcaacgtctactgccgggcaggccaaaccaaggacgacgacgaggcacgcgacccccgcatccgaaccaccagcacggtggggcttgagagcaagtcgctgagcaccctctctttcgggctgtcttcggtccttcatgccctgtggcacaagccccaggtggcgctcgtcatgaacgtcgccaacggcttcttcctgccgctgctgaagcttcgcggaataccaaccgtggtgaacgtggacggaatcgagtgggaacgcgccaagtggaaccggttcgcaaagttcgtcttcaggctgggcgcccggctgacggcccgttatggcaccatcctgatcagcgactcccttgagatccagcgccgttggaagcgcgactttggccgcaagagtgtcttcattccgtacggcgccaacctcgccagccccagcgaggttgttcccggcctcgaaccggagtcctatgtactcatggtggcccggtttgttcccgagaacacggtgtctgagtttttccaggcagcggaacgcctggcggagcaacatcctgtggtgatagtcggatccagcggatatggcgggccgctggacgaggccgcccagcggctggctgaacatcccaacgtccagtggctcggccacgtcagtgatgacaagaagctcctctcgctctggcatcatgccggagcgtatttccacggccacagcgtaggcgggaccaatccagccctggtacaggccatggcctgcggggcacctgtcgttgcccggcagacgccgtacaacgctgaggtcctgcgggcggatgagcacctggtggcaccggatccgcttgctatcgagagtgctttgcggcgcatgctgactgaccacgacctgcgggcgaaggctcgggcagcgaaccaggcccgcgcagccacccattacgactgggaagatgtgtgcaggagatacgaactgacgcttcaggaggcggtcctgggcgaaaaggcggccaaaatagccagcgaggtgaggcaatgacatttggactgcgcaccagcgctctcaattcggccggacctaaaggcagcggaaccccccgcatattggttgtgaatccgttgggagtggcattaagccactacactgacgcgcttttgcatcagttagcagatgccggaatagaaacagaatcattttccatcgccgaaccttcccagtccggtaaaagccgttttcaatggctcggcgcatatacaactgtgctttactcagtgggacaacggacgcggaaaaggaattcacctgaaagggtcctccttacgtggccggtattgggtttcctggacctcctgatgatgaaagtcctttgcggcaactcaggggccatcgtttaccacgatccgcaacccctcgtccggtccgttggcagcagccccctggtggcgggcctcgtgagacgcatcaaaaatcggcccggaactctggtacacagcgatgaagctgcccaagccatggacgccgtcgggctcaccgacggcctggcgcaggtgccacatccgatgctccccccagccggtgccgcccaagaccccgcatttggcgggcagtcagggaaaaggccgcgggtccgcgtgctgggacagtacaaagccgacagggacattgacctcctgaaatcattggccggcaggctcggcccgaaatgcgacctcgacatagtgggccgtggctggcctcccgtcgagggttggcatgtcgatgcccgctttgtcccggaagatgagctggaggaactgatcgtctccagcgacaccatagtgatcccctacaagcgcttctaccaaagcggcatagccatgcgcgcgcttgagcacggcgttccgatcgtcgggcgcgtcgggacgagcctcgagaaactgtacggagcgcaatcacggcttttggtcgcagcggaccagatgctgcccggccaggaggtcgaagcctgggcaactgccgtagagtacgcaatgggccagggaagaaccgaaacggtcctcgctgccaaactctttcatgaggaggcgtccgagagctggcgccttttcggccaccgcatgctggccgaaggatccgcccaaccttccaagggctgacctggccttcccatcgtggccagtgacggcactgtcaccgagggcatgtacccaggccacaaaatggcccgacgacggctgtacggttctcgagttgcgctccaggaaagcggcacttgaatgggctgcgaagatcgccgccgcctgccgctgcccccaggaggtccggcagttccagtacgatcccgagagctgacgggggcaacctcctcagcaggcctgttgtgcgtcagcgagcccgccgtgcggtcgcggaccacccatcctgaaagcgtgcagcagccctgcaggcgcgtgcagaggcctttcgaaacggaggtttggactccccctgcactgccgtgccggcgaagctggtgccgccgcatgccgcgacccagcttcggcgggctcaccggcgcgacgtcgatcgtggcaacggcggccgggacgggaagcgcgaacccatagccgcaggcacgggcctcgcttccggcttcaggggtaccgccatggccaccaccgatcccacggtcaaccaaaggacgggggtggatgccatggaagaggcggactcggaagaagcgaccgtgagcaggaaccccacggccagccatacgggcaggctctgggtcctcggaacacggcggaggagtttcccgaggtggatcaggagcaggagggcggcagcaatcatgggccagccgatccacgcgaaatacagccccaacaggctttcactgcccacaccggtggacgcgccctcaagcgccgcctggtatccggtggtgccaaaacccaggcctccaggcgactgcaggccaagcataaatccggagaacaggccatctgaatggctggcggtgttgccttgctccatgaaggtggcaagcaggtagccccccaggccagcgcccaccaggatgccggcgtacttcccgatcctggtccagatgaaatagatcacggtgaccacaaggaagagtaatatgcccgcccgggcatatgcgaaaaagagggttaggccaatggcggcaagcatcccgagcctcgcgaagctcctgagccttgctacggcagcaaaggctccgaggccaagcaggaagcccatgaccggtgggttcatgaaggggccgccagggcggaaggcgagttcaccattggataccccgtccgcgaagtaggcgggcggcaggcccatgcgcatactgcgggggttcccgccaacaacgttcacgtggtaccaggccgggtccaggaggggcgcctgcatgacttcctcggccagggcccatgccacggtcagcgcggtcaacagcagcaggtaggtgctgacttttcgccatttaatgtcatcccggtagacgaagccggcgaacaccaggccaagcggcatgagtacctgccgtgcctgggcgatgccgatgtccgcatccggtgatcggataaaaccaatacccaccaggatgaccagcagcagcatcagccccagcgccttgtgcaggcgcttgtcctgggagctgaatgccctgataacggcggctgcaacgagaaccgcagcgggcacgtcatccaggtactggaatgcgtcagatctggtgagggtgatgagcggcgcctgcgaccagccggccgcaatgaccagcaggatcaccacgtggtaggcacgtcccatgatcaggacgaagctgatcactgctgaagcggcaacaacgaaaggcagtagcacggggtggtcgttcctctccagtatcgccgtaacgcgccggacctcgaacccatccggtcccacatatgtctgccggtggtatcactggcgtcgcgttccgacgggcgtccgtctttcctcacggtaagccgggcggtacccggcaacaagggaaacgtcccgagttttgcgggtacccgcagcacctctgtggagggccgtcgttctacagcggtaggcggttggagacgacgggtcgtccctccgaagaggtttcgaccgcatctttccaataggaaaggaacggcgcagcagccagagcgactgtccgcccattctgcagttccgttatctggcggtcgaggcgttcaagctcggcgggagttgtgatggtcctgtgggcaacctctgccaggtcccggacagaagcggggacaacaatcagaccgcccgccttggaggcttcccccagcgtcccggagtcaaaaccgatcacgggggtacggtatgcgaacgccctcgaagccaccccggaggcaggcaaaatgctgccgtaaaagcggctcgtcttgtcgtacggcaggaggatggccctcacggactcaaagaaagcgtcctcctgcggcccctcgaccgctcccaggatggtgactcccgggagcggcggcagctgttcggtgcccctgccggcgacgcggatttcgacgtccggcgggagttcacggcggagctccacgagcctgtcgaaccctttgcctttggacgcgtgaccgtagaggcctaccgccagcggacgctgcgaagcaggctttagggcgggccggggcggcacaaagtgccaggtgctgagaaccgtgcaggcgggaaaggtctttctaagcgctgccgcgccgacttcactgagcgcaaacagggtggtgtcccctaacagccaccgttccagccgggcactgacggggcgcagcggaagatggatgccgtggtgaagcagcttgctcctggccacccacttgaagcggaagggccaccacgcagccagcgggggatcatgcacggtagccgttgtggcgatgtcgcgcgagcggcccgccaatagccaaaaagggcccagcgacgccgctgacaactcgaagtgaaccaccacccggccagcagcgagggattccttcaccgccctggagagctttagccggtcacggaagacatcaaggagcccgacgttgcccggtcctgcggtcctgatttcacggaatgcggagaagttgggcatagccgcggcgatgaactcctccgcatagtcgccgactccccccgaacccacacggggtgccaccagaatgagtgttgcgggaattggagaagtattaggtacaggaactgcgtctgaattagccacgttactccgcttttgcaccaggggacgaaaaattgggcggcacggcactttgaaaactccatagaggattcgtccggccttgactacagtatgcatcagcaaccgggggacgtaccgggaaattgaggaaacaattcgttttccagcttccagcatccggaacgctccaaaaccgggctccagatgtgcgggcacagcctttagctcaataactgctcaattactgcgaattcctcccaacgggccgcacccagacagtaaacttttgcaataaggccacaggaaggctccaacccatgacgaacgttgctggtggacttgcccgtgtcggcttccggggagcggtctggcaggggcttgccctggtgggcggtaaggcgatcgtcctcatcacgacgatcgtgctcgcacgcctcctgtcgcctgaacagtatggcctcgtggccgcggcactggtcctcatggcctacgtcgagaccgttgccgacgccggcgttgcacaagcgctggtctatctgcctccttccggcgtcgcggcccgttcggcgctgctggcttcagtggttctgggcgcatgcctggcacttttgacgttcttttcggcgccatggatcgccgggcttttccaactgccggacgttggccccctggtgcaggtgctgtccatcgcagtcctggcaacgtcgctgggagcggttccggaagccctgctgcgacgcgaccttttgttcaggagactggcggtggccccgattatccgggcgctcgtcacaggagtgctcagcctggtcctcgccttcgcggggtatggtgcattctcgctcgcggccggcaccgcggcaggggctgttgcgtacgcagccacgtgctggtggcttgtccgcaagggcgctccctggcagatctggcgcgtggccaaagacgccctccgggcgaacctcaagttcggcgttccggtggcgggcagcaatctcctggcacggctcatcttcgacatcgactacgtcatcatcggcgtgatccttggggcccaggccctgggttattacacgctggccttcaggcttccagaagccctgatcatcaacgtcttctttgtgctctccacggtcctgttcccgctttacacccaggtgcagcaccagccggaccggttgcgtgacggctacttgaagggtgtccgcgtacagtccctgtacggcatgacggcgggtgtgggcctggcagtgctggcgccgatcctcgtcccgctggtctttggcggccaatggtccgagtctgtcattccgctcgtgttcctcgccctgtatgcggcagcacgctccttgggagccggcgcgaacgacgtctacaaggcgataggccgccccgggatctcgatcacattctcagtcattcggctggctgtgctggtgcccgtcctgattgtggctgcccagtgggggatcatcgccgttgcatgcgcccaaatggcaacggccctgctctttgccgtcgggatgcagactgtagctgccaaggtgctccacatcaaaccaaaagcaatgctgcgtgctcttttgccagcctttgcctgcagcgtcgccgtggcgatggctggatcaatcatgttcctgcaaccctacttgggagctccgctgacagcggcgctggtttttgtgaccgcaatagccgccgtatacggcgtcctccggttgggattctcaaccctgcacaatgagctgctgcacctgcttcggcgcaattagggagcgggagcagaagtacgacgacgggcagtgcgggaggtgcgcagccggcgggtggccatgtgtcagggcgtgcacgggcttttagggcacgcgcaacggcgtccaaggtttgagcacccgtccacgcagagggacacccgcctaggctgcccgcaccgcccagtcggtgaccgcatggcgccaaagccagaagtcgcggtccgctgtcactgcggcctggacgtggccggtgtccccgtcatgtacggcctggccggccaagcggtaggtcattgtggctgctgaacgcgcccacgttgcgatgaccaggtagggaagcagttcgggttccacgttccgcagccgcagatgttgtgccaggggtttcagggcccatccaccgggactgaaggcattctcgaaggctcggagctgacgccggcgggaggacaacgcatcttcctgcgactggccgatgtactgcaggaagaaaatcaggtcatgggcgggcaggccatcaaggcgcgagcgttcccagtccaccacctggaggcggccgttcggctgcaggaacaggttctggtagctaaggtcaccatgttccacaactgcaggaagctgctcggtccgcattggcgccaacacctcgtgggtgcggtcgatcagccgggccacttccgtgtcagccggcagcaacgatgcgagttcggccaaggggctggcgatggtccgctggtaccagtccgcattttccggtactggcttggtgcagggcagcgcagcgacgaagttcaggcctgcgtcaagggcgcgggggaagtcctgcacaacgaggtgcggctccagcaggctgcccaccacggcagtctcaatcagcactgtctgccccccgacgtccagcactcccacaacctccggcgcgccctgttcggaccctactcccagcgacttgagctgcagcagtacatcggcttccttgcgcacgctttcgttgtccccgggctggcgggggatcttgaccacgagccggggaacctgggcgtctgtggaaaaaatgagggccaccacgtggcgtgacgtgacaaactgcggcgtcagcaggagtgtgtcccattggccggtgaggccgaacttcttaagctcgagcgcccggtagttatcgcggaggatctggtcaataaacttcacagcaactcctgccggccggcttccggtgcccgtcgaccaacaacggtgccttccgcggcggccacattgaacatgcccaaattcaacgcaagccttccgattgcggccttggcttttccaaagcgtacgcccgaataatgcgcgagggtatcctggaccgcggtcctcgacgccgtgggcacaaagcgtgctggccgttcgagtgttggcacatgccagtagaccgccacgtcaccgaagcccgacctctccaatgcccgcttccaccctgcgagggtgtatgggcccggacgggaacccactgagcgccttacctgcaagcagatccagccgcctggccggagggacgcggcagcgctggcaaacaggcgcgcgtccggttcggagagcaggacgacgtcgaattcgttggctggggcgggtccgggagctgcctcgatacgccgcgcggacggatccagcaggctgattgccgccaccgcgtcgctgctgagcccgcctccatagccgagcttctcaggttggcttacgggaagcaggaagcgccaatccagcagcgtccacagatgcagggggagcggttccgtgccggcttgatcgtccatttccttgggcgctgcgacgttccacaagagcccgctggccttcactcggacctgggactctgattggctggcatccaggacgtgcgctgagggaatttcctcggccagctccagatacgcttttcgccactcctccagtttctggggagtgtgttcacccttcctggcaaacatgacctcgccggggacgtcaaggaccaggacgaggtcagggagtggctggaaccgcagggccagcgcatccgtcaacgcagccaggcggctatccgccctcgaaccggggagcaggacatcgaatgcgaggcggtccatcagtaccacgcggccccggagggagtagtacctggcggcaagtccggcgcggaatatccggaataccttcctgaccaggaacccgccgcggatcttctgaagccaacggtccaggggactgctggaccacagccccatgtagacgtaggcagagggcagggggcagctggagcgaaggccgtggagcagggtggtcttgcccgccccgtcgggggccagcactcctgccaccggtccgcggcccttgagcttggggccgacccgcctcagcaccctgttgcccgagctggtaagccacggcggaacccttgtaccggtccaacggcttttcaggtcagccgcggtggcagggacgtcatcgaaattttctgactgcagcaggttgagaagctttcccgctgttccggtcccgaatttccggtccaagaacagggctatcgggttttcggccgtcgccacggcagctgcggccccggctgccgggaccttggcgggagtaattgcacccttgtcgagcaccaggtgcaggatgtggagccaggcctggtcctggatttcgggcagccacaacggccccaaggccacacgccgcttgaggcagtcggcggccagtgcagtcccgagctcctggaactgcccaaaactgatgtccgaaaccacgtccagtttgatccaaagatcctcgtcggcgaggtaacggaagtagaagcggtggctcccgtggcccagtgctaccacgcgccggaaccccacaccggcaagatggcggtccaggccgggcaccagttcagcggaaacaagcaggtcaacgtcccccgccggccgcaccaggtcgtcctcaccccgcagcagaacccacggcagtccggatttatcgagttcccggaacacggtaatcagcgccggattaacctctggaatggcgcctgcattaatgccatgtggatatttgctggcaaattccgactcagaataggaaaccggaagtcggggggaatttgacaattcgctcaccacttcttgatagttttgaatttcgacggcgcctgtccgctgcacgcaggcaaggcaccgctgatccgatggcagtcccgagagcctaccccctacctaatggggtggcacgagtagtgggtactcacattttctggcccggaatccctgaactacgtaggtaaagggcatcctgctgccgtctcggccgggcataggtagcccgccggctgtcgtgggcattaggtaggggaggtagaggactgcgggccattaggtaggtagggcattcgctctcctcttgaggaaaagcaggggtgatcttgatcaaatactaagtgaacgatatatggcgctttgcataaattcggggctatattcgcttaacggctgggaaccgtgctggaggtgcaagccgacagcctgccgacccaatggttatatccgtaaccggatggcggcatgcagtactggacaactactaacgaaagaatttggtctccttcttcgaggattggggacccatgtcattgttagggcgaaacaaggagctggataggcttctttcggtgatccgcggtcccaaggacacggccctggcggtgatcggtggccacggggttggaaagtcggccttgctttcagaaatccccacgctttccgactacaaaaccgtcttcctcggagcaagcgcgttcgaatccgactggccgttgtccggtgtcactgccctcctcaacgccatggatgatcccgtactcaacagaattgctgatgagctcctgcgcgacaccgccggatccctggacgtgccggccatttcctcaatgctcctcaacggcctgcaccagcgtgcatcctcccggactgtcatcgttattgacgacgcagaccagctggatccgggcagccaggctgttatcggtttcctggcccgccgcttgtccggaacggacattgccatgttcgtctgcctgcgtgacgagacacctgacagccctttcagcggcctggccgtgctgcacctccaggcgctgagctacagcgataccgtgcggatgcttgaggcaatccccgcacggcaaaccacgacggcggccgcccacgcggttgccgcagcaacccgtggaaacccgctcgccgccgtcgaactttatgcccggctgctgggacggcaggcggagggaaagttcgccctcccggttcccctgcccggcaacggcagcttcgaggcggagttcgccttggtggtgggcggacttaccgccccggcacggaacgtgctggatctcctgtccctctcatgccggagcgacatcaccacgctggaaaaaatcagcaaggacgtgtggaccggcgtggatgaactgctggcctgcgggatcgtgcaccgcactggcccgcaccttgcaatccgggaccagctgcttcgcgggtacgtctttggcgccatgacgccggcagtccgaacggccaaccaccgggcattggcggacgcgtgccaggacactgacccgtacgcccgcaggtggcatctgagcttcacggcgctggaacggcagaccccgttcggtttgctccgccatgccgtagacctgatccggggcggcgaactgtccttcgccgtggagtacgttgaacgcgccctgaccatcaatccctgggaggcggaaactgcggcacgcctggcggcgatcgctgaactgctgttcaaccggggtgagttcgtttacgcccggcgctacctggagtgggcacagcgggtgacccggaatcccgccttgatccttcggctgacagggctctccttcgaaatcgacttcatccaggggggagcagtccggtccagcatggtgctgcgcctcgtgaaggaattcggtcagcacgatccttccttcgccgccaatctcctcgccgtcgccgcggtgtattacgcggaacgctgggaattccaggatgcgtgcgagcttctccagtacgccggcaatttccaggaagcggcatcagccgaatgcctcgagctcacggagcgtgcccggctgctcaccgagtccaccaacggcgacggagtccagtccggacgcaagtacaccctggagggcggctccgtggccggcctcctcatccagggccgtgccttcagctacgcggagcgctacgaccaggcgcaggagctctttgccatggtgcggacctctacacgggacgcccacgtgaactggcgggaaaccgccctgttcctggctgtggacaacgagatcagggccggaaacgtccggacggcgagcaagctgatggatgatcttgaactttttgaacctgagttcaagtaccaccgcggcctccgccacgttttccgggtctggcgcgcccacgcgctgggggatgaaaccctcgcccacagttacgcggctgaggcacaacgcttcgccggcgccgaaagccacccggccatcaccgcccagcttgctgcgtggcagggccacttcgcacttcttcggggtgacctggcagaatcccttgcccagctttcacgcgcggctgagattggcacaaaattcaccaatcccacgttgctgcggtgcgatgcggacctcgtggaggtactggtccggctgggacgccaccgggaagccacccaggccctcctcagcctggagagccgttccgtcgggttacgctccccgtggctgatgatggcggttgcccgcagccgtgccatcctggcggacggtgagcagtcgctgcaattgttcggccaggccctggacagcaggaactcgcgggattcgttgcttgaacgggcaaggaccatgctttgttatgcagaacggctgaaggcacttggccgcctgcgggacgcccgcgacggtcttctgcgggccaaggtcatgttcgacgaagttagtgccaacgcgtggatccagcacgtggacgcgctcctgctggacgaacgggtggaagcaccaggccctcagggaaacccggccatgctgctgctcgctgaccacgaacgcgtcctggcaagaatggttgcccggggcatgcgcaacaaggagatcgcatccaccctcttcgtttccgtgaggaccgtcgaggtgcggctgaccgccatctaccgcaaactcggggttgagtcacgcgcccagctgactgccctggctgccagcaaggaaaagtcagctcctgagccgtacatcctgccggtcctctagtgccggctgcagctgctgcagctacccgcattatccacaatattccttcgcgggacccacaaagggcccgcgcaaaccctccgcaggtggctttccgtgactaattttgcttcacggcaagagcacaagcggacataccggaaggggtcaccatggcagaagcacccgtcaccggacagcggcgtcccatgctttacgggaccaaacgctcagcgcttaccggcagcctggcaggcgaacgccctgcctttgcgggagacggtcctgccccgggagtatctcccggttaccgccccgccgtcagactcgtccccccggagcagggccgtaaggcgtcctccgcggactggatttcagtccacatcaacctgttgcgtgtcacggactcgctcctgatcgccggggcagtcgctctcggctaccacctcgccagtccagggcttctgagcaggacatcaacggccgccggaatcgcggccagcgttgcgctggcgctgatctggatcgctgcactggaaatttacaggacacgcgatccgaaagtcctgggggtcggtgcagacgagtacaagcgggtcatttcggccaccttccggctctttggattaatcgccatcggttcggtcgtcttctcgatccagagcggtgccaccatgttcgccgtttccttgccggtgggaatcctgtcgctgaccgcgaaccgctggcttttccggcgccggctggcgaccgaaaaagcgaagggacggcacctgtcacgggccatcgttgtcggtgaacctgaggacgtccgctacgtggtccaacagatcgaaaagaaatccggccccgtctacaagatcctcggcgtgtgccttcccggttcacgccggggggccaggctgcgcgtgggcgagcagctggtgccggtcctttcttccactgatgacatttcccggacggcacgcctcgcgcaggccgatgccgtgatcgttgccgggcccctcccgggcggcaacaagttcatccgggaactggggtggaggctggaagagtgctctgccgagatggtgctggcagcgaccctcacgaacgtcgcggggccccgtatccactggcgcccggtggaagggcttccgctgatgcacgtggacattccccagtattccggtggcaaacacgtcctcaagcgggtcatggacgttgtccttgccggtgccgcgatcaccgcactttcgccactgttgttgctccttgccgtcatcgtccggctggacagcccgggtcccgtcctgttccgccaggaccgcatcggcaagggtggcgaaaccttcggcatgtacaagttccggtccatggtggtcgatgctgaggagcgccaggccgtgctgcacgacaccaacgagggcgccggggtcctgttcaagatgcgcaatgatccccgggtcacgcggtgcgggcggtggatgcggaagtactccctggacgaactcccgcagctctggaacgtcgtcctcggcgacatgagcatggtgggcccgcgccctccccttgcacgcgaagtcagcggatacgagcagcacacccaccggcgcctcctcatcaagcccggcctcactggcctctggcagatcaacgggcgctcggacctgtcctgggacgaggccgtgcgcctggacctctactacgtcgaaaactggtcaatcccaggtgacctgctgatcttgtggcggacattccgtgccgtcatccagccttccggcgcctactgacggcgcctactgacaaagaggatgagaatggaagctttcgctaaggacttcagccacggcagggaccgtgtgaacgcagacaggttacgtatcgcggtggttggcgcaggttcccggggagcgggcatggccgaaactcttcaggccagcccggactgggacctggcagccatctgcgacgtggactcccgccgggccggcatagtctcggaaaagcttggcggggcgccttggtttgaggccatcgatgaattgctggacagtgtggaagtggatgcggtggccatcgccacgcccctccgcgccctgttcggaaccggaatgactgcgctgcgggccggcaagcacgtcctggtggaacagccattggcggacagcctggagcgcgggcaggagatggctgccgaggcggacgccaagggcgtcgtgctgatggcaaacaaagcccagtgtttcgagcctgccgtgcaaaagatgcagaagctggtgggtagcggatcactgggcgatatcctcttcgtcgaagcggtgcggaccgaaagcaacctgtcccggactgaccgggacgtcttctgggacctggccccggacagccttgccctccttgactacgtgttcgccgggcggcttaatccccaaggagtttcggcacttgggggtgacccgctgggaaccggccgcgactgtgttggccacgtgattttccggcttcccaacgacgccacggtgcacctgcacgtcaacaatctgagccgagtgaaaagccatcagctggtcattgcaggttcgcagcttgtcctggtgtgggatgccatgcttccacaggaacaactgggcatcttcgactccgattcatccacgcagcagcgccggcgctccccctactgggcagagccgggcgcacttcaggtgccggccgaagatggaacggtgcccgccttcgggcaggaggcgcgggaccgcgtggctgccgagtttgcccgccgcgcgcgcggccacgagagggcaccgtccacgaatacttccggcctgcgggtccttggcatgttggaggccgttacccgcagcaggggcctcgaaggccaggcatcgagtatctacgtaccagggcccgaggattaccagcaccaggctgcaggatcctggcttgaaagcgtcctgtggtccaggtgacacgaactgccggtcttcgttccgttcctcctaggaaagatggtgcctcgtggccaccgaatcagctgttgcacgcatcgaagtaatgaagccctggctggggcaggaggaagcccacgcgcttgccgaggtggtcttctccggatgcgtcacccagggtccgaaagtcaaggagttcgaggccgacttcgcagccgcacagggggcccggttcgcagtggccacgtcgagttgcaccaccgcgctgcatttggccctcgtggtggcgggaatcggtccaggtgacgacgtcgttgtgccgtcactgtcctatatcgccacggccaacgccgtgacgtacgtcggcgcgcgccctgtcttctgcgacgtggatcctgccacgggcaacgtgaccgcggagaccatccatgccgccctgaccctggatacccgggcggtgatcgtggtggaccagggcggagtgcctgtggacctggaccccatccgcgatctgtgcgaccgccatgaaataacggtcatcgaagacgctgcctgcgcggtgggctcgcagtacaaaggaaagccggtgggagccggcgcccacatcaccgtctggtcctttcatcccaaccacatcctcaccaccggggaaggcggcatgctcaccacccggcgggcggactgggcggcccgtgcccgggccctgcgggaacattcgagcagcctggcagccctcaaccgggaagaactgttcctgtcgccccgcgaggtctgcctcgaagttggcttcgactaccgcatgaccgacctgcaggccgccgtcggaatcatccaattgcggcggctgccggaaatggtggaacggcgccggaagatcgcgggcatgtacgttgccgccctcaaaaacctccaaggcctgaggatcgtgtccgatcctccgtatggcaccacgaactaccaatccctgtggctggaagtcctccccggattccccatgacccgcgaggccctgctggaaaggctggccgacgccggtatcaccgcgcggcgcggggcgtacgccgcgcaccgccagccggcgtaccgctggcgcgacaacggcaacgccaggctccagtccacggagcggctgagcgaccgcaccctggtcctccctgtgttccatgagatcgactcgtccagcatcaaccgcgtcatcaacgccatccggaacgcagcgcacccggtgggcacgtgagtgagctgatccttatttcagtgagcggccttgcccgtgaagtcctggcgatggtgcgcagcagtggccagtacgacgtcgttggcctgctggacgatgacaaggagatggctggcgtcaccgtggacggggcgccggtcctggggagcatcgatgatgccgccaactacacccatgcgttcctgctggtgtgcctggcgtccgggaaggcacgggaagccgtggtggaccgcctcacgtccctgggcatccatgaatcgcggtatgcaacagccgtggatccttcggtccagtaccccgagggatgccggattgggcggggaagcatcctgttgcgcaatgtcaccctgacagccgccgtcaccctgggctcacacgtggtggcaatgccctcggtgactttcacccacgacgacgacgtggcggactttgcgacgttcggcgcaggcgcgtcattgggcggcggcgtccggatagggaaggctgcctacctcggcatgaattccagcgtccgcgacaggacgtcggtgggagactatgccacagtgggcatgggcgctgccgtgctcagcaacgtcccggccggagaaacgtgggtcggagtccccgcccacgaaattgaccagcacctgtttactttcggaaaggaaccgtcccgctaggcggcagtccggaaaaacagcccggtcaccgcagccaggcgccagggatcctccacgccgcacagctcccgcgcggaatgcatcgagagcagcggaacgcccacgtccaccgtccggatccccaggcgggtggcggtcagcggaccgatggtggaaccgcacggaatcgcgttgttggacacgaactcctggtaaggcacgccggcatcagcacacaggcgggcccacagcgccgcaccggaggcgtcggtggcatagcgctggtttgcattgatcttcaggagcggtccgccgttcagcaccggatggttggcggggtcgtgccgctccgcgtagttggggtgcacagcgtggccggcgtccgcggacacacagaaggacgccgccagtgcctgccggcgctggctcaccgtggcgcccagcccgtcagagatccgcaccaggacatcctcaaggatgggtccgcaggcgcccgagcgggagttggagccgatctcctcatggtcgaacgccgcaaggacggcaatcgggctgccggtacggggcgcggacgcgtgcgcgatcaacgccgccagccccgcatgggtcgaggacaggttgtccaggcgcccggaagcaaaaaactcactgttgcccccgaaaaccgaaggggtctgcgtatccgccatgacgacgtcgtacccgccaatccgggcagggtccacggaagcgccggaaacgtgggaagccagcacggccagcaggtcggcatccgcaggattgccgagcccccacaccggattcatgtggcgctgcttatccagggtcaggccatcgttgactgcgcggtccaggtggatggccagctgcgggaaccggagcattggcccggtggcggtcaggtgctcggtgccgtccagcatgaccaggcggccggccagctgcagttcccggtcaagccaggagttcagcagcggcccgccgtacacctccacgcccgcctgcagccagccgtgggcacccgtggtgggcttgggcttgagcttgaaggtgggcgaatccgtatgcgcgcccaggatgttgaacccggtggccggccctgccccttcgggaacaacccaggcgatcaaggcgccgtcccggatgatgaagtactgtcccggtccgccctcccaaggctgcagttcatccaggcggacaaaccctgccgcctccagccgccgccccgcttcgtgcacggcgtgaaagctcgacggcgacgcgctgacgtaggcggcaaggtcctggatatggtctgcggcggaggcaagggaaggcatggtctcgagtctagacggcgttgggccgcgggtctcagtagtccgggttgctcggcaccaccaggccggtttcgtacgcgtacaccacggcctggacccggtcgcgcaggtggagcttggtgaggatgcggcgcacgtgggttttcacggtcgcttccgagaggtagtaccggtgggcgatttcggcattggacagcccctcggccatcgcctccagcatctccgtttcccgcggggtcaggtccgccagcagggggtccggtgcaggaacggccggggccgggcgggcggcacccctgacatatgtttccagcagccgctgcgtgacgcgcggcgccaccacggcgtccccgctggccaccacccggacagcgctgaccaactccgacggcgccacgtccttgaggaggaaggccgaggctcctgcctggaggccggcaaaggcatactcgtccacgtcaaaggtggtcaggatgatgatccgggcacaggaaccggaggccgtgatggcccgcgtggcctcgatgccgtccagcacgggcatgcggacgtccatcagcactacgtccgggttaagctcccgggcctgccggacggcgtcggccccgtccgaggcttccccaacaatccgcagatcctcttcaccctccaggatcaggcggaatcccatccggagcagcggctggtcatcagccagcaggacgttgatgggtgcgtttccagtcatgggttgccttgcagttggtaggggcggatggaatcggcggagtcgtctccgggccaggacaggacggcgtgcacgcgccagccccggccgctgggccccgcttccacggagccggaatagatcctggagcgctcagccatacccgccagcccctgtccggatccatgggaaccagcagcaccggacggggaagtacctccatcctgggcggggtgcccggtcactccggcgccgtcgtcgagcacgtcaatggtcaccgtggagccggagcggacaacggtgacatccacccgcgtcagggcgcggccgtagcggagcacgttggtgagcgattcctgaacgatccggtacacggtgagctggaacgccgcatcgcctggcagggcagggccggtgtgggagtagtgcagcggaaggcccgcggtgcggaagccttccagcaggctggccaggctgtccccggcggtcagcggcggccggggcgcggcgctccccgtgtcatcacgcaggacgccgaggacccggcgcatgtcggcgagggcggtacgtcccgtgcgggacagttcgccgagcacctcgccggcgcgctccgggcttttccggaccacgacggcggcaccatcggacaggctgatcatcaccgtcagcgagtgggccaccacatcgtgcatttcgcgtgcaatccggttccgttcgttgacggaggcaagactcgcggtccgggcggcccaggcggcaacctcctgctcgtgctcacggcgttgccggacgctgatgccgaggccggtggccaggatgttggacagggctatgctggcaccggtggcgatgctggtcaggaggtggaaatctcccgggttgactcccggatcgtggacgaaggagttttccatgggtcccacggctgccaggagatagaggagtgccagcggggccgtggccgcggccatggtagcgagcgcgaagcggcgggtgtgggccacggccacggcatagagcgagaaccacagtcccgcggacacattggagccccaggggtggagcagggtgactgccacttccaccaccgcgacgaaatccaccaggccaacagggtagaaccgccgcaggaacagggatccggccaccagcaccagcagggcggctgcaagccagttgccggatgtggcggcgtccaccacggtgggtgccaccaagaggctgtagctggcggccactacaccgtccatgaccagcgggcgccgctgcaaataccggcggagccgccctttgcgccttgccgtgagctcggcaaaggacgcgtcggcctgcccggccggcgcgtccttggtaaatgccgtttggttcatacgtcggggttgcccgttccgtgggtgctagacgtcgcgcttcttcaagatgatcatggctgcagccacgggaacaaccacccacacaccaagccacgtccaggcctgccagacctccagtgcgtcttccgcgggcgcggctgtgacgatccgttcaaagaggctgtccggcaggtacttccgcgcttcctcgaagaattccccggggatgagctgaaaggcgatgggaaccacgaagaacagccccaccagggacatgattccccccgctgaattgcgcaggagtgtccccagggacatgccgattgccgcgactgctgccacgtacacgccgctgaccagcaggaggcgccgggaatggtcggaaccgaggtcgatatcaaaaccgtagttgtccaaaatgggggtggccgctacgtacgcgagcagggacgacgccacggtcaccacgaaggcacacgccgtcaccaccagcagcttcgcgatgaaggccggggtacgtttggggaccgccgagaaggtggaccttgccatgccggtggtgaattccgagctcatgagcagaaccgccagggatccgataatgagctgcgcgaaagcgatgccggatgtcgggattcccgccgtaagatcagcgccctgggcggcgaaggccgcagctgcctggggatcgttccgggatgcttcggaaaactgtccgatgccccaggcgttcagggcggcaaagcccaccatcaccagcacggttgatcccaccaggatcagggtggagaggagcgtccggaacttgatgaactccgagttgaggacacgcaggaaactgggaccgggggcagccgtgccgtgcggccggctggattgaagtgctgctgtgctcattgctgtcctccggtctgggtgggcgccgcagctcccgtggtgatgagggagtggtactccacctcgtccttggtcagttccatgtacgcctcctcgaggcttgcctggaggggagtgagctcgtagaccataatcctgttgtccagggctgtccgggcgatgtccctggcgggcaggcccgtgacctcaaggagttcgtggtcctggacctctactgagacgccgtcgtccgccagaaggcgcatgagctgctccggctggtccgtccggacgcgggcacgggactggcccttgcctgtgatgatttcgccgataggggcatcagcaatgatcctgccgcggccaatgacaatcaggtggtcggcggtcatggccatctcgctcatcaggtggctggacaggaacactgtccgcccttccgatgccaggtacttcaccaggttccgcacccagaccacaccctccgggtccaggccgttgaccggttcgtcgaggatgatggtttgcgggtctcccagcagtgctgcggcaatgcccaggcgctgccccattccaagggagaaccccttcaccttctttctggccacctcccccaggccggtcatctcgatgacttcctgaacccgcttccttggaatactgtgggtcgcggccatggccaggagatggttgtacgcggtgcggccggtgtggacggctttggcgtcaaggagcgagcccacttcgcgcaggggtgcggcatgctgcgcgaacggcaccccgttcacggtgacggaacccgacgtcggccggtccagtcccatgatcatcctcatggtggtggactttcctgcgccgttgggtcccaggaaaccggtaacgcggcctgcctggacggtgaagctgaccccgtccacggcggttttttcgccgtagaccttggtcagccctgttgcctcaatcatggagtgttccttcgaacggcagcttttgactgcgggatgcgttgcagaagactggtacgcaccacgctacccacggccggggagtatttcgccggtctcagggatgattcagggacaggtcagggtagtccccgtggatgaccgggtgatcattggggctgtggcgagtagtaggcaagggccctgcggcgcaccgtgtactcgacgctgcgcacgccggccagcgcctcaccgtccaccgccaaagccatcggcgagccaccggcatcaatgcgcacccgggttccctctgagagatgggtgatgcgcgaggatgccacggtacccgtcagcaccgaccacagcagccgtatccgggcgaatgactcgtccgctgtgatcatgcggacgtccaggacgccgtcgtccatcacgggccggaacaagggggcgtggtcacgcgggtagtaccggccccgtcccacgtaggagatccacaccttgtgcggcctgccgtcgactgtgagggtggtgggggttccggccgcgaaggtgcggaacattgccaccacaccggccaggggttttcccagcgcaggctgcagctgtccccggcggcgcacgaagttcgggtagaggccaacgctggaggtgttcagcatggtcagctgtgccctttccgggctgccggccaatccgcgctccaccgtggcgatccctatgtctgccagcgctgcttctcccctggaagcggcggctacggcctccctgaggctgccggtgccggcgtcccgggcaaagtggttcagggtaccgccgggaaggaccagcaggggaaggacatgctcgacggcggcagctgccgcggctccgacggtcccgtcgctgccccacaccccgagtgcacgggtgccgggatgttccgctgccagccggatctcgcggagcaggtcctggtccggatggaccggggtaatatgcgccttggggaatacctcccgcagggcggcagccgtctcctccgtgaaggatccacccagggtgttgaccacaatgctgagccccatgccgccgggaagttccggcgccgtggtccacgttcgggccacgtctggaaaaggggggcgcaccggccaccacctgcgcgtcaggaaggcagcgccggcacctagggcggagccgaagaagacatccgaaggccagtgggctccggtgtgtacgcgtgaataggctacacccgccgctatcggagccagggcggccccaatgacgggctggacaagtcctgctcccactgcgaaagcgacggccgaggcggagtggccggatggcatggaggagctcgtcggctgggggtggacgaaccggaacaccggaagatgttccggcagcggccgcgcccgggggagcagggttttgaagccgacgttcgtgacggcggaagccactgcctgggcgatgaggccatgcagtgccgcacggcgtggccgtcccggaaaggcagccatcgctgcagcagcggcgagccagagttttccgtggttggctgaggcggagagtcggcggaagaaggcatcatggttccctcccggaagatccgagacatgccgcaccaggtatttatccaggcggctgatccaccgatggcttccgcgccatgtgctctgcattcaattaccctaccgcccagtgaatggaggttttccagccttgcggaaaagcccgttcaccgtgcttacccgactttgaggggttttgctgctcccgccagcagcagggccaagaggatcggcgcaaggatggccagcagcgccaggtgtatgccggtcaggtcgccgaggtatcccagaaggggaggtccggcaaggaaggagatataacccaacgtggatactacggacacccgggctgcggcatgcttggggtcgtccgcagccgcagacatgcccatggggaaagccagcgctgctccaacgccccacagggcagccccaacagccgcaagccacacatttccggcgagtacaaagaggcacagcccggccgctgcggcagccatgctcgccctgaggacggcaacacggccgtacttgtcgatgacgcggccgccaaggaaccgcattgccgtcatggccagcacgaagagggcaaacatcagcgcgccggtggattcagaggtacccaggccgtctacggacgctttcgcgatccagtcgttgcccgcaccctccgtcagggtggcccccaggaccacgacgccgatgagcagggtgcggctgtcacgccaggctgacgggcctttgggtgcctttggttctccctccggtgtggcggtcgagatatgcgggaggaagtagcgcggggcagtcagcatcaccactacaaccacaccggcgatgaccagcaggtgcaggggcaggcctacccccaggttggaaagcccggcaccgatcagtgcgccgacgaaggcaccaccgctgaaagctgcgtggaactgcggcatgatggtgcgccgcagtttatgctccacgtcggcaccctcaatgttctgggctacatcccagagtccgatggcgatcccgaagaagaagagggcaacggccgtccccggaattgacgcaaccgagagcgaggcggcgattccggcgcccgcgagggccgccaggatgccgccgaaacgtgcggtgttggccgttccgatcctgcccaccaccagtccggcggtagggagcgccaggagcgaccccacggcggtgcacagcaggagggtgcccatctgcccggaggtgatgtccagggtctcggtaacggcagggatcctcgcggcccagctggcaaagaccaggccgttgatgccaaaaaccacaaaagtggctgcggcggctgcgttcagtccagcctgctgcccggtaccggtgttgatgctcatacagtcactacttccagggagtatttgtcgagttgcgcgcgttcttcggcgctgagatttttgtccgtcaccaggatgtccacccgttccaggccggcgaccagtgcccgggcttgtgcttcccatttggcggccgaggcagccaccaccagccgtgcggcggagtccaggccggcgcgctttactgccgcgtcgtcgatgtcatgcgccaagaggccggccttgaggtccacggcgcagggtgtgacaacagcggtgtcgaagcgcagggagcggatgttggattcggcgagcgggccgcggaagctcagttctccgggcaccagactgccgccgggtagcagcagggcagggcgggtacctgcggtgggatcgccgcccgcgaggacgttcagcgacctgagcgacatcggcatgacggtcagttccctcgcttccacagcgcgggccacctccgtagcagtgctgccgctgtccagccagacatgctcgcggtccgccaacagccctgctacggctgccgcaatgcgcttcttggcgtcctggtcctcgagttcgcgctggccgtagccaggattttcgccgtgcccgatgaggctccgcgccccgccgtgaacacggcggaggacgccgttcgctgccagggcctcgaggtcccgccggatggttgcccccgatgcgtcgcaggcggcggtcagctcctccactgtcacctcatggcgctggcggagcaacccggcaatggtccggtgccgctcgtcagttttcatgatcaaatgctaacaaaccttgatcatttgctcaccagacgctctctcacttaatgccggaaatcttccatccctctctcaccggtgagagagcgatggccaaaaagctgcagggagtgagagagcgttggatcagcggacgcgctccacgcgcttttcgtcccacaccggctctgcggattcgtacactttgccgtcggatccgaacaccaggaagcggtcgaaggtgcgcgcgaaccagcggtcgtgggtcacggcgaggacggttccttcgaaatggtcgatggccttctcaagtgcctcggcggagtgcaggtccaggttgtccgtgggctcgtcgaggagcagcagggtggcgccgctgagctgcagcagcaggatctggaaccgtgcctgttgcccgcccgagagggactcgtacttctgttccgactgcccggccagtccgtagccgtccagcgccccggccgctgcctcccggccgagtcctgaacggtgttcatcgccacggtgcaggatttccagcagcgtcttgcccaggaggtcgggccggacgtgggtctgcgcgaagaacccggggcggatcctggcgccaagtttcacggtgccctcgtgcggcacttcggcgatttcgacgtcggaaacgggcaggtgttcccgctccggatcggttccgccggtggccaggagccggaggaagtgcgacttgcccgagccgttggagcccaggacgccaacgcggtccccgaaccacacttccgtggagaagggcttcatgagtcccgtaagttccagcttctccgccacgatggcccgcttggcggtccgcccgcccttgaggcgcatttgcacgttctgctcgatgggcagcgcctccggcggcccgatctccaggaacttggccaggcgggtctgggctgcgtggtatctgttggccatgtcggagcggaaggcggccttgttcttgtacatgttgacgagttccttgagcttgacgtgctcctcgtcccagcgcttccgcagttcctcgaaacgggcgttccggtctgcccgggcctccacataggagccaaatccgccgccatggatccaggcgccagcaccgttgatgccgggttccagcgtcacgatgcgccccgcggcgttgttcagcagctcgcggtcgtggctgatgaagaagaccgttttcctggactcgttcagcttgtcctcaagccaccgcttgcccgggacgtcaaggtagttgtccggttcgtcgagcagcaggaggtcgtccggcccggcgaaaagcgcttcgagcaccagccgcttctgctcacctccggaaaggctcgacgccgggcggtgctgcgcgcggtcgaagggaagtcccagcgcggccatgcatacctcgtcccagacggtttcgacgtcgtagccgccggcatctccccaatcaacgattgcctgggcgtaccgcatctggcttggctcgtcgtcgtgctccaccatggccagctcggcctcgtccacctcgcgggcagccgctgccagagccggcggcgcggcggagaccagcaggtcgcggacggtggagccgtcccggacctggcctacgaactgtcgcatgatgcccatgttcccggaccgcccgatgacgccttcatccgggaccaggtccccggcgatgatgcggaagagggttgtcttcccggtgccgttggggccgatcagtgcagtcttggtgccgtccgggaccttgaaggtcacgccgttgagcagctgggtgccgtcggagaggaagtaatcaatgccggaaacgtcaatatgggccacgtattcaatcttcccacggccacggcggagagtttttgtccagatacgcagggttgaccggcctggaagtccgcatatctggacacaaactctagcccgcggcggtgaggaactccttcagcagcggcccggacgtcgttgctcccagtccgccgtcctcaacgaacacggccactgccaggtcgccatggacagccacgatccaggcatgcgtcttcggcggagtctccttgccgaattcagccgtcccggtcttcgcccccacaggtgcaccaggaacgctcgcaaggaagcctgcatgcccggaggtgaccacggcgcgcatcatgtcagccagggaaccggcctcggcggccgtaatcggctcgcccgacgccgtcgaaggagcctctgccgtggcggtggcggaaggctgcgccgccggtgccgtggaaccgctcgtcgtgccggcagcggcagcgccgccgtcgggattcaggaccagctgtggcgacaccggagcgcccttggccacggagccggccatcatggccgccgccaggggagagagcagcaccctgccctgcccgatcatggaggcggcgtgctccgtccctgccgcctcgccggggacggatccgaggaacgcgtctgcgcccagcgacggtgcttcgacagcgatgcccatggccagggcggcagcctcgagctgtccttgtgacacggtgtcccgggcagcgatgaacaccgtgttgcaggaatgcgcaaaggcgtcacgcagggtgacggagcccagggagccttccggataaccatcggcattcttgaaggtgcgcccgtccaccgtcagcgtcggcgtgcattcaaccttggaatcaggggtcagcccgttgcggaacatggccagcgagtccaccatcttgaaaattgaccccggcgcgtactggcccagcatcgccgtgttgtagccgttgctgccgggacccgatgccacggccaggacggctccgctggaagggcgcagcgccacgatcgccgatgccgggcctacgtcctccagggtggtctccgccagtgcctgcagcttcgggtcgatggttgtcttcagcggtgtaccgggctcgggcgccacttcaaagagcacacgccgggggtccgttgctgcggactggatctgttcgcgggtcaggtcggcgcgctgcgcgcggattacgacggcgtccgtccccctgagctgttcgtcatactgctgctgcagcccgccgatgccggtgacatcacccgccgttagggcaccttccgaggcttcgatctgctcagcagtggcttccccgacagtgccgagcacggcccgggcgaaggtccggctgggtgccagcggcaccgaggcgggaatggcacgggctccggggattgctgcaatctgctcgttggtgatggtgcggccctcatcccgcagggtaatcgccgaaacaaaggcttccgcgccggaggccttcacctgctggacgtagccggccgggtcaaccccaacgagggcagcgagcctggtggcagagtcggcgggatcggcagtgcccagctggggcttgtcaatgccgacgttcaccaccggacggtaggtaaccaggggggcgtcccccgccccgagaatatccgcgcgctgcggggattgggaccccttggtcaggatctcgctgtccgcgaggccgggtgccagggttgccgggtcccaaaccgtaagccatttatccccggacttcttaaagttcgccggtacggtgtatttccattctgcttcaccgaatgtccaggtgtagttcaagggcgccgaggcgttgtcaccgtccagggtgacgtcgcctgtttcgaccgccggcttctgtggatccagtgccttgaacacgccccgcagttggtcgtttgcggctgcggcgtccttgccgtcaaaggccactcccgccacatcgagtcccgaaacggctgtggcaaattgttgtgctgcggtttctgccccgctcctgccgtcgtcgcaggccaccagagaggttcccagaatgagcgcagctacggcaacagaaagttttgttgatttccccatccggccattatgccccgcgaaatgcagtgcgggtggccattcccggggcttttgaagggctctgctgattgctatgcgccacccaggcccagcgacggaacgggcaggtggaatatgtccttcagcgcatgggttgctgcgtgcaggccgggcatgccggtgaccccggggccgggcggggtggaggaggaacaaaggtagacgccccggaggggggtgcgccatggatgccgggacactacaggccgctggaccaggccgcggaggtccatggtgccggcgctgaagtccccgccgatgtagttgcggttgtactctgccagctgcgccgccgtcactacgttggtatccaccacaaggtccctgaaaccgggggcaaacctctccagctgtgcggtgatggcttccgccatgtccttggttgaaccggccgggacgtggcagtaggtccacagggtgtggcggccggcgggggcacgccgtgggtcgaaccgggaaggctgggccaccagcacgtaggggcgttcggggtgccggccggcactgacctcgttttccgcgtgcgccagctccgccctggttccgcctacgtggactgttccggcgtccgccagttccgcggcctcccacggcacggggccggagaggatgaagtccaccttgcacgagccgttcccgtagcggaaggactccagcgctttgcggtagcggccgggaagggagtcaccggccatgtccaccagtccgcgcggcgcaacatcaaggagagtggcccgcgtgggtggaaggtccgtcaaccggttaatgggggtgtttgtgtgcaggatgccgccatgtgcctcgatgtccgctgccagggcggcggcgatggcagcagaaccacccaggggaatgggccagccttcagcgtggccaagtgccccgagcatcagccctgctccggacgcggcgagggacggaaggcgggacacggcgtgggcggcgacgccgctgaggagcgcaggagctgactcctcgcggaacctggcattccaaaggcccgaaccttgttccagggtgcgcaggccgaaaatgcccgcggccacagggttgcggggaaggcggaagagctggttctgcgtgaagtccataacatcgtcgatgttccgcacgatggggctcatcagccgccggtacgccgcaccgtcccggccgagtcccgctgcggtccggtcaagtgaccggtaggcgagggcggaccgtccgccgtccagcggtgatccgaaggagagctcaggagtgacaagctccatccgccgggaaagctcgaaggcccggaagaagggcgaggccagcgccatgggatgaacggccgagcagacgtcgtggaagtggcccggctgcatgagttctgccgtacgggtcccgccgccgaccacgggcgcggcttcgaagacctccacggcaagccctgcccgcgccatgacggccgcggcggccaggccgttgggtccggcgccaaccaccgtaacgtcaggcatcggatgccgccttctgcgggagcgcggcataggtccggcggcgcaggttcagccggaaccggtccggtgcgccggtgaacgggccgccgtgcggatcgtccaggtggtgccggcggatgggatcgtaggtggggtcgtagatgtcccaggtcacccgcgccatcaggtaggcgacggccagcatgtgtgcggccacggccaggacgtagtagggcatatccaggttgtgctgggaggagcctgcgctggtcacctgtccaaggtacatccacaccgcagcccagtgcaggccctcgatgccctgccagaccaggaagtctcgccaccggggcctggccagcgcgagcagcggaatcagccatacaacgaactgcggtgagtacaccttgttggtcaggatgaaggccgccacgatcaggaaggcaagttgggccaggcgagggcggcgtggtgcggtcagggcaacaagggcaatgagggcgcagcccaccacaaacaagccgagggacagcaggtctaccgctgcaccgctcagttcctgcccccttaatctgcccagcaccaggttgtaggcgaaccacggtgagctgtacccggcgccgcggtctgccgagaactggaagaagtaggcccagcccgggaagtttgcgaccgcgaaggggaggttgacaacggcccacgcggcggccgccgcccccgcagtcttgaggaacggctggaaccgtccgctccggaaggcgagcaggaggatggcgcccagaatgagcagtggatacagcttggctgccgtggcgagcccgatgaagacccccgccagcaccagccgctcccgggagaagaagtacatgcccacggcaagcagcgccaccgcccagaggtcccagttgatagtgccggccaggatgatgcccggcgccaaagccaccatggctgcgtcccagggccggcgggcgctcatccgcgcggtggccaggaccgtgaccaccgcggccgcggccagaagcgcggcattgatgtcgaagtaggccaggatccgggtatccggggctccggtgccggggaccagccaggccgttatcccggcgatgaggccggtcaggacagggtattcaaactggctcccggtgcccacgatgggaaaatttccgtccgccagtccccggttccggaacagttcggggaaatcggaatagcaggtggcgtaaaactgggtgggggattcccaaccgttggcgcggcagtatcccttcagcaggatgcccgccagtgccgacaatacggtcagcaggataagtacccgctccacggtgaaaacaccgggggaaacgatccccggagcggaccgggatccaagggggccgcccactaattccgtgaagttcctcagcaggacatcgctgcggcttggaacaacgaggcgcagccttcctggatgctcgggcggctgggtgtcctccatggcttcgagcttaccgccgagcccggaagccggttggcgccccggagcccacgcgtcgccgcgtgggctccggccacaggttcgctgatgttcactgtgcctcccggctgaggtacttcattcgtggctgcccgggcggcgctttagcgggtaccgccgatctgctggtgcatcaggatgaatacatcctcgcgctgcttttccagcagggtctcgttgaactttctcctgctgctgcgccgtccttgggccggcagcaggagttttcggaactttttcatggtcatcacctccttttgggtgaggttggcacgcataattgggcatggcaattaagcccatttatggcagagaaatcatgggcgtcaggactttatgggaaatgcaaatataaacgcgcagaaactgacgccaattgcctgcacatcagcactcaagctgcatttgcacagggaataaggcgaaagggaaagttcgcggccccgggaggacggttgcagggactgcacccgaacccggacagggccagtgtccagccggaccactggccgctgagggacgctgctgcctggactccaggcgggagtagcggctaggagccggcgtaatccctaaaagggcgcgcaaaagcatcaggggccggggcagcggtgatggtcatcttccatccgctagtcaaagtaatcattttcccaacctccttttctgctctgccgccgcacggatcaagaacccggcagcgtgcgccacgatcccggcaagacgctctgggatcaggaataaaattacactaccgcttggagtattcgctacttaatatccaaaaattgtccaactaattttggccgtctctttcaaaggccccatcggacgatcgcaggcgtccttttgtcccacccgagtgtgcagaccttggcagtgcccaaaatgaaatggcggccttcagtgggaggcaattccagccagcgtgcggtaaggatccttgagaaatggccgtgggcaacaatcagcacgttgtccatgccggattcgagcacgcgcccaataatcttgtctgccctggccgccacctcatccagcgtttcgccgttgggaacgccgtgggtccagatgaggtagtccggattgtccttgcggatcaggtccgagctgatcccttcgtaatcgccgtagttccattcaacggccaatggttcgtgctgggcgtcggggaatccggcaagctcggccgtacgccgcgcgcgcctcaacggagaggtgagcaccaggtcgaagtcaacaggatccagcaccttccgggcctccacggcctgctgttcaccctcgacggtcagtggaagatccgtgagcccggtgtactggccgctcttggaccattccgtctcgccatggcggaggatccagagctggggacggggggcaagggctggcatggtcacttggactcctcagaaggggacggctcgacgacggcgggcgacgttccagcgtcaggcgccgggggtgcggggacggcaggtgctgattccggctggcccgcccaccagctgagcagccgtgcttccgcttccgccgcgggcaggggaccgttctccatccgctcattaagcaggaacttataggcccgccccaccacgggaccaggcttgatgtccagcagggccatgatccgggcaccgtcaaggtcaggccgcacggcgtccagggattcctgctcgcggagggcggcgatgcgggcttcgaggtcgtcgtaggcgaaggccaggcgttcggctttccgctggttgcgggtggtgacgtcagagcgggtcagccggtgcagccgttccagcagcggcccggcgtcggtcacgtagcggcggactgcggagtcgctccaccctgcttccccatagccgtagaagcgcatatggagctccacgaggcgcgccacggctttggtggtgtcgttgtcgaaacgcagcgccttcatccttttggaggtgagcttcgctcccaccatgtcgtggtgccggaagctcaccgcgccgcccggttcgaagcggcgcgtcgccggcttcccgacgtcgtgcattaatgctgcgaagcgcagcacaaagtccggccctggcaccgggccctcactgtccgtctccagctccgctgcctgttccaggacctggagggagtgctggtagacgtccttgtgccggtggtgctcgtccgattccagccgcagggccgaaacctcgggcagcacgaactcggcgagtcctgtgtccaccagcaggtccacgccgacgcgcggacgggcgccgcagatgagcttgaccagttcgtcccgcacccgttcggcggaaatgatggtgatccgttcggccatctgcgtcatggcctgccggacgtcctcgtggacagaaactccaagctgggcggcgaagcgtgccgcgcgcatcatcctcagcggatcatccgaaaaggacgcttccggcgccccgggcgtggccagcacggaagcatggaggtcgcgtacgccgccgaaaggatccaccagttccagggagggcagcttcagtgccatggcgttgatggtgaagtcccgccggagcaggtcatcagtcagggacgaaccgaaggccaccacgggcttgcgggaatcgggatcgtacgcttccgccctgtaggtggtgatttcgatctggaagcctgccttgcgcatgccgatggttccgaaggcgcggccgatctcccagtagttgtccgcccacttcttgacgagggcaaccgtctggtccggggtggcatcagtggtgaagtccaggtcaggggaggtccggcccaggaaaaggtcacgcaccgggccgcccaccagtgacagctcgtggccggcgtccacgaagcgccggccgagctccaggacgacggggtccacctggaattcgacggtctgggaatcagtcttgtgatgtgcgtgagccatagttacttaagcttgtcagaaaccagcgcgtcggcaggccaaaatacggtcaagatcgtgcggaatcactccaccgccggcaaagtgcgtcatatgcagtccatgttggtgtcatgttccggtcatcacgaacgggcaacagtcgttagagtggactccatggcccatccagtaccgagcgctccaggcaggaggacaaacgcaccattgccctcggcaatcggtgcgcacgttgcgcctgcccagcatgcggcaccggcatcgctgcccacggttgaggaagtctcagccggcggcgttgtagtggacacgtccgacgccgagttgagggttgcgatcatcgcccgccttaaccgcggcggacgtttggaatggtgcctgcccaagggccatccggagggcaaggaaaacaacgaacaggcagcggtccgggaaattgccgaggaaaccggcatagaaggggacatcctcgcgccgcttggaagcattgactactggttcacagtcagcggccaccgggtccacaagacggtccaccattacctcctgcgggcaacgggcggcgaactgaccatcgagaacgatccggaccaggaggccgtggacgtggcgtgggttcccatccatgagctggcccggaagctgtccttccccaacgagcgccggatcgccgacctcgcccgcgaggtcctgccggaacacctctaggactgcagctatcccgggcggagggcgcctgcgttgcggctttaaccgccttcgggtgagacgatgaagtcgatgtcagctaccaactttccttccgataaagcccgcgggtccggcgatgccgtcccggacggcgtttcccccgagccggccggcccggacaacacccctggcgccgtggctgccagtgaaacccggtccagtgccatcatggccgccgggacgctcgtgtcccggttcctgggctttggcaagacctggatgttgggcacggcactcggcctgggctccactgtcaatgacaccttcatcaacgcgaacaacctgcccaacctgatcttcctgctcgtggcgggcggggtgttcaacgctgtcctggttccgcagatcatcaaggcaagcaaggccccggacaggggagcggactacatcagccggctgctgacgctggctgtgctgctcctcctggggctaacggcgctggtgacactggcggccccctgggtcattgaactcacgacgcagggatacaccccgcagcagaaaacgctggccgtggccttcgctttctggtgcctgccgcagatcttcttctacggcctctatgccctcctgacccaggtcctgaatgccaacggagcctttgggcccgccatgtgggcacccatccttaacaacctggtggccattgccgggctggggatgttcatctggattttcggcgagaacaaggtgaacccgcacaccctggacaactggggcgacacgcaaaccttgctggtggccgggttctcaaccatcggtgttatctcgcaaacagccatcctgatgatccccgtgatgcggctgaagcttgggatccggccccgcttcggctggcggggggtgggactgggccaggctgccaagctgagcgtctggaccttgctgaccgccgccgtcggccagctcgcgttcctctatgtcatgcgtatcgccaccatccccggcgcggaacgcatcaggctccagcaggcaggggaccccgcggcctatatgctgccaggcaacgccgtgctggaggtggccagccagctctacctcctgccacactccatcattgccctgtccctggccacggtgctgttcaacaggatgacccgggcctcccaggacggcaaccgcgacgcgttgcgtgacgccctctcgcacggcctgcggaccatggcggtggcaaccgtgttcggtgcgcttgcgctgtttgccctggcaggtcccctgggcatgttcttctccggcggtctccgccaggacggcgtgatgctggcccagacgctcaccatcctggcactgagcacgccgttcatgagcgccaacttcatgatgtcccgggtgttctacgcgaacgaggacgcgcggacgcccttctacgtccagctgctcctggccattgtctacgtggccggtgccttcgcaatccagttcctgcccgtcacccagatcatctacgccatcgcggtcctctacatggtgggcaacatcctctcggtggtcatcagcgcctggttcctgcggcgcctgctggggcacctggacgggccacggatcgccaactcctacatccgcatggggtatgcagcgcttggttccgccatcgccggggcgggtgccctgtggctgctggggagctacagtccggacggctttgcctggcaggacaggctgtcagccctgatcaccgtcattgtggtgggcccggtgatgctggtggtctacttcttcctgctcaagctgttccgggtctccgagctgcgcgacctgctccggcccctcctcggccggctggggcgcggtggaccggccgcacctcccgctggaggcgggacgccgccgtcggactcgccctccgattcgccgtccggttccccgtctgagtcgccgtacggcgggggcgggcgccagcagccggaacgtgccaccacgtccgtggacacaggcctcatcccaaggatttccggcgagttcgatgccgtctccttcagggccggaccggctccggaagaggaggcgcccgggcacggggcgcggcagaaggagccgctcgacggcgatggcccgccaacgtccgatggcgattacctcccgggggaggaccagcccagcacggcacggggaggtttcctgcgggagcagatcccccttcccgggcgccgcaccttccagggaaagcccggcgagaacccccatttcaagccgaggaacccccggaaaaagtgacgttcccgcggtttccggctgcctttgtccaaggtgggagggacgcaatcggctaggatcgaaaaggtacaggggtagttgcatccaggggtcaggcgcccgccagctcctggacggtggttgcatcattcaagccggcaatcccggacagtctaggaggaacacgtgtccaacccgatcgatgtcggatcagtactgggcggccgctacaaggtcactgccacggtattggcctcgcatgaccacgatctggtgctggacggtgtggatcaggtcctgaaccgtcccgtcagcatactggtggccggacccggcaacaccgaacaggttgcccagagcgcccgcgaagtagccaccggtgaacgccccggcaccgtccaggtcctggacctgggtatgaccgaggcagccacctacctcattaccaaccacacttccgcagcggatctgctggaccttgtggtggcctccaatcctccctatgtggagccgtttttcacggacaccctgggaagcgaaatctttggccagccaaggtcgagcgagccggaaccctacgacgatgaagaccacgtcgaagccggctacatcaactactcggacaaccaccccagccaggtggatccctaccgggcagcaccggctgttccgccgaaaccgccagtccgtcctgctgccgcgccttcctccggccgcacgtccaacggggcctccgctgttggcggagcagcggcagcccgcggagccctggctgcgggcggagccgcaggtgcggccgcagccgccggatccggatccgagcgttctgcacacccggaggatcaccagaccgcacacacgcaggctgtaggccacacgcaaggatctcccggctcaccggccggtaagcccaaggtgtccctttggtccgatgacgattacgcgcatgctgaagagcatgccccggtggactcgtccgtcgacgacgaaccagaggccaagaagaagaaatcttccgtttttgcgcggtctgctgcgccggcagctgctaccggcgcagccgtccccgatcagggccgttatgacgacgacggccgtgacgaacctgcccgcgagccacggtccatgcgctggttggttggtgggctgctggccgtggtgctcattgccggactggtgtttgccgtaaccaacctgggcagccttttctcctcgcagccgcaggctgggcccacggcacccggtaccagcagcagcgcgcccgaagacacctcggctccgacgcaggcacccacaacggcaccgccggctgaaccaccggccatcgagagcatcaccaggcagggcaacttcgactttgctgccacctttgatggcgacctcgtcagggcgtacgacggcaacgccgcgagcttctggtccgacatggagtttgccaccgagaactggggcggcttggcaccccagggcgtccccctggtggtgaagctcgagaaccccgcccaggtttcctccattacgctttcgcagcttggcggctcgggcggcaacatcaccgtctacaccaatgaccgtcctgcactggatggggctaaaacagtaggaaccaacagcttcacctccacggacctgaccatgcctttggcggagcctgtggaggccgagtatgtgatcgtctccatcaattcgctgccgcggctggcctccccgaaaacccgttacggattcgggatccggctcgcggagatcaaggtccagtaacccgggtacctcgtccctgcggcagcggtcatgccaaccaggccggcatgaacgcggaagtctggacaaaccctggagcacgcggcgttccgttgccgtggcggtaaccttgaaagagcgcctgcggtgacggcgacctgctgtgcaccggtggtccatcgtgtcctggcgccggaataatcagcaacaagtagcagttgtgccatgtggccggcctccacgaggggcgcgtcaaccaaggaagaggttcaccgttcagtgaccatcgaagaaaacaccgcgttcgatgtacgtgatgtcatcattgtcggctccggcccggctggttacacggcagctgtctacacagcacgtgccaacctgaagccgctgatgctggccggctccgtcactgccggcggcgaactcatgaacactacagatgttgagaactatccgggctttccggaagggatcatgggtccggacctgatggagaacttcgaaaagcaggcggtccgctttggcacggagattcagttcgaggacgttaccggtcttgaacttgaaggcccggtgaagaccgtctccatcgcgacgggcgagagcttcaaggcaaaggccgtcatcctctcaacaggatccgcctatcgcgaactgggcctgccgaacgagaagcgcctttccggacacggcgttagctggtgtgcaacctgcgacggtttctttttcaaggatcaggacattgccgtgatcggtggcggtgactccgcgatggaggaggccctgttcctcaccaaattcgccaggtcggtcacggttgtgcaccgccgggactccctgaaggcttctaagatcatggctgaccgcgccctggcccatgagaagatcagcttcgtttggaacagcacggtggacgacgtcatcggcgaggagaaggtcaccggtttgaaggtgaagaaccttcttgacggaagtatctcggatcttgcagtcaccggagtgttcgttgcaatcggcaacgacccccggacagatttggttagggacgtcctggacctcacccctgagggaaccatcgcggtcgaaggccgcagctccaggaccagcattcccggcgtgtttgcggccggcgacgtggttgaccccacctaccgccaggcgattaccgcttcaggctccggctgtgtcgcggcgattgatgttgagcactacctcgcagacttgcccgcctaactaccgccacgatacccgagaagagagatcaggttatgagcaacgcaaaagacgtaacagacgcaagcttcaacacggacgtgctgtcctccgaaaaaccggtaatcgttgatttctgggccgagtggtgcggcccctgccgcaagctgggccccattctggatgagatttcggtcgagtacagcgaaaaagtggacgtcgtcaaggtgaacgtggacgacaacccagcaatcgcagccgaatacggcatcacgtcgatccccgctgtctacctcttccagggcggggaagtgaagagcacggtcatcggtgccaagccgaagcagttcttcgaaaaggaatttgccgacgtcctgtcctaggacggcgcctattcgccttaactgaatacaaaaagggtggccactgcattgcggtggccaccttttttgttcgcaaagtgggccacgccaacaacggactgcttttgaccaagaaagatgcctgccctcgtgaagtctgctggatgtgtgcagctgtttcacgtgaaacgtgatactgactggggctgcttgtccgccccacgaatggaccctccgttcaggttctcttccagaacaagcgggtcctagtcacgattcacatcccagcctcccaaccagccgtattgttcattcccaaggggaaggcgccgaacgctcagtcccggtgagtggccaggaaagcacgtcatcagccgtagaaagaagtatgtgccgccggccaaagactacaaccgccgtacgttggacctctctctgttccccgcggcgtcaaggaacttgcgaagatagtctcacgcagagcgatgagcgccagtactcccgcccccgagcggctcacaaagcgcgtgcgggtggcagtctcgcactgcttgccggggctaatgaacgaagcgagggtaaacaacgtctttatagctgactccggtacccggagcagtgttcgtttcacgtgaaacatgcacggggactcttccggtttcacgtgaaccatgcttcgacatctgcagctccagccgatttagcgtttgggctgctacgaaggggcctcaactcgtgttcaacgggtaacggccgtgcgcgcccggccggagtgccgcttagctttccatgcaaaaatgcgagtagcgctggaataatgcctcagacctgcaaccgagctgcgagccgtggacaggtgcggcacaggctgggccatcattgcgacttggccgaaagttcttcacctgacacgttatggtccatcaattgttcgaacctccttgggacgggcgctctgcctgaacacaggtcggacacccgaaacacccctgaacggaagatggactgccttgaggagtgctctgcccatctcccgggcacgcacgtctcgggggactgtgcaggagcgcattctcccaggaaccaccgcactgtggatgttgatgcctgctggaagccctgagtaccgaccttcccggatttccgactcggggacaaatggaagctcacggcgatcgactgaggacatcgacgcacgtgcagcaattaggacctcctctcgtccaacgtgccactagcgctgttcactaggcaacggttcacacactggctgaacagagtatcgcgcgtaagaagacgatacttcgcggtgttgtagccggaagggctgctccaacaacactgtttaccgactagcggagatcccgattggtaggcaactgggagtgatgcccaggtcccgtttcacgtgaaacatccctgccaagagatcgcccgcactagatcgggtctctactcgtgggaatcattgtgcttgagtcccgcagcgtgcgtctctgccaccacgttccggcactattaccgcgatcaccccctggtttaccgctgaacacgaccgcaagtcgccaacgtactgttgctgctagacagattcccttcgtattgtctcgcccctaagcgcatcagtattcacgaacccattagctccaccgagcgatggccctggacatgtcccatatactggccgtggctctgtcggcctacgtatccgcgtatgcaggccctctcaacgcaatcacagagtaacgcacactgatcgtcgggcaggcatccccggcaaaccgaaacaactgcatccgatccaccaaagcaggcaggggccgccagcggagcagggaagccgggatcgtttatggctcgctcacggacctagctgtggaccaacctacctaggcgcccggacgagaacttgttcacaaaaacagagggcagcgtgtgtgctcgagagccggtatgcagtcctgccagcaggctgatatccacacggttttccacagcagcagcgctccgtattcacagcgatatccacagccccggacggcggcgtggatccgtgcacaacgcggatatcgccaaaatctccttcggtgccgtaagttgcctgagaatctcccgtctcacctatcttgccttttgccacctagcggcgggcgggagccgatagccgcgtagaaagtagcttcgcgagggtgatttccacgcgggacgcgcacccccgccacctagccctacaatgtttcacgtgaaacgcaaagcgacatcctcttcaccgcggctggagcgcaccacaactacatttcttccgggtcccgcagagcatctgtattcacctccctgaagccgcggcgatagctcgtcatccacagagttatccacaacgaaatcccggtctaacaacgagccatctaagtgtgagtgggcagactttaccgaggcaagcatggcgggtaccgccctgcgataaacgcacttaggcaatgggcaatgtgatgccgccacgtgaccgttgttgagccggccgttggagcgcataaccctttgcaaccaggtacacaggccacatgcggtaggcgccgaacgcaccagaggacgcgtcctgatcgaggagcttggccgttccctagtcgaaagagtgcgcctaacctgcagatgacattccttcgaaaggcagtctttagtccacttgcgcctgcgtcggacacctacacttagtggccgccccagaccgggaggggaaaaccatcgcagttccacgtacgttggtatagggcgatcggccttcagcgtagggtttcgttggctcggccgccaggaggcgtggagattgaatttgtgcagctatgcgatacgcgagtttgtcatcctgcgggtccacttacgggggagaccgtgcacgtgcggcctcgtcgaccaacgcgtatcacaaggctggttgtccatcttcgcccgtttctctcagtgctcctccgccttgcacctgtccctggccgtagcgactgttcgtattcctcttctgattgctctcacgcctcggaacctgtcagctcctggcgctccactcttggtgtttcacgtgaaacaccaagggctgccggacatcgagggctgacagggcttatcgtcatagtcagggtcgtgggtgcgtaggacccagcagagagcctccgtgcagcctcgagttgggggtaggggaacctacgccgcgggtagtccatcgaagccccggcaagggatcctgagctgctgcaggagcatttacagcttcatcgggtccccactgtcattcacaaactttcgtggctggctcctgccacgcttcgctacattctgggcccgactgcacatccggaactgcagaagcggccaaactgcgcagaggcggccgcggagagtgccgagatcggcaatctccgcacatcagttccttcagtttcacgtgaaacattcggggaaggctagctcgtgcagggcatgaggatcctccctttgagactgtgctgcgcccacttccgaagcatccataccccgacatcgatacgtcctggtctcggccacatagccaacccagtcagcgagaattcgaccattaggtagatttaccgcaccattcaagggttcgcgcaattccactaaatccctcagaggcgagatgaaaatcctgcgtacctatctaatgcttccctcctatgaatgggacatcaggcttcaacagtccttggcatcgtagacctagaggcgacacagccttgaaggcgtaggtgctgacacgggactgtttcacgtgaaacgcaatgcctccatgcaccagtcctagtaagtcgagcccggatggacacctggctgccactttcgtctcgatatggcagctattcagccccaagttgccgaaactggggccgacatttcagcagcataagcattgggacgaaatatgaccgcgcgaactgccatacaggaaaatcagacctatgtcttccctctggatcagcgccagtattgacttggtatccagccttccaacctcgtcaaaaggttttcaccccggcgtgactagcctactcgcctcggaatagcccattatctctgcagtcgttcccacgggtgacggtcccgaatacgagtaaggcccgattcggtgtgaatcgggccttactgaagctactgaacacatcttcctagccggtttggccgggggccaaaacctccataatgcgattaaggtcctccacgctggcaaattcaatgcttactttgcctttacgcacaccgagagagatcttgacgttcgtatccagccggtcggagagtgatgatgccaggtagtcgagccgctcatgacgagcacctggacggggaatgttgttcttcacgggtttggccggatcctggtaaagcgtcacagcttcttcagtcgcccgaaccgacatgccctccgcaacaatcttctgagccaagcgctccatggctgcggcgtcaggaagcgccaagagggcgcgagcgtggcctgcagaaagaacgccggctgctacacggcgctgcaccagcggaggcagcttgaggagacgcaaggtgttcgagacctgcggccgggaacggccaatgcggtccgccagctgctcgtgagtagttccgaagtcttcgaggagctgctggtaggcggcagcttcttcgaggggattcagctggctgcggtgcaggttttcgagcagtgcatcccggagcaggtcgtcatccgtcgtctcgcggacgatcgcggggatagtttccaggccggcagcctgtactgccctccaccggcgttcacccataacgagctcaaacggctcactaccctcttcggttgatttcctgaccacaattggctggaggacaccgatttcgcgtaccgagtggacgagctccgccatgtcgtcttcatcgaagacggaacgcggctgtttgcggttggggtggatgtcagagaccggaatctcagcaaaccgaacaccaggaacctcgaccaggtccacgccgtcgtcatcccacacaggggtttcagatcgcacactggacacatctgcggacactgcggccccaggcgtgcccatcggctccggcgcggtgtcaccggcatcgtctgttgtaccggccgatgtggccggggactgcgtctttgccttcgctgcagtgctgggcttggatgccggacttccagcatccgttcctttccctgcagcggacttggctgaggagggcttggccgagggcttggaggacccagccgccgcacgcttgtctgctgcgggcttcgacgactgagtctcgacggtgtcctctgaaggctccgtctttttacgtccctcagggaagaagagatctacaggacgcgagacggttgtcgcagtgcccgacccgctggcggcggcggaacttggaatcagcgcaccaagaccgcggcccaggccgcgtcgtttctcgctcattggtaatccctccagtggtagagccaggcgttaccaggctccagtcgttgcagtttgaagattttagcgctctgctatttcagcagcggcttccagataagacagggctccgctggaggaagggtcgtacgtcattaccgtctgctggtagctcggtgcttccgagatgcgcaccgagcgcggaaccacagcagagaggacctgatccgggaagtgctggcgtacctcggccgcaacctgggctgcgaggttggtacggccgtcgtacatggtcaaaaggatagtcgacaccaccagatcggcattcaggtgcttctggatcatctcaatattcttcagcagctggctcaggccttcaagtgcgtagtactcacactggatgggaatgagtacctcgttggctgcgcagaaagcgttgacggtcagcagcccaaggcttggcgggcaatcgatgaagatgtagtcgagccgctgctcgccgttcttctcccgggttttggcgtagacatcaatggcacgccgaagccgctgctcacgggccaccagggaaaccagctcaatctccgcgcctgccaggtgaatggttgcgggcgcgcagatcaggttcccgatgtcagggcagggtgccaccacatctgcgaggggcacatcgttgatcaggacatcgtagatgctgtccacgtccgcgtgatgttcaattcccagggcagtggaagcgttgccctgcgggtcaatgtcgatcaccaggacattgaggccagccgccgccagggcagctgcaatgttcacggtggtggtggtctttcccaccccacccttttggttggagaccgtgaaaatgcgggtgttctcaggccgcggcagttggcggcctaccaagcgttcgcggcgtttcgtttcatgcgccagctcacgggcgatggggctggaatcgtcgattgcatcaatcacgttggctttaccgccagcggttgtttcacgtgaaacggacgctgactttgaagcgtttgaaaccttctgtggatgcattccgcctctgcccggagtggtgacgggaccagcgacagaacgtgctgaccccaaagacacaaacgggggtatccgctgtgtggaggcttcactactggtcactggggcacactcactctcgttcagccaaatttgctgccgttgtctagcctaactgctggacccgccagagttaggccaccgggcccgaactaggccttcttttgggacttgtttacaacgatgcgcaccacggtggtgggttcctccaggaggttctcaccaacagtaagaactgatgtctcgacgccacccagcttccggatggtcttcgcggctttttcgatctcctcggcggcgctgcggcccttgatggctaccacctcgcccttgccggcaagaaggggaatggtcagtccggcgaggttactgagggccgaaacagccctggccgtcactacatccgcctcgacatgccccactgccagttcagcccgggtccgcatcactgtcacgttgtccaggcccaggtcgtcaacaacttcctggagccaaatcaccctgcgttccaacggctcgatgagggtcagctccagatctggccgggcaatcgccaggcacagcccgggcaggcctgcaccgctgccgacgtcggcaacgcggctcccctcggggatctcactctcaatgacggcgcagttaaggacgtgccggctccacaggcgggggatctcacgcggcccgatgagtccgcgctctgtgccggaggtcgccaggtgttccacatagcgtttagccaggtccaaccggtcgccgaagatcttctccgcggccgaaagctcagctggcgtaatgtcaaccatggttaggggatcagccattctctactcggcggatacaacgatgtggcgtccggcgccttcgccctcggactcgctgaccagtcccaggtcagcaacggcatcatggacgattttccgctcgtaggcgctcatcggctccagtgccaccggctgtccgctttccttcacagaagctgcggcgtcctcggcaaccttctgcaggtggccggtacgctcctgccggtaaccgttgatgtcaagcaccagccgcgagcggttctccgttgcggacagcacagaaagccgggtcagttcctggagggcttcgaggacctcaccgtcctcacccaccaggctgtccagggcgtctgattcttcctcggtcacgatggagatataggtgcgtccgttacggacctcaatgtcgatgtctccatcgatgtcggcgatgtccaacagttcctcgaggtagtccgctgcaacgtctccctcttcttccaggcggctggctgaggaggccttgggcagggaagcctccccgttctcggacgcgtcctgatcgtcgatgatctcctcggacagggcgtgttcggtgctctcggcagacattacttcttcttcctgttcttgcgttgtggctggatacgctggccctttgcctgtgccacggccgcggcggcagcagcggcgtcggcggcctcgtccttctttccgcccagaatggggagggccggaaggcccttggcggcccggcgctcggcgagggcctttgcggcgggggatcccggcgtcggcatgcggcggatcacaaagaactgctgtcccatggtccaaaggttggtggtggtccagtagatgaggacgccgatcggaaagttgatgccgccaacaccgaagacaatcggcaggatgtagagcatcatcttctgctggcgcatgaacgggctggccatggcttcttcggacatgttcttggccatgatctgcttctgcgtgatgaactgcgaggcagtcatggcgaggatcatcaggatggaaagaatccagaccgccaccacattgcctccgggaggtgtcccgtgaagcagagttgcagacaggggagccccgaagatggtggactggtcaaactgcaccacctgctctgggctcatggcgccgataccctcgccctcgcggcttgccgtcgagatgccggacagcactgtgaacagcgcgaagaagaacggcatctggatcagcatgggaaggcaggccgagaacgggttggtcccgtgcttcttgtacatggccatctgttcctgcgccattgcctggcgggacagctggtcggtcttgcccttgtacttgtcctggagcttcttgaggtcgggctgcagcagctgcatgccgcgctgggccttgatctgcttgacgaacacggggatcagggcggcacggatcaccagcaccaggccgatgatggacagcgtccacgtccagccggaagcttccggcagcccaatggcagtcagtccctcatggaatcccaccatgatgatggacacaagccatttgaacggaaacatgattgtttcaaagaagtccatacttatccctattcgtcaggccgcactgcggccttctccatcagtccgagcagccaggtacttgtccgggttgttcagcacaacaattgtgggggtctggtgctccggccattcccgatggccggcggggacgtggtccacaccgccggcattccatgggtggcagcggccaaggcgccggacagcgagccagcttcccttgacggcgccatggacagtgacagcttccagcgcataggccgagcaggaggggaaaaaccggcacacctggccgtacaagggtgaaatcaccttgcggtaggccttgagaagaagaatgagaacgttccggggcaggtcccacaggaacagccccacggctgcggcaccacgttggagagaagtaacgacgacggcggtggcgttacgcacgcggtgtcccctcctgtgttgtaccggccgaatccttggcagcagcccttgcggggcggccggccagccggaccatcgtcgattccaatgcggcattgtaatccgacaacagctggtcccagctggcagttgcggacgcaggaagcgcccggaccactatggcaaacccggtaccgtactcgcgcagcgaggcagcacctgcttctctcagtctcctcttaacgaggttcctgaccacagcgttccctacactcttggaaacgatgaacccgatccggctgggttcgccagcagcaatggctgccgtatataacactacgttccggcgtccattgcggacaccggaacgtacagttgttgaaaaatcggatgcagtcctcaaacggttacgggtggccagcaccttaaactcgcaaagaaatgtctaccgacgagtcagtatttaggccgacagctcggtgcgacccttgccacgacgggctgccaggatggcacggccggcacgggtacgcatacgaaggcggaagccgtgcttcttggctcgacggcggttattcggctgaaaagtccgcttgctcacgttagttactccagtggatcaaaggtgcgcccacccgatcagtatggggaagaactggccgacgctaagttttgtatatgcacgcttcccccggctgcccaagcgcactgcgcctgagagattcagatggggccaaaaagcggacacaaaggacttcacaacgttagggcaatttaggcccccgagtcaaaccggaaccccctatggccgctatccccagctgtgcctaacctgcccctggagcctgtggatgaagtggctcacagcccccttttccgaaccacaccggtgtaattatccacaagctacttgccagctatcttctaggcttttcatcccctagagtggcccagtagccgattatccacggactgtgcataaccctgtggatgaagctgaatccaatctggttcatgacttgcggctgcaggcaatgcaggcaaagcaagttttgagggaaccgattgatgacagtagacgaagccaaccacgccaatactgtcggaagttcctggcggcgggttgtcagcctgctggagcaggaccaccgtgtttcaccgcggcagcggggctttgtcatcctcgcccaggcccagggcctgatcggttccaccctcctggtggccgtccccaacgagctcacccgcgaagtgctccagacccaggtcaaggacgcactggatgatgcgctgcacaacgttttctccgaggacatccgctgcgccatcgacgtcgatacagatttggtgcccatccacacggaacctgaacccgtcgacgtcgagccgtccttctccgcggaccagctcatcgaacagaagccgcagccgatgctgcccagcacgtcgcacgaattcggccggctgaacccgaagtacgtcttcgataccttcgttattggttcgtccaaccgctttgcccacgccgccgccgtcgcagtggctgaagcgcccgccaaggcgtacaacccgctgttcatctacggcgactccggactcggaaaaacgcacctcctgcacgcaatcggccactatgcccggcggctctacagcggaatccgcgtccgctacgtgaattcggaggagttcaccaacgacttcatcaactccatccgtgacgatgaaggcgcaagcttcaagaccacctaccgcaacgtcgacgtactgctcatcgatgacatccagttcctcgcaggcaaggaccggacgctcgaggagttcttccacacgttcaactcgctgcacaacaacaacaagcaggtagtgatcacctcggaccagccgcccaagctgctggcagggttcgaggaccgcatgaagtcacgcttcgagtggggcctcctcaccgatatccagccgccggaacttgaaacccgaattgccatcctccgcaagaaggcgctcagcgaagggctgtccgctccggatgacgccctcgagtacatcgcatccaagatctccagcaatatccgggagctcgaaggcgcgctgatccgcgttaccgcgttcgccagcctcaaccgccagcccgttgacgtggcccttgccgagatggtcctcaaggacctcatcaccgacgacggcgcccaggagatcacgtccagccagatcctccagcagaccgccgagtacttcaagctgagcatggaagagctgtgcagcaaatcgcgcacccgcacactggtaactgcacgccaaatcgccatgtacctctgccgtgaactgacggacatgtcgctgccgaagattggccaggagcttggcggccgcgaccacaccacggtgatccatgccgacaggaagatccgcgagctgatggccgagcgccgtgtgatttacaaccaggtgacggagctgaccaaccggatcaagcagcagcagcgcgactcgtagccgccgcatctataccttattaacaggcgcatgtggataagcctgtggatacttaaggggacaaccgcggttaatgggcttaaaacccttaaggcgcctgtggattcgaaaaatcgcgaaaaatgttgtccccatccacaccctgtttaaaacctccgccgcccacagtccatgaacagggcttaaccgccggatcctgcggtgagggagagttatccacagtttccacagcagttattaacactactaatcccaagaaattgaaatccctcaaacaacaagaccggtccgccctcccgaacctctccaggccaagcggcccaaagggggcccggctgacttgggggatgggttaatcccggatcttccggctaagctgtcagcagcgctcccatccttgggttttgtgtggttccttcagcacggaccatgcaccagcacgggcggggcaacaactcttcggaactcccggcgggacgtttcaagaacatcaacgcagcagcaatgaaaggcggcacccttccgtgaagttcagagtcgatcgggacgtcctggcagaagccgtcacctggacagcccgctcgttgtctccgcggccgcccgtaccggtcctgtccggtttgctgttgaaggccgaagccggcacggtgagcctctcgagctttgactacgagacctctgcccgcctggaaatcgcagcggacatcagggacgagggcaccatcctggtctccggccggctcctggccgacatctgccgcagcctgccctctgcacccgtcgacgtcgaaaccgacggcaacaaagtcaccctcacctgccgccgcagcagcttccacctggccaccatgcccgaagccgagtacccgccgcttcccgcacttccgcccatcagcggcaccgttcccggtgatgctttcgcccaggcggtatcgcaggtgatcatcgccgcgagcaaggacgacactttgcccatcctcaccggggtacggatggaaatcgaggatgacctcattacgctcctcgccaccgaccgctacaggctggccatgcgcgaggtgccgtggaagccggtcactcccggcatctcaaccagcgcactggtcaaggcaaaaaccttgaacgaagttgccaagacccttggcaacagcggcgacgttcacctcgccctcgccgatgacgagagccggctgatcggcttcgaaagcgggggacgcaccaccacctcgttgctggttgacggcgactaccccaagatccgctcacttttccctgactccacccccatccacgccaccgtacaaacccaggaactcgtggaagcagtgcggcgcgtctccctcgtggcggagcgcaacaccccggtgcgcctggccttcacccagggccagctgaacctggacgccggcaccggagaagacgcccaggcctccgaagaactggaagcccagctttccggcgaggacatcaccgtggccttcaacccccattacctggtggaggggctgagcgtgattgaaaccaaattcgtccggttctcgttcaccacggcacccaagcccgccatgatcacagcccaggcagacgccgacggcgaggaccaggatgactaccgctacctggtgatgccggtccgcctccccaactagtccccaccgccaccctcgcctcgcaagctcggccagggaaccctggcggcgtgggcccaccagttgggctacccaccctcccccctagcgcagaaaagagttccaccatgcacattggactgatcggccttggcaaaatgggattcaacatgcgcgaacggctgcgcaagggcggggttgaggtcaccggatatgaccgcaacccggacgtgacggacgccggatccatcgatgagctcctggccgcggttcccacgccccggctcatctgggtcatggtccctgccggcgacatcaccgacgccgtcatcaaggagttgggcgaaaagctcagcgagggcgacctggtgattgacggcggcaattcccgcttcaccgaagaccagaaacacggcgaactcctcgccgccaaggggatccacttcgcggactgcggagtatccggcggagtctggggactgcagaacggctacggcctcatggccggcggcgacgccgccgatattgagcgtgcgcttccggtcttcgacgccctgcgccctgagggggaccgggcggacagctttgtccacgtgggcgggatcggtgcaggccattacgccaagatggtccacaacggaatcgaatacggcctgatgcaggcatatgccgagggctaccagctgctggcttccaaggacatcatcagcgacctgcccggaacattccgcgcctggcaaaagggcaccgtggtccggtcctggctgctggacctgctggtcaaagccctcgatgaggatccgggcctgcaaaacatcgacgactacgtcgaggattccggtgagggcaggtggaccgtggaagaagccattgccaatgcgattccggcgccggccatcactgcggcgcttttcgcccggtttgaatcccgcgaggacagctccccggccatgaagatggtgtccgcgctgcggcaccagttcggcggccacgccacccgtcccgccaagtaatacccagcagggaaccgcgaggttcccggaattgccgaaaaaccgcgtgtacctagaacacctctccctgactgacttccgcagttatgcccaggtggaccttgccctggggccgggtgtcactgtccttgtgggatacaacggcatcggcaaaaccaacctgatggaagccatcggctacctggccacactgagctcacaccgcgtcagctcggatgcgcccctgctccggttcggaacggaacgtgcgctggtccgggccaggctggtccgcggggaacagatcacggtcctggaactggaaatcaatgcggggcgggcaaaccgcggacgcatcaaccgcagcaatccggtgcgggcacgcgatctcctggggatctgccagacagtacttttcgcaccggaagacctggccctggtgaagggcgatccttccaaccgacgccggttcctcgatgaactgctggccagcctcgttccgcaccacgccgccacgcgcagcgattacgaccgtgtcctgaaacaacgcaatgcgctgctcaaatcagcccgcgccggaaagttcacgccggcccatgaggcgaccctggacgtgtgggaccaacacatggcgaaagccggggccgaactgctgcacgcgcggcttgaactggtggaacggctgcggccgcacctgggccgtgcctatgcggagctgaccgacgcatccaaacccgccgacgccgtctaccgttccagcctccaaaaccagatggacgacgacggcgccccgctgatgcgtgcagccggcaccggtggcggtggtgctgcatcagacgtggaagacctgcgccagctgtccgtggaacagctggcggaacggtacgtcaaggctttcgcggactcccgccgcaaggagatagagcggggcatttcgctcgtgggtccgcaccgtgacgaactggaactcatcctgggccaggcgccggccaaaggctatgcttcgcacggcgaaacctggtccatgtgcctgtcccttcggctcgcctcctactatgtgatgctggacgacacccggacagggggctcggctcccatcctgatcctggacgacgtttttgccgagcttgacgtccagcggcggcgtaaactggccgcaatagtctccggcgcggaacaggtcctggtgaccgccgccgtcgacgccgacatcccggaagagctctcgggacggcgggtgaaggtcatcccgggaggtatcgatgagcagggacagtgaaaaaggcggcgggcttcagcccggccgcgaccccgacaacatcgatgctccccaggtcgccctgaacaggatgcgggaggcagccgcagcgcgcggcgagatccgcaggaccgcatcccgttcgggctccgccaaagccaaaaaaggcatccgggacacccgcggcttcagccagttccacgccagcggccgcgaccccctcggcctgggcaaggtggttggacgcttggtggcggagcgcggctggacgtcgccggtggcggtgggatccgtcatggccgaatgggccaccttggttggccccgaaatttcggcccattgcacgcccgagagctttaccgacaccaccctccacgtccgctgcgactcaaccgcctgggccacccagctccggctcctcagcaccagccttctggagaagttccgggtggagctgggggacggagtggtcacgagcatccaggttctgggcccttctgcaccgagttggcgcaagggcggccggtccgtgaacgggcgcggtccccgtgacacctacgggtagtgccggcggcgcactcttgaaaatcgacgtaacggcgtgtagagccttgaaagggccggagggtgtataggcacccggaggccgtcctgccagcgcgcccaaggcgcgactaacggcctcccgcaggcacaccaccgcccggggaaggccctggaatgcggggaattggccgcctgcacggtagaatccttgtagataactgggcgcgggtgaacgttgactgggtccgttttccgcgcgtttcaggcccgcggagcgcggatccaccgtcagccatacatcggcgctacaagtttgtgcctgttggcggatgacttccctgcagtaaccggggaaggattcggccggccatcatcgagaacagaggagtcgacagcgcctgtggctaacgacaatacagatattctggcagctgaacccgcagtcgaggatgcccgtacgcctgacaccccggccgcaccagggacgcagcgtgaatatggcgccagcgacatcactgtccttgaaggcctggaagccgtccggaaacgtccaggcatgtacatcggctccacagggccccgcggactccaccacctggtctatgaagttgttgacaactccgtggacgaggccctggccggttactgcacgcacattgaggttgtccttcaggccgacggcggcgtgaaggttgtggacgacggccgcggcatccccgtggacatgcaccccacggaacacaaacccacagttgaagtggtcatgaccatcctgcacgccggcggaaagttcggcggcggcggatacgccgtctcgggcggcctccacggcgtgggcatttcggtcgtgaacgctctttccaaccgcgtggatacggaagttcggcgccagggccacgtatggcgcatgtctttcgcggacgggggcaagccccagggcagcctggtcaagggcgaagagacggaccgcaccggcaccacccagacgttctacccggatccggcaatcttcgaagtcaccgagttcgacttcgagacgctccgcgcccgcttccagcagatggccttcctcaacaagggactccgcatcacgctcacggacgagcgcacctccgccgaagcggacggcgacgccgacctggatctggacgccgtcgtcaccgagggcgaggtcagcgcggaacaccgcaccgtggtgtaccagtacgacgacggcctgctggactacgtcaagcacctgaactcgggcaagaaggttgacgtggtccacgaggacgtcatcgccttcgaaaccgaggacaaggaccggaagattgccctggaaatggcgatgcagtggaccaacgcgtactccgaaagcgtccacacctacgccaacaccatcaacacgcatgagggcggcacccacgaagagggtttccgggccgcgatgacgtccctaatcaaccgctacgcgcgcgagaagggaatcatcaaggaaaaggacgacaacctgaccggcgatgacatccgcgaaggcctcacggctgtcatctccgtgaaactcgccgaaccccagttcgaagggcagaccaaaaccaagctcggcaactcggaggtcaagggctttgtccagcgcgtggtcaccgacggcctgggtgactggctggagcgcaacccgggccctgcccgtgacgtcatccggaaggcgatctccgcggcgcaggcacggatggccgcacgcaaggcccgtgacaacgcccgccgcaagagtccgctcgaatccttcggcatgcccggcaagctctccgactgctcctcgaagaacccggagaaatgtgaggtctacattgtggagggcgactccgccggcggttccgccaagcgcggccgcaacccggagacccaggccatccttcccctgcgcggaaagatcctgaacgtggaacgcgcgcgcctggacaaagcgctgggcaacgccgaagtccagtccatgatcactgccttcggcacgggcatcggcgaggacttcgacctctccaagctgcggtaccacaagatcgtcctgatggcggatgccgacgtggatggccagcacatcacaaccctgctgatgaccctgctgttccgctacatgcggcccctgatcgagaacggctatgtttacctggcgcagccgccgctgtaccgcatcaagtggtccaacgctgcccacgactacgtgtacagcgaccgcgaacgcgatgcgaaactcgtggccggacaggctgccgggcgccggatccccaaggacaacggcatccagcgttacaagggcctcggcgaaatggattacaccgagctgtgggacaccaccatggacccggaccaccgcacgctgctgcaggtgacgatggacgacgccctcgccgccgaccagatcttctcggtccttatgggcgaggacgtcgagtcacgccgcaacttcatccagcagaacgccaaggacgtcaggttcctcgatatctaggactaggtcctgcagatattcggttactgacatatacctgaaacggaaattaatatgagcgacgaaacacccgagaacccggcctccgaagccggcactccggacaccgttcttgaaggcgacgtgctgatagaccgcgtggagcaggtggacctgcagacggaaatgcagcggtcctacctcgactatgcgatggctgtcattgttggccgtgcccttcccgacgtccgcgacggactgaagcctgtccaccgcagggtcctttatgcgatgttcgacggcggctaccggccggaccgctccttcaacaagtgcgcccgcgtggtgggcgaggtcatgggccagtaccacccccacggcgacaccgcgatctacgatgcgttggtccgccttatccaggactggacgatgcggtatcccttggccctcggccagggcaacttcggttccccgggcaacgacggcgctgccgcgccgcgttataccgaaaccaagatggcgccgctggccatggagatggtccgtgacatcgacgaggaaaccgtcgatttccaggacaactacgacggcaagaaccaggaacccaccatcctgcccgcccgtttccccaacctgctggtgaacggctcctcaggcatcgccgtcgggatggccaccaacattccgccgcacaacctccgcgaagtagccgacggtgtgcagtggtacctgtccaaccccacggccagccgcgaggaactgctggaagaactcctgctgcgggtcaagggcccggatttccccaccggcgccaccatcctgggccacaagggcatcgaggacgcttaccggaccggccgcggttcggtcaccatgcgtgccgtggtaaacgtcgaggaactccagggccgcacctgcctggtggtcacggagctcccgtaccaggccaacccggacaacctggccatcaagatcgccgaactcgtcaaagacggcaagatgcagggcatcgccgacctccgggacgagacctccggccgcaccggacagcggctggtcatcgtcctcaagcgggacgccgtgcccaaggtggtgctgaacaacctctacaagcacaccgaactgcagagcaacttttccgccaacatgctggccatcgtggacggcgttccccggacgctgagcctggacgccttcatccggcactgggtgacccaccagatggacgtcatcgcccgccgtacccggtaccggctgcgcaaggccgaggaagaagcccatatcctgcgggcactcctgaaggcactggacatgctggacgaagtgatcgccctgatccgcgcctccaacaccaccgaagcggcccgtgacggcctgatggagctgctggacatcgacgaactgcaggcccgggccatcctggacatgcagctgcgccgccttgccgcccttgaacgccagaagatccaggaccggcacgccgaactcgaagccctgatcgccgagtacaaccagatcctcggctccgagcagcgccagcgggagatcatcagcaccgagctgggcgaaatcgtggacaagcacggggatgaccgccgcaccaagatcctcatgggcttcgacggggacatgtccatggaggacctcattcccgaagaggaaatggtggtcaccattacccggggcggctacgtcaagcgaacccgcagcgacaactaccgttcccagcagcgcggcggcaagggcatcaagggtgcccagctccgcggtgacgacgtggtggagcacttcttcgtcaccacaacccaccactggctcctcttcttcacaaacctcggccgcgtttaccgtgccaaggcttacgaactgatggaagccggccgggacgccaagggccagcacgtggccaacctgatggcattccagccggacgagcacatcgcgcaggtcctggacttgaaggactaccagcaggctccctacctggtgctggcaaccaaacgagggctggtaaagaagacccggctggaggattacgacaccaaccgctccgccggcgttatcgccatcaacctccgcgacggggacgagctggtgtccgcacagctggtgtccgaaaccgacgacctgctgctggtatcccgtaagggccagtccattcgcttcaccgcaaccgaggatgccctccgccccatgggccgggccacctccggcgtcaccggcatgaaattccgcgaagaggatgagctgctggccgccaacgtggtgaccgacggctcctacgtcttcatcgtcaccgagggcggctacgccaaacggacagctgtagaggaataccggctccagggccgtggcggactggggatcaaggtagccaagctcgcggaggagcgtggagacctggtgggggcactgattgtccaggaagaggacgaggtgctggtggtcatggagggcggcaaggtggtccgctcctcggttgccggagtccccgccaagggacgcgacaccatgggcgtcatcttcgccaagccggacaaaaacgaccggattatcgaggtggcacgcaacagcgaacggggtcttgagggcgaggaatcgccggaggatgacgtaacgttggctgaagatggcggatcctccgaggattccaccagcccagcagtggcagaagaatcaccggccgttgagtcagaggacgcctcgggcgacgctgagccgaacgaagactacacggaaggtaacgagtgagtaatcccgactcatttcccaagtcgaacagcaccgctcctgacggaaaccggccctcagccgcaccacgggtaaacgctcccgtccgtccgcagcagcgcccggccgcccccgccgccgcgcccgggcaagcgccccggccgcttcccgg

SEQ ID NO: 23 - DNA, 325966 bp, Arthrobacter sp. OY3WO11
ggccagggcaacgcaggccttgtgaagcctgctccgaaagcaaaggtccggcgagcacggctgctcatcagcaaggtggacccgtggtctgtcctgaagatggccttcctcctgtccgtggccctgggaatcgtcacggttgtggccgccattgtcctgtggactgtccttgacctgacgggcatctttgaccaggtggacagcctgctgggcacgctggccggctccgagggcggcggctttgagctgaagaaggtggcttccctgggccaggtggcctctttcgccactatcatcgcggtggtgaacgtggtcctgctgaccgcgctttccatgctttcggctgtgctgtacaacatctccgccaccctggtgggcggcatcggcgttaccctcacggacgactaaggtcccgtttccgcaggcctgacagctgcggaaaggcccgatttgagatcgggccgggatgtgctgtaaagtcatgtctcggcccgatgaggcatcggggcgtatagctcaggcggttagagcgcttcgctgataacgaagaggtcccaggttcaagtcctggtacgcccacggaacctgtgcaggttcaagtgtaggtctggatgtgtaacccgcagccggaccggaacggggagcatgtgaagaagttgcttgtattggcagcggcaatcgcaggcgtcctgctctaccgaaaagcacaggagtccgaggcccggaaggatgtctggagcaagtcaaccgacacggtggactagccccggggcccggaacggagctggtcaaaggctccctggttctagggtatgattgacgggttgcttcttatgggggcatggcgcaattggtagcgcacctgctttgcaagcagggggttcggggttcgagtccccgtgcctccaccataagaaagtcccggtcagcggaaacgctggccgggacttttgctttggcagccggaccgcacaatccccggcccgagcgcccattagggtagtgcagtgaacttctttctcgcagccgtcggcgtactgggcgtcgcctcgtccggccccttgattgctgccaccctcggggccacaaccgtgagtgccctggccattgcattctggcgcaacgccatcggcgctgccgtgatggcctctcccaccctgatcagggagccccggaagttcggccagatctcccgacgcgagttccgctggtgcctgctggccgccgtcgcgctggccctgcatttcgcctgcttcatcacctccctgcagctcacctccgttgccgcagccacggcactggtatgccttcagtccgcctggatagccgtcttccagctcttccgcgggatccgccaccggtggcaggtgctggcgggcctcggcatcgcttttgccggcgtcgttgccatcaccggattcgacatgggttcttcaccggacgccctgctgggtgacctgctggccgtcgccggcggggcgctggccggcctctacacactggcaggaggaaaagcccggcaaagcatgacgacgggcacctacaccacgctctgctacggaatgtgcgcagccctggtcgccgtactggcggccctgggcagacagcccctggtggggtttgaagccgcgggctggctggggatcctggccatcacggtctgtgcacagctggtggggcataccgcgttcaaccacctgctggccaccatgagtccgctcctggtttccatgatcatcctcctggagatcccgggtgctgcacttcttgccgcggtcttcctccacgagacacttcccgccggtacttacgccggcctggggcttatcctggcgggacttgccgtcgtggtgctgggccagcggtcgggcaaagccgcacgccgcgtaagcccggcggcaaacgggcgggaggaaccgccgtcggaccggccgctcgcggagctgggaaccgactgacgccggccgcgctctttggcctctactgaccgccgcggcgcactggctgggcggtattcacggtgtggatggcccgcaggagcttggcggggaagtacaccgagaagaacaccaccatgggagccttcagcgccatcttcttgacgttgtgggccttgtaggtccggtcgaagcgggtgacgtagtagcggtaatccctcggtgaatcctcaagcctgcgggcagacatcccggacaccatctgggggcagtactggatcttcagatcgttctcggccagatgcagggacaggtcgatgtcctcatgcatctcgtccctttcgtcacggcaggtttcggcccggatggtatcccaggcggtggaacgcagtgccatgttggagccgaagaggaaatgatactggtgcttggccagcttcaacatgagctggcgcattttgtcgtctgccttgaggccaaagcggcgcatcggcatgtcgtagtacaccaccggtcccgtggccgcctggacggactggtcgaggaaggctttctgcacctgctccacccagtccggctccaccacagaatcggcgtcgatcctgcccaggacatccccggttgcatggtccagcccgaagttccgggtggggatgagcccctgctcctggtcctggctcagcaggacgatgggggtttccgggtactcgagctgcatctgttgcacaatgcgggccgtgcggtccttggacaggttgtccacaaccacgatctcgtgggccgggacggactggtagatggcagctatgaggcactgccggatgacgctctcctcgttgtacgccgggatgacaatggacacgcggggcaggtctgctgcgtcgttcaaggcatccccagaggattgttcggctgacatcggttcaaatctagcaccgaacggtgccccgcctccgaaacgccggagccatctgagacaggaaaagggccccgccttgcggcgaggccctttccggctgatgttccggcccggcggggaccggatacatcaggaatgttgcatcaggactgtgacgcgcccttgtcaccgttgccgatgttggaggcgatgttcttggtggcggtcttcgcgtccgtggctgccttcgctgtgctgtccgcagcgtcctcggccacgtgcttggctttctccccggtttcctcagccttgtccgtgggggtgccagcctcggccgttgccggggctgccgcggctaccggtgactcctggacctcgttcaccgtggtggcgggtacgggtgcaggcgtgggtgttaccggtgacggggtcttccaggggtcttccaccggcttggaagccttccaggccgcgacgccggcggcaaccgcagccgcgatcacaccgaaaaccagccagccgcgcttcttcttggggggttccggctgtgcaagctggatgcccaccgtgcggccagcttcggttgctgctgccttcagctgggtaccggtggcctgcgcctgttcctggagggcgtggatgattcccacatcgccaagtttgtgggcgacggcatcgacccgtgcaggcgcgttctccagcgtgcggtgcacggcgtaggaggcggaaccgatctggtccgaaaggcgcgggaggtattccacaaccacgcggtcgcgggcgttgaggatcaccggggtggccttgtccagggcctcgtgcaggcggggcgacgcattgtccacagcatcgttgattttaggagcgagctgggccaggccgtcctggatgcgcggggtcaccgttgcaacaccgtcggccaggttgtgggccgcggacttcaggccttcctggacctttggagacgcggtgtccaggccatgctggagacggtcaatggctgcttccacacggggggctgcccaatccttggcattctccactgcgctggtgactgacagttcaaggtcacgggcaatacggtccgacttcttcactactacctcccgattaatgtgacggttctgtggttagcctacgtggcttggtgttcacctgctattcccccagcggattttaggaggatttcacccagcgcggaactgcggcggcagccgttcgctccccagaccgccgtggaagaatagggcctatgactgccacagcaactgcaaaagcaaccatccacaccagcctcggcgacatcgtcgtcaacctcttcggcaaccacgcccccaagacggtcaagaacttcgttggcctcgccacgggtgagcaggcatggacccacccggagacgggcgaagacaagagcggtacgcccctgtacaacggcaccatcttccaccgcatcatcaaggacttcatggtccaggccggcgatccgctgggccgcggcacgggcggtccgggctaccagttcgacgacgagatccaccccgaacttagcttcaaccagccctacaagctggccatggccaacgccggcatccggatgggcaagggcaccaacggctcgcagttcttcatcaccaccattcccaccgactggctgcagggcaagcacaccatcttcggtgaggtggcggacgatgactccaagaaggttgttgacgccatcgagggcgtgcgcaccggcatgggcgaccgtccggtggaggatgtcaccatcaacagcatcgacatcgaacagctgtaataccgcaccatgagttacggaattccggcggctgagccgtccgcccaggttccggtgtgcccgcggcacccggaccggccctcctacgtccgctgccagcgctgcgggcgaccggcctgccccgactgccagcgggcggccgccgtcggattccagtgcgtggactgcgtcaacgaaacaaaacgtacgacgccggaggtgcggaccgtctatggcggtgccgccgctgccggcaaaccacgggtgacgttcgggatcatcgcagtgtgcgccgttgtgtatgccctgcagtggctgatcccgggccaggtggtctacgaacagttcgcctacaacaatgtgtttgccacgccccaatacggtgtattcgaaccatggaggatgctcaccgccgcgttcctgcactcgccggactcactcctgcacatcatcctcaacatgtacacgctgtggattttcggccaggcgctggagccgctcctgggccgtgcccgctttctcgcactgtatctaatctctgccgtgggcggttacgtgggatacctcctcctgaacccggtccttgttccgggccaggggcttgtaggtgttgtaggtgcttccggtgccatcttcggcctctttggggccatgctgctggtgcagcggcacaggggcggcgagacccggcagctttgggtcctcattgccatcaatggggtgatcgggttcctcattccccagatcgcctggcaggcgcacttgggtggacttatcaccggcggcctctgcgccgcggtcctggcatatgcccctcgcggtccgcggcagcggctcctccaggcggcaggactggcaggagttctcctcctgcttattgccgtcagttggctaaagatttccctttagggccaggttcagcagcccacatcccaccacgcacaagaaatcccgccgtccccaggacagcggggttttttgttttccacagcccttatccacagtgttggtaacttacaggcgtgtagttcatcgtgccgagcctcccagaccgctgaattggggccgttttccccagaacacacccgtttttctccacagctgtggataacctctggggatatgggtgtgtttaagtggaaaagcctgcctgaggatgctgttctgtggataaccctgggaagattcttcagataggggccctggccgccgtccaggaccgaactatcaacaccgttattcacactgttaataaacaacaacgctgtagttcacctaccgataaaggctcgcatggcagcgtgcaggccacggccgccgagattcgattcgactgtatccacaactgtggataacttgtgggtatcggcatgttggtaagtggataagcaccaggcgcctacccttggcttaagtccgttttccgacaggagggtccatgactgcgaccaccaagcacatcttcctcgacaaacagcaccccgccgtgtggcgcgcactcaatggcctggggctcagggccagggaggcggcgcaggaagcaggcatggagcccaggaccatggaactcctgcacgtgcggatctcgcagctgaacggttgtgcctactgcctggacctccatgtcagggaggcggtccaggccggagagtcgccgcagcggctggccgtactaccggcctggcgggacaccgcgctgtttaccgagaaggaacgtgccgcgctggcactggctgagagcattacgtcactccccggccacagctcacaggagcaggaggaagcctacgcccgggaacacctgacggaggaggagttctccgtggtcagctggctggccattgccatgaacgccttcaatcgggtgtcgatcaccagccaccacccggtccgcaaagagcgctaagcccgccgggtctgtccccatcttgttatccacaggtattccacactgttaataactgcgtccggggtgcaggattagcccgtggcgccgtcgcggcggggattggcacgttgaacatcctccgatgggcgggtggctgtggataaggttcccaacagctggggaaaagcacgtgggttccattgtgttgcggccaccgctggctcattcgccagggcaagcccgcccagggtgcttccgcctagcctgcgtccggccacatcccggaggatccccgccggtggcttcccaccagatgggtgtccaccattccgatggcttccatgagggcgaacatggtggtggggcccacgaaggcgaagccctttttccggagggccttggagagtgcgatggattccgccgactgggtggggatgtccgcatgggaccgggggcgggggctcgctgcgggctggaactgccacacaaagtccaccaggccgccgtcctgccgcaacgaaagcgtcgcatgggcattagtgaccgcggcacgtatcttcagccggttccggacaatgccggcgtcctgcagcagccgctcgacgtcggcctccgtgaactgtgcgacggcgtcggggttgaagcctgcaaaagctgtccggaacgcggggcgctttcgcaggatagtggcccaggaaagccctgcttggaagccttccaggcagatgcgttcgtagaggccctgctcgtccctgacgggcatgccccactcatggtcgtagtagtcccgcagcaacgggtccgaggacgcccacgccgggcgggccaggccgtcaccgcccagcaggacaccgtgatcgtcagggggcatgcgtttccctcggtgctaaggtccggcctgccggccgtccgggcaaaaacctatgagcgccagcgggtggtcatcaggaatccaacaatggcgataccgaaaccggccacgatgttccacgactcccaagcctggacgggaaagcgtccttcgctgatgtagaacgtgatgatccagaacaggccgatgatcatcagtccgaacatcacgggcttgaaccacacagggttcggcttgtacgtctgggaagaagcctgtggggcggtgctggcagtcttcttgcgcggctttgactcgggcactggctctccttggcgggctgaggcaagctcggcgttccgggcttggtatcctgcaagaaggaaattgccagcggtctgcgcgatcttggtcaaatctggattcttacttagcagccaattctagccgtagttcatgggccgccggtgcccgatggaaccgccccgaggagaacgcgtggtgttgcaggagaaggcggggcgagccgctgcggcgcctgccggcgtcgtaattctgcgtggagcagtccaggtggttggcgagctgctgataacggccggcatcatcctcctgttgttcgttgcctggcagctgtggtggactaacgtcgaatcggatgccaggcagagcgaagtgatcaaggaattcgcccaggaccttggcggcgctgccccggccgcaccagctgccccggacgcttctgggcctcccgccggggaggacttcggcgagccggtggtatccgccgcacccggccacgccggcactatcggcatcatgtacatcccgcggttcggcgcgaactacacccgccccattgtggagggtaccaccagcgatgtgctggacaccctgggtctggggcactacggcaccaccgccatgccgggagcagtcggcaattttgccgttgccgggcaccgccagacccacggcgccgtcctggacaacatccacaccctggttcccggggacaagatctatgtccagaccaaggacgggtattacgtctatgttttccgcaacaaccagattgtgatgccgtcacgcaccgacgtcctggaaccggtgcccacactcccggggactgttcccaccgaaagatacctgaccatgacaagctgcaacccccgttttggggcggaagaacgcatcattgcctactcgctcctggacagctggcgccccgcctcggcaggcccgcccgccgaaattgcggaccaggttgctgcggcgatcggaaagggctgagcatgtacggctggatcttccggcatcttcccgggcccctctggctgcggatcgtcacctcattggtgctcatcgctgccgcactggtattgatggttcagttcctttttccctggatgtccgaatacacccaattcaccgactcaacgattggttcagcaagccagccatgaccacaaccaaaatcctcgtggtggataactacgacagcttcgtctacaccctggtgggctaccttcaggaactcggcgccgagaccacggttgtccgcaatgacgatgtcaccctggcggaggccatcgaattggccggcacccgggacggtgtgctcatctcacccggtcccggcaaccccgcggaggccggggtgtgcattgaactgatcaagtggtgcggcgagaacagcgtgccaatgttcggtgtgtgccttgggcaccaggcgctggcggaggccttcggcgggaaggtcacgcacgcccctgagttgatgcacggcaagacgtccctggtacagcacattggcaccagcgtcttctccgggctcccctcccccgttaccgcaacgcgctaccactcgctggcagccgtccgcgaatcgattcctgacgtccttgaaatcactgccgaaaccgcaacaggcgtggtgatgggactccagcaccggacggcgccgctgtgcggcgtacagttccacccggagtcagtgctgaccgaaggcggctaccagatgctgggcaactggctggagtcgctgggaatgaagggtgcagctgcccgggcagcaaaactgagtccgctcatccagcactgacctgcgggccgtccccgtcagtcgtcatccttggtggaggtcggcttgggtgtcggtgtcggcgtcggggtcggctcggggcttggcgggggcggcggcggagctttggccaccacgatcgtgacggtcttgccctgctccactgtggaattgaccggatcactttggtccgtcaccctgcctgcctcaacctgggcgttctccacctcgatcacggcagggaccaggctgagttccttcagtgcggcttcagcctcttcgcgggtacgtccccgcagttccgggagcgcaaccttgcccgtggacacaatcagttcgacgctggttcccacgccgaccatctggcctggtgcggggctggtggtgatcacgatgccggctggaaccgtggcgctgttggccgtggtggtggaaggggctccagccagtccgctttgccgcagaatatccctggccgccgcttccgtcttccccggcaggctttcaggaatcatcacggcgctggggccctcggagatgttcaggaccacctccgcccccggatccatggacgcgccggattccggttcggtgccgatggccgtgcccttgggaacggtatcgtgctgcgaccggacaatcctgggcttgaggtcggcgttatacagttcctgcagcgccgctgactccgtcatggcagcgaccaccgggatctggactttcggcacttccggggccggccggttgacggtgctgtatagccatagcgcgccgccggcgagcacaagcagggtgaagaccaccagggtggcaatccatgcacgacggcgggacttctgccgggggctcggctcacgttccggggggaggcccagcggcagcgcctctgcctgggtccggtcatcgaagccggccgcgtggtcaccggcggaggcatgcattgcggccagcctgccggtcggagcatcatccaggaaaccggcccctgtgacaccaaaagcttcggtggccggagcaggcggggcagggacgtggtcattggggtccgtcggcgcttcggaggccggtaccgcaggaaccggcacccccgaccgggcagcgcgcagggcacggcggaaggccgccgcatcctggaaccggtcgtcgcggttcttctgcagggcttttgccagcacactgtccagggccggagtgacttcagggttcagtttgctcgccggctccgctatttcccggacatgctggtaggccaccgaaacggggctgtcgccgacgaacggcggtcgggacgtgagcatctcgtacagcaggcacgcggcggagtagaggtcgctccgcgcgtccacggcttcaccgcgggcctgttcaggagacaggtactgggcagtgcccaccacggcctgggtttgggtcatggtggccgaagaatcggcaatggcgcgggcgatcccgaaatccatcaccttcaccgagttggtgctttcgcagtacattacattggccggtttgatgtcccggtggacgatcccggccttatggctgtattcgagcgcccccaggacgcccatgcagtagtcgatggcctggccaatggtgacgcggtggccgcggatcagttcgcggagggtctttccctccacgaactccatcacgatgtagggcacccggacgtcctcggagccatcgtggacgaggtgttcgcctgtgtcgtagatggcgacgatggacgagtggttgagcgccgccacagcctgtgcttcgcgcttgaaccttgcctggaactgcgggtcacgggcgaggtcggggcgcagcagcttgatggccaccgtccgccccagccgggtatccacgccgcggtacacgtccgccatgccaccgcgcccgatcaggccgcccagttcgtagcggccactcaggacacggcggttatccaccgggaggctgtcctcacggtgcaacggggtgcgcggtgactcattcatgggatgtcctggcggctacgggttgcaggttgggggcgtacccggctgctggccgtccgtgcagtcgggcaggggtgactccagggtgggcgccgccaccgacgaggtggtgggcgccgaggttggagccggagctggggccggagcagatgttgtgggctcgggttcgggtgccacggcatagacgacggtgattgcagtgccctccggcactgcacccgtggggttcagctcaatgactctcccaggggcgtcgtcggtgctttcctgcggcacaacggttactgcgagtcccagggcagcaagatccgcctgcacctgccggtagtccttgcccaggtaagcggccggtatcacgttgaccagttccggcgtgggttcttgcgtcgccgtgggcgtcgagcgggtctgcgtgggagtagctgacggggttgtcctggtgggggtggcgctgctcggcgccgcgctgcttgtggtcaccgcggacgtggggtcctctgacgggaaaaggattccgcgctggctgaggaagaaccccaccagggcgaacagaagcagcaggatcagggcgatcaggggccaggtccagggactgcggcccttgcgctggggctcatcggcgggctcgtcgtcgtacgttgtttcttccggaacccacgtgcgctccgcagcgagggcgttggcccgggccaacgtcccctggggggcatcggcgtcggctgctgcccccgcagcgccggccgccgctcctgcggctgcacccgccgcacctgcgccaagcaccggcaaagcggaggtccggcttggggagtcatcccgctgtgcgccgatgacgccggtcggcgccgtcgcagtgtctaccggagccgtgatggggccggtgtcagcgtcgaagaggagcattcccggaacggctgcgcgcgctgcgctgatgtcgccgttgcggatggcctctgctgcttcggccagcttgatggcgttctccggccggtccttggggtccttggccagcatggacatcaggagggcgcgcaccggggtgggcagtgattcaggcaggggcggcggagcgtcattgacctgggcgagggcaatcgcaatctgggattcgccggagaaagggcggtggccggtcaggcactcatagccgatgacgccgagcgcgtaaatgtcggacgacccggtggccgtctggccggtggcctgctcgggtgcaaggtactgtgcggtgcccatcacctggccggtctgggtgagcggcacctggttggcgagccgggcaatgccgaagtcggtgaccttgacccgtccgtcaggggtaatcaggaggttgcctggcttcacgtcgcggtgcaccaggccctgcgcgtgcgcaacggagagggcgcgggcggtctgcgcgatgatggacagcgtgcggtccggcgagaggacctgctcgtgttcgatgatgctgctcagcggctggccggggaccagctccatgaccaggtaggcggaaccttcctcctcgccgtagtcgaagacgttggcgatgcccacgtggttcaggagcgctgtgtggcgggcctcggcgcggaaacgctggaggaacccgggatcgccggtgtactcctctttcagcaccttgatcgcgacgatgcggcccaggacgaggtctttcgccttccacacttcacccatgccaccaatcgcgatccgcgtggtcagctggaaccgcccgccgagggtgattccggttgtaggcctcacttattcaacaccgcctcaaaaattctcttcgcgttcggactggttagctgtgctccggtggtgatgtccacgtcttccatgacgatcgtgacacccacctgcgggttgtttgcgggggcaaagccggtgaaccaggagttgttcgctccattgcccagctcggcggttccggtctttcctgccacctggacgccgggaacagccgcccggttggcgatgccctcactgaccgcactcaccatccactccgtaatctggttggcgatgtccggggtggcggaggtccgcaactgcttcggctgaggttcatcaatcacgcggaggtccggggagcgcagggtcttgataagggtgggctgcatctggacgccgtcgttcgcgattgcggcggtcatcagtgccacctgcaacggcgtagccctgacgtccttctgcccgatgacggactgcgccaggccggggccgtcgaggtcgtcagggaaggtgttttcgctggcgtagtccagcttgagctggtcgcccatgtcctggccgaacccgaacttcgcagcctgttcggcgatggcgtcacggccaaggtccaaggcgatactcgcgaagggggtgttgcaggactgctggagcgcgaaggcgaaactggctgtgtcccgggtgtagcagttgccgcccgcgtagttgggcaggcggtactggatgccttcgaagggcagctccgcagggttggggagctcgctgtccttgttgtacttcccggatgccagggccgctgcggtatccaccagcttgaacactgagccaggggccagcagctccccggtgggtccgctgacgttcgggttcaggttgatcccgggcaccttgatcagttcgttcatgctggcatcggccgcggcgaggtcctgggtggccaccaggttcggatcataggacggcttggacaccatggccaggatggctccggtcttggggttggtgaccacaatggagccacgctgcccgtccgggatcaggctgtaggccagctgctggatttcggggtcgatggtgagttccaccgaggcgcccttgggctggtttccgaggaacagctgccccacccggtcaaggaacagttggtccgagttgccggctagttccgctcccatggactgctccaggccggtggcgccgaagttctgcgagaagtaccccgtgatccctgcgtaggcctccggctgcgggtacgtacgctggaaggcgcaggtctccgagccggtttccacggattccgccacgggcgatccacccacaatgacggcgccacggtcgttgcagaagctctgcaggacggcgcgctggttccaggggttggcttttagttcatcggccccgatcacctggacgtagctgatggctccgaagatgagtgcgaacatggcgatggccgccacccatgaatgccgtattgcctggttcacaggtgcttcaccgcctcggtaggagtatcaatgcctggtgcttccgatcccttgcccggcggcaagggagtggtgtccacggggccgcgcgcggtatgcgaaatcatcaggagcagcccaacaatgatccagttggccagcagggacgagccgccggccgccaggaaaggtgtggtgaggcccgtcagcgggatcaggcgggttacgccgccgatcaccacgaagcactgcagcgccacggcgaaggacaacccgcaggcaaggagctttccgaacgcgtcgcgggtgcccagggcagcccggaaaccgcgcgtgaacagcagcagatacatcaggacgacggcaaacaggccaataagccccagctcctcgcccagggaagcaatgatcatgtcgctgttcgcgaagggaaccaggtcggggcgcccctgccccagtccggtgcccaccaggccgccattggccatgccgaagagtccctggatgatttgccggcttccgccgggaaaccggtcgtagacctcgggcgtgaaggcattgagccagccgtcgatgcgtagctgtacgtgggagaacacctgggcggccacgaacccgccgccggcgatgagggccaggcctatgaccacccagctgatccggctcgtggccacgtagatcatcacgatgaacaggccgaagaagaggatggaggagcccaggtcccgctggaagatgagcacaccgatgctgaccagccacgcggtgatcatggggcccatgtccttgaaccgcgggaactgcagcggcccgaccttccggcctgccagcagtatcaggtcccggttggaggaaagataaccagcgaagaatatagccagggtgatcttggcgacctcgccgggctggaacgtcatggggccaaggcggatccagacccgcgcgccgaggatttcgccggcggtgatgcccggaacaagcggcaggatcaggaggagtgcgctggcggccagcgaaatgaaggtgaaccggcggaggatccggtggtccttgaggaaccagatgaccccgatggccacggccatggcgatcagtgtccagcgcagctggttgttgccggtgtcgtcaccgggggcgtcaagccggtggatcatggcaagccctagcccgttcagtgcgactaccaacggaagtattactggatcggcatattttgcccgaaagcgaaggacgccgtgaaagaccagggcagccacggccaggaggccggactggaaccagaagtctgaatcaaacgcgttttcccggtcgatgcccaccagcatgctggcgccgatgccaacggcgagggccagcaggagcagggcgagttcaacgttgcggcggggtttgggcatggtgctgagctggctcattggaccgcctcacaggtgacggaggggctgggggacggggacggacccgccggggcaggagcagcatccggggccggtgcagcaactgcggagtccgtgggcgccggggccggggtggatgctgccggggacggagaaggcgtagggcaatcctgttcgggagacgtggtcccggtgagctctaggttcttcacgatgcgctgggcgtcgtacaagtcgttggcaggaacggtctggcggacccgctgctgtgaaaagggcggcagggaatccatccggatctccgtgacggtctccaggctggacagtccgatgggtccaaggcgttgcgaaactccgttgaagatagccacccgcgaatcgtgttcgcccacgtaataccgggtctgcgtccacgcatagcccagccagagacccgccgtcagtgccaccagcaccgaagcagcgatggcccaagtgacccaccggcgcggcttaagcgggacgaggttgtcctcagcgtcattggcgggctgttcggccctgtgggtcaagagggtcgctgcccggcgcgccacagtgcgccccgcgatggtggggatggagccggactctgcggccgccgcggcagcacccacaagttcgtgcggccgtgacgccagctcctcccggaggacttccgctgacaggtgctcgcccaggtgcggatcggtggcgcccgcctgcgcggacggagtgccgtcggcgtcctgggaggaaccttccgcgttcttcgcttccttggaatcagggtccgcgtcatccccggcggcggtgttcctgtcctccggcggtgagtttttccgggctgccgcggcagcggccaaggcggcacccgtggaaggtatgacttcgacggcggctgtactgacgtcgtcgggcgtttcttcgacgatttccaccatgatcaccgtgacgttgtccggggaaccggcttcgagggtcaggtccaccagggtttccacgcactcgcgaaggtttttggtctcccgtaccgtccgctcaacggcgtggccggcaacgtagttgagcccgtcggagcagagcagccagcggtcgcccggccgaacgtccagggtgtcgagatcaagttcgggactggcatcgacatcgcccaggacccgcatcaggacgttcttgtgcgggtgggtctcggcttcctccgggcggagcctgccttcgtcgatgagccgctggacgaacgtgtggtccacgctcacctgcttgaactcgccgtcgcgcaggcggtaggcccgggaatcgccgatgtgagcgaagtgcagctttccctcagccagcaggagtgccgtgaccgtggtgcccattccagcgagcttggggttctggtgcaccagttcggacagcagggaattcgcggtctggatttcatcggcaaggaccgtgccggcatcaccgtggtagccgccgcggtccaggtggatcatgtccaggactgtggcggcggaggcaacatcgccgcctgcatggccgcccattccgtccgcgacgacggcgaggtgccggcccgcgtaggcggaatcgtcattcttggagcggatgcggccgacgtcggagcgcgcggcgaagcgcatgatgaggggccgctgcgggggctggtgcccgtttgcgggggattgcgtggcggccacggctatggcctcaattcgatgaccgtcttgccgattctcacgggtacccctggctcaaccggcagggcacgggtgagttgctggtccgccaggtacgttccgtttgttgatccgagatcctcgatgaaccagcggctgccttgggggaacagccgtgcgtggcggccggaggcgtagtcgtcctccaggaccagcgttgcctcctgggcccgtcccaggaggatgggactggcggcaagcggaagggtggttcccttgagcggtccctcgatgacaaccagctggtgggcctgctgcttcaccggctgcggagcggcttccgccaggcccgggttcttgcggacctggcgttgggttggagcgccggacgctgccttgcgccccaccatgaggtccctccgcatcgccgacacgatgctgaaaatcagcacccagaggagcaggaggaagccaaagcgcagggccgtgatggtcaggtcgctcatgcgcggccaccagggccggcaggcagaaggcggaagatgatttttgtccgtcccatagtgatggtggagccgtcagtgagctcggtgctccctgacaccttctgcccgttgacgtagctgccgttggtggaacccatgtccactgcgcttgtcactccgttggccgtgcggatttccaggtggcggcgcgaaacaccggtgtcctcgacatggatgtcggcatcggaagacctgcccagcacgatggacggcgcattgagggagtagcgctgcccgtcgatgtccaggacgggctggagccggaccggctggcggctgggggctgccggcacgttggagcgtgcgggggcacccgccggggaaccctgggacttctccgtggaggagaggatttcgaagtcgccggcgcgcagctccgtgtcccggcggaaggaaatccgcaccgaaccctgaagcgtgtagccctggctgcggacgtggttgatcaccacatcgcacagttcttcggccagcggggtgccccattcctgggccctcttgaagtcgtcttcactgagctggacgtcgaagacgttgggcgccagtgtgcggccggccgacaccgtcagggccttgtggtccacctcgcggcgcagcctgctggcgatttccacaggctcaacctgggcgcgggagccggtggagaagacgccccggacagccttttcaatgccgcgttcaactttgtccagcagacccatgattcttctcctttccccccggctgcggggcagtttgcgttccggaacttcacccgccgtgcagttcacaactcaggagcgtgcgcgcgtgcggcagccgctcctacatccgatactactgggcaggcatgtgaatgaccttaatcaacaacggcccgccgcctgcaaaagttcactctaatgccgcagccgggcccgatccggcgccggttccgcccctggacgggggcccgaatttacgggcttcgccggggccgggcagccgcctggaagctcaattggtaatttccgtccactgtccgttatgcttgatctcgctgcttttgcaaggttgcggatccgggaaaccggccgtggctgggtgaaagaagttgcgcgcgagtggcggaacggcagacgcgctggcttcaggtgccagtatccgaaagggtgtgggggttcaaatcccccctcgcgcacgcaaacaagaagagccccggtcttaggaccggggctcttctgcgttcggcgacctgcgtagagccgatttcaccgctgactggacttttcaccccggggttcccgggtgttaagtccaaacccgggtgcctcaaagtctggtccgacgacgggcgccgggttggtgccacggggcggcgatattccccgaccgtcagggacgcgccgaagccttgaaccggcgtcgtgaattcgccaggtggctgcgcatggcagccgcggcagcggcctcatccccgtccgcgatggcctccgcgatggaccggtgttcctgcaccacctggtcaaagtggtcccgggcatagtgttcgacgccggtcatcagccgggtgcgcggcatcgcgatcatcgtctggcccagcgccgcgaggcagtcggagtaataggggttgccggaagcggcggctactgcccggtggaactcaaagtccgacttcatggcgtgtgccgggtgccccgcgctggcggcgaactccgccagcgttgcggtgacggcccgcagttgccgctccgtatggttgcgcgctgccagcgccgcggcctcggcttccacccccatccggaactccagcaggtgcaggcggtcctccatggtggccaccggacgcgcccccggagcgggggagggtccgtccgacggcgggatgagggcaaagcttccacgcccccgttcggtttccacaagtccctcggcctgcagccgggtcagcgcggcacgcactaccgtacggctgacgccaaagtcgctgatcagggtgttttcgctggggagcttctcgcccggctggataacgccgtcgacgatgcgggtgcgaaggtcagcggcgaggtccgcggtgaggttccggctcatggcaactaggttacgcgccgaactccactgaatcggtggtccaggcgcgcgcctggtcgctcagcgtgatgcccaggccggggcggtccgggacgatcatccggccgttcttggtttcgaggcgttcgttgaacagcggatcgagccagtcgaagtgctccacccacggctcgcgcgggtaggcggcggccaggtgcaggtggatttccatggcgaagtgcggggccaggcccaggccgcgctcatccgccagggcggcgaggcgcaggaactgcgtaatgccgcccacccgcggcgcatccggctggatgatgtcgcagctgtttgcgctgatgaggcctttgtgttcggccacggaggcgagcatttctccggtggcgatgggagtgtccaggacctgcgccaggtgcgcgtggccctcgaagtcgtaggcgtccaggggctcttcgatccagatgaggttgaactcctcgagctggcggcccatccgcagggcagttgcccggtcccactgctggttggcgtccaccatcagcggaacgtcccagccaatgtgctcgcggatcccggcgacgcggcggagatcctccttgctgtccggaaggccgaccttgatcttgatgccgccgatgccttccccgagcgactgcgtggcacgggcctttacttccgcgaggctggcgttgaggaagccgcccgaggtgttgtaggtctgcacggagtcgcggtaagagcccaggaacttggccaggggcaggccggcccgcttggctttgaggtcgtagagggcaatgtcgatcgccgccagggcctgcgtggccacccccgagcggcccacggacgctccggcccacagcagtttggtatagatcttcgcaatgtcgttggggtcctcgccgatgatgccgccggcgacctccttggcgtgtgcgtactgcgccggaccgccagcgcgcttggagtagctgaagccgatgccggtatgccccagctccgtggtgatctcggcgaagagaaagatgacctcggtcatgggcttctgccggcccgtgaagaccttcgcgtcgctgatgggaacaacgaggggcaggtgggcggtggacagcttgacgtgccggatcagatcgacggtactcacgggttctccttcaggcgggaccgggctccttcgcccgccctcttaggatataagtagagtacttgtaatacaagtactctactgcttcgtgtgataggccactcccggtacagggcaggaatagcggcgggccgggacgctgttgacgcaggaatgaaggcgattacttacagcgaatatggcagccctgacgttcttgagctcaccgagcaacccacgccgaaagttgggcctggaatggtcctggtcaaggtgaaggcggcgtcggtcaacccggtcgactggaaaatcatggcaggctacctggatgcggcgatggacctgcagttcccggcgatcccggggtgggatgtggccggcgtggtggaatccgtgggaattgattcccggcagttcaagcccggagacgaagtgatctcctatggacgcaaagactatgtccacggcggcagctttgctgaatacattgccctcccggagaggctcctggcccggaagccggcatcccttgaatggagcgagtcggcagggcttcccctggcgggcttgaccgcctaccaggtcctgaaccgcctgggcctcacgtccggcgagaccgtcctgatccacggcggagccggcggcgtgggatcgttgggcgtccagattgccgtggccatgggcgccgacgtcattgcgacggcgtcggaaaagaaccacgatttcctccgctccctgggcgcgcatcccatcacctatggtgagggccttgccggccgggtcaggtcgctccgtccgggcggggtggaggtggttgccgattttgtcggggggaaccttgaggcaaccctggcggtccttgcagaaggcggcaggcatgcctccatcgccgacagtgacgttgaggaacatggcggcacctggatgtgggtaagccctgtgggcgcgcagctgcaggagcttgccgacatggtggacgacaggaagatgcgggtggaggttgccaaggtgttccccttggcccacgcggcggaggcattccggctcaacatggaggggcatacccgcggcaagattgttgtggcagtgggccagtccgcctgatgcccggggtggacgctacttcctgattgccccgaatcccgcaatcagggcctcgagtccccggtggaacgcggtgtcggccgggcggccccgttcctgcccggccggtgcgtcctggcgcgacgccgaactccgtacggcagccgtgaagtaaggggtggactccgccatggatccggattcgaagatgtcctccggtgccgtgacgtcgtaagcggagccaaagatgaaggactccagcgccacgacggcgggaattatgtgctcctgcgggaacccggcgtcggcgaagcccttgcttacggtctcatacatggccagggtctggggcgcatcggtgacgggcaggacggcgatcacgggaatcagtggggtgtgggcggcaaagacgtcccggtagctccaggcccaggtgcggaccgcgtcctcccaggctccggagccgaatcctgagacgtccaccagggacatcaggtggtcctccaccagaagcaggacgtcctgcttggatgccacgtggttgtagagggcagacggcgccacgtccaattccttggccagcgcggccatggtgagaccgtcataccccttgcggttgatcaactccagtgccgccgcggtaataccagccttgtccaggacggcggctgccggcctgccggcctttcgcctctgggttccggcactccccgaggggcgcccctgagtggctgatactgccggcatgcctgccctttcgttggtggtctccagcattattccaccgggcccttcccgtccatgccaggaccggctatagttctaataaatgaatgccgttcatttagtggttcccgtcaccagacaggaccaaagaaaggacatcatgctgaaccttaaccgcgacgtcgtggtagttggagccgggccgtccggactcaccgcagcccgggaactcaagaaggcaggcctgtccgtcgccgtgctcgaggcccgggaccgcgtgggcggccgcacctggaccggcacggttgacggcgcaatgctggagatcggcggccagtgggtctcgccggaccagactgtgctcctggagctcctggacgagcttggccttcagacctacccccggtaccgcgagggcgagtcgatgtacatcggcgccgacggagtgcccgtgcgctataccggcgattcgttccccgtggaccgggacacgcaggccgagatggacaaactgaccgcactgctggacgggcttgcggcggaaataggtgccaccgagccatgggcacacccgaaagcgcgcgagctggacactacctccttccaccactggctccggcagcactcgtccaacgaggaagcgtgcaacaacatcggcctcttcatcgccggcggcatgctcaccaaaccggcacacgccttctccgccctgcaggccgtgctgatggcggcgtcggcggggtcctttagccacctcacggatgaggacttcatcctggaccggcgcgtggtgggcggaatgcagcaggtctccctgctgctcgcgcaggagctgggggacgacgtcgtccttaattccccggtgcgcaccatcaactgggagccggacaccgaagggcaccgcgtcaccgtggtctctgacggggcaaccgtcaacgcgcggtacgtgattatggccgtgccgcccaacctgtactcgcgcgtctcctttaatccgccactgccgcgccgccagcaccagatgcaccagcaccagtcgctgggcctggtcatcaaggtccacgccgtctacagccgcccgttctggcggaactccggcctgtccggcacttgcttcggcgccggatccctggtccaggaggtgtacgacaacaccaacttcggcgacgccaggggcaccctggtgggatttgtctcggatgaaaaggccgacgccgtcttcgagctgggtgccgaagagcgcaagcgcgccatcctggagtccattgccgggttccttggcgctgaggcgctggaaccggaggtctattacgaatcggactggggctccgaggagtggacccgcggcgcctacgcctccagttacgacctcggcggcctgcaccgctacggcaaggaccagcatgccccggtggggcccatctactggtcctcctcggacctcgccgcggaaggctaccagcatgttgacggagccatccggatgggccggcacaccgcggcccggatcctcgaagtagcccgcgtggccgtcccggccggagcctgacccccggtttcagcgcagggcggacaggcccttccgggctggaaaataagcatgcttaccaataggctgggccagaggggagttcccccgcacgcagacgaacgaggtgagatatgactgacactgagagcatcagcaaggttacggacatcatcaacgattcccgcatcggaatgttgaccaccatcaacgaagaaggcgccctcgtgagccggccgctggctgtccaggatgtaaaggacgacggcgacatgtggttcttcacgggccttggcacctcgcaggtggcccatgtccgggcggacccccgcgtcaacgtctcctttggcaagaacaccgagtgggtttcagttgcgggcacggccgaggttgtcacggaccgggagaagatccgtgaaatgtggaaccaggctgtcgaagcatggttcccggacggaccggacacccctgaggtgtgcctgctccgcatcgactccgattcggcggaatactggaccagccccggcggcaccgctgccacggtgctccagtgggtcaagtccaaggtcaccaacagccggatgagcgtcggcgagagcggcacggtggacctgtagggtctgccggccggatggaattgcagggacggggcggctgaggccgccccgtccctggcgtttgtgctgttatccgggctccaccgctgagagggcggccaggacctccggcagcagcaggctgttccggccccagacgggatcgaagacctccacataccaggagtcggcgagcagcagcgccagggaatcgttggtttcctccgcccagtcgcggatctgttcctcgtccaccggattctcgctggagcccagcaccgtggtgacttcagttcctgccagcgtcaccgggatggcggcgctgctggcctcgccgggggcatgcgccacggtaaccagctccgtgcgggcggacaggccgataagggctgaggcggcggcggcggagcaaaaccccgtcacgtactgccgctgcgccgccgggcccaggcggaggccgggctgggactccttggtgaagagtccaagacggttcaactccgcgagggaggccgcgattggacgggtttcgccgtcaaagccgggggcgaacgttcctggctggtattggcttgccccttccagccagcgggcggtcagttctccggccgcagccagggtggtggcctgccgccagacgccacggtcctcaagccttcggccgaactggtcatgggttggcaactcctggggatccatcattggatgctatcgccgcagggttccctgttccacggcacgcgacacagcgggtaacgtctaggcctgctccgcggggacgcctgctgcccgctcggcagcggcaagggtggcacccaggctggtgacggcgtcgggatatccctggtggggcgcgccacgcagctcgtcagcctgccgcatggccttgatgagggctgaggtttcgggggtccggacgtccgtcagcgccggataatcaatggagcaggccggatccagctcatagcgccgccaccgggcaatcagttcgtcatgccgggcctgggcagcgagatgggcggactccagcgcccggtagtcattgcgcgccgtacgccgcgcaaggtacttcggcgtccagaggtaggcggccacgccggcggcaatgcccgcgccacccaggaacagtcccgtccacggcgagatcaaggtggggatgagcagggcgggaacagcaacggctgacccaaggaacaggtcccagaacagctggtccgaacgctcagttgggccgcttccgccggcaagcgcgcgccgccggaccacaaagatggtggccgcaacactggcaaccagcaccgggccgcagagcagcagggcccaggctccctggaccagtccctcgaagaatccttcccccatggcggacacctgacttccagcgcatgcccgggccgcggaatcccgggctggttattccattccaccccgttactgaaggtgggtcaatggtgcgggcacaccaggccggaacgggcaccttcccggagggcggaacgccacgtaccgtgggtccatgagactcaaaatgtgcagcatccacgtcaaggaccccgccgccgcccacgccttctacacgggaaccctcggcttcgagacgctgatggccatgcccgagcacaacctgtacatcattaaggaccccggctcggatgcgggttcggtagggctgcttctggagcccagcgacaacccgatcggcgccgcgtacatgaacgccgtgcacgacgccggccttcctgccatcgtctttggcgtgccggatgtgcgggcggagtatgagcggctgctggcggcgggggtcagcttcaagggcgagcccgctgaggatccttccgggatcagcgcggtgttcgacgacggctgcggcaactacatccagctgcaccaggactgagggtcccgggcgggtctactcggccttggcgcgggccttcttggcgtccttcttggcggattcttccttgacgcgctgggcctcggcccggacggcggcatgcgtggcccgctcggtgaccagccactgcgggggagcctgcagcagcgcggtgatctccgccgtcgtcagcgcttcctcaacgccgccgcgcgccaggccgctgatggaaacgttcaacttctgggccaccaccgggcgggggtgcgggccgttgcggcggagctcggcaagccactcaggcgggttggcctgcagttcggcgaactcggcgcgggtgatggttgaatcctggaactcctggggcgtggcgggcaggtagatgccaagtttcttggcaacagtggccggcttcatggactgggagtttgcagaggtcatgcttcaagggtatccgggcggacggtactgtgaagacgtgccctcccacgacatcccccagacaaccggtcccggtgaccaggaccagcctgccgggcaggcggaagacgccgttccccgcatgctccgcatcgcctatgtggccggcgtaaccccgggcaaatggatccggcggtgggaagagcggatgccggacgttccgctgcgggcctttatgtccgacgacggcgcgcaggttgcggtgctccgcgaaggttccgcggacctcagcttcgtccggctccccgtggagcgcgaaggcctcagcgtcattccgctgtacgaggagcagccggtggtggtggcgcccaagggacatgagatttccgtgttcgaggaggtggccctggccgacctcgaacaggaatccttcctcgacgtggctgcactcggaggcccggagcccgcgctgcaggtggtggccacgggcgccgggctggccatcctccccatgtccgttgcccggcacttcaacgtcaaagacacggtggcgcggcggctcaccggtgctccggccacggaaatcgccgtggcgtgggcttcggattcaactgatgaagtgatcgaggagttcatcgggatcgtccgcggacggactgcccaaagctcccgccagccttcggcccagccggtgaaaaccaagaaagagcccaaaccggaccgccggggtaccggagccaagaaggcgcccaaggtggcccagcggtacgcgccgaacccggacaaggggcggggcaagggctcgcggaagaagggcaagcggtagcctgtttggcccccagctgcttagtgccggatgcatagcgaaggcgaaggccggggtctgcggtacaagcaggattaacagcgataacggcaacaggccggctccaaggggagccggcctgttgctgtctagatattcctagatagtcctaggtgtttttgacgttgcttgcggcgtcggtggtgcggtctttgacgtctgtggcggcgtgttggccttcggctttgacgttttgggcggcgtcggtggcggtggccttgacgttttccatggcttcctgggcgggttccttgaggtcctggaccaggtccttggcggcgtcggtgacctgggtggccaggggctgggcggcggttttgagctggtccgcggcttcccgttccttttggctggccgggatcagggaggagatcagcattccggcgccgaacgcgatcaggcccgcggccagggggttgccctgggttttggctttgacctggtccggtgcgttggagatcgctgttccggcatcgccgagtttggccgcggcggtgtctttggccccgtgcagggtgtctccggtggagtgcagtgcgttgccggtgtgtccggcgccgctgtgcatggtgtcctgaacacgggtagtggtgtggtctgctgcgcccatgattttctccttgaccccgctgactgtgtctttaagcttgtcggtctggcggtggacgatgtttgagggggtgactttgtcggccacggcgtcaacgttggtgcccaggcgtgcgcgggtggcttctatgtctgaacggattgcgtccgggttatcgctcatcggtttacctcacctggttttagggttgggggtatttcggacagggtttcgctggtctggggcaggcccttgacctgtttgagttccttgcggccgatcgaggccaggaccgcggcgatgatgccccagatcacggcgacgatcagggcggcccagcccagtggcatcagggcgcccagggcgaacatcaggcccagggacaggaagatcaggacgaagtgtcctgccacgcctgccccggcgagcatgcccgcgcccttgcccgccttggtggcggactgtttggcctcggccttggccagctcgacttcctggcgcatgagcgtggacaggtcacgggtcacgtccccgagcagctcacccagcgaggcgttatccgccttctggtgcgcctcactcggagcgggttccggaatcgaactactcacagctgacgtccttccgatgagcggtaaccgccgtcggtgctgcggtaggagccgtcctcgtcccggtaggggtcatcctcgaaccggaggggagtgtcctcagccgtgccggagggcagggaagtggtggataccggagcgccggcgcctacaacaggctcgctgtagaggtcgtcatttccggctgcatacacggtctcctggcggaggggtgcaaccggctggggctgcacggaccgctgcgacggcgaaccatatgcggcgccgcgggaatccggcgcgcctgcggtcagcccgcgggtgagccggccggccaggacgccggcgcccgctgcaagcaggaggaaggtgccggggttgttgcgggcaaacctctggacttcgccgagaatgtcgcccggctgcttgttctccagccaggaggccacggtgtcggtggtgccggcggcctggcggatcaggtcgctggccatgccctgttgatccggcgcatcggccatgctgtgcagctggctggagatggtgcggatgccttcggcggccttctgctgctgggttccagcctggcttgtcaggcccgactttgcctggtgcagcagatcctgcgcactggacttcgcctcgaacgccacatgcgcggcttcttccttggcggtctgtgcaacgttttgggctgacgttgcggcctggccggcaacgttcgacgcctcttcctttgccgcctggctcttggaggtgccggcagaaccctgaacgggggcggtgccaaagttttcatcggctcctgctgcgttcacaccgtaaggatcggtggttgcagtgccgggggtctggggccattggttctctgtcatcgggctctctttcctgaagggtcagctggcgatcaagaaccagcaatgctggctagtagtaagcatggttactaattagatactaagcacactttccttttgaagcgcaagagggccgcctaataaaggctctcaggaacggctctgggcctgggcggatagtaagcctacttgcgaattggatgctaagcatgcttattgtagagaacgtagcgacgcaacaagaggtgatcacactctgcacttcgccacccacaggaaggccacggcccgatgaccagcaatctcgatccagatgcccgcaccagctaccgcctgatttctgtggcggccaggctggtgcagcggcgccaggacgacgccctggcgcacttgggcctgacccgcgcggctgtgatagcacttgaaggcctggccagcgggcccttgaaccaagaacagcttgccgaaaccatacgggtccagagccagactctgggacgggtcctgctgcggctggagggcgccgggtacatcaccaggacgcgccagtccaccgaccgccggcaattcaaggtggaacttacggaatcaggggcagccatcctggaggccgcgcgtcgggaagaaatcaatgcctaccctgatgatccggacatcggctggaaggtcctcagcgaggagctggcaaagttcgtgaacgcgctgccggcaagccggagccaggaggtgctcccgttcgctccgcctgagcaccgcactccgaggcgcccccatggcgcacgcggcaccggccttcgcggcatggaccagtccggccactaaggcggactggcacggccgttcgagtcggcgtctcaacctgcgctaaggcggtagccgccggactatgccgggctgctaagccgagcaggcatccttgagtgcctggacggactctgccggcacctcgtctccggcttccgcaatctggcccaacggcgtcgtaatttcagccgggacgccagcagtggacgccgcagagacgaggcccgccagcagctgcttgtcctcgacgctgaccagcccgtcctggaccacagcgcagatctggcggttcacttcggccgcgcccgcagtggccacctttgaggcagcgtcgctgacggcattgcctgcggcttcctcaacggcaccacagccggaaaggagcaggagcaagggagcggcggacaggactgcgaggcggcggttcatcaacccagcctatcgggtgcgcacaaagtgctaccgcgcgcttgccgccggcacccccaggatgctgtccagcaacccgttgcggaacttgccgtccgggtcgtgcgccgatgccagcgaacggaaatcagcgaagcgcgggtacagcgactcccagtcgtgctccgctggggagaagagcttgccccagtgcggacgggcgccgaagggcctcagtagattctcgagttccggcaggaccgcttccacttcgggctgcagcggcctccaggtgaagtgcagggcaacgctctgctgccggtagaaagggctgagccagaacccgtccgcggcacctgtacggatttccgaaacaaaaagcagcggggcgagcttgtccgcgagtccgcggactgcctcgatggcggccggggcatgctccagcgggaggatgaactcgctctgcagctcctccccgttgctcggcgtgaactcatggcggaagtggggaaggcggtccagccactggccgggttcatccagctgcagggtgcagttttccgcggacatgtccggcagcgggtgccgcgggctcacagcggcggtggcgccgaacagggcgttcaggggtggctccgagtccagcgccttgagccagacctggctgatggaatccccggcatagtcagtgaaaaggctcacgctgtaggcgctggacacgagttcgtggaagctggccagtgcccggtcccacggcaggttctccagaacgcgctggcgcatccggaagctcggctggacggcgagttccaggccggtcacgatccccagggcgccgagccccaccacgctggccaggaattcgtcgccatcggcgcgggagagggaaacctgttcgccggatgggcgcaccaggtcgatggactggactgctccggccagggactggttgtccaccccggagccgtgcgttccggtctggactgcgcccgccacggaaatgtgcgggagtgacgcgagattgtgaatggcggcaccggactgttccagggtccggcacagttccccgtaactgacgccgccgctgacccgcaccgttgtgcggtccggcgagagttcgatccgctggggcagcgcatccaggagcacgtgcacgccgtccgtgtcccccacgcggttgaacgagtgccgcgatcccagggccttgacacgcccggcgccggccacgatgccggcaagttcgtccaccgaggttggccgccggacctccgcggaggcgtattcaaggttccctgcccagttcttcatcgagtcggctttccggttggaggtgcaaattggctccctcaactgtcagcgctaacaatccccctgtcaaggcgcgttcacgctgcccgacggcgccgggccaccgtgcgccgggactggctggcgcatattcttctatcgttgtaaattggcgggatgacacgtgcgggcacccctccgacgggatgaaacagctgggactgcatgctcggctccgacctgccgctcgctgaccttggcctcccgggaccgtcgagctggacagtccgggaggcctggagcggcaccgtatagccgggctcatccggctatacggtgtcccggcccttgcggtgggtccctccgcccacggcgtgctgttctaccgcttctcccgcaccccggcttagctcccggggcgcggtaggactggtgcggggcggcgggaccctgcgcctgctggtagcttcaaatgcggcagcgagccgcagcaggagtgcatcgctgtaggccctgccggcgaacgtcaggccgacgggcatggcgatgtccgcggccagccccatgggaaccgtcaccgtgggaatgccgagatgccgtggaaccaggttgccgttggacacccagacgccgttgcgccatgcgaggtctgccgagcgctcgttgcggtccgcgtcggcggggccgacgtccgcagctgccgggaacaccacggcgtcgaggcccaggccgtccatccactgctccaagtcaatccggcgtgtttcctccagtccgcgcagtccctcagccaggtggggtatcgcggccagttcaggcacgccgttcttccggatccaggcggggtagtcgctgatgtcgtcgtcgaacccgtggtaccggtccggcaaggaaccgtccggagcggggaagatggcggcaccgtcgacgtcggccagccgtttgaggtgcgggtccccgttggcgtcaaggaagtcgttccaggcccaggccgagaggtccacgatttccctgcgaaggtagtcgggggacaccaggcccctggtcgaaatgctgggggacccgggacggtcgccttcatagttggacaccacggggaagtccacctcgacgacgtcggctcccgcggcctccaggtcgcgccgcgccgcctcccagagatcgatgattgacgccctggtctcgatccgctgccctgtgggtccgccaatccccggagcaggggccgttccggcatcaggatccgcgttgatgtacatccgcgggaccccaaagcgcttgccggccaggacgggaacagctgcagcccggtccggtgcggccagctccaggtaggaaccggggcgcacctcggatgctttgggcagctccacccagggctgcacccgccagaagtctccccgggtttcggcgtcatcggccaccacaacatcgagtacctccaggaggtccgacatggtgcgggcgtgcggcaccaccacgtccatggtgggcaccagcggccagttgccgcggactgagatcacgccccgggacggggtgtaggcgcagagtgcattgttggacgccggcgcccggccggaggaccaggtttcctcggcgagcccgaacgcggcgaagctggcggcggtggccgttccggaaccattcgaggatccggaggcgaaggcggcggtgagataaccggcgttgtacgggctttcggcacggccatatacgcctcgctgcataccgccattggccatcgggggcatgttggtcagtccaataagcacggctccgcctgcgcgcagccgctcaatggtgaaggcatcctcctgtgccacgaggtctttgaacgccggggacccggctgccacggtgaggccgcgcacctggtagctgtccttggccgtgtagggaatgccgtccaggggtccgagcgttgcgccccgggcccggcgttcgtccgatgtccttgcttcggccacagcctccgggttcatcaccaccagcgcattcaaacgtattccggaagagtcatacttctcgattcgctccagatacaggcgcaccagttcctcgctggtgacctctcccgcctccagcgccgtacggagttcgctgatggaggcctcgacgacgtcgaagctgcctttcgtgacccgcttgccggctgtttcggcgagcctcatgccgcgcctccctttgctgccggctgctgctgggtgatgcagtggatgccgccgccgaaggcgaagatgtcgcgtgcatccaccagttccacggtgcggccggggtaggcacgctccaggatgccggcggcgatggcgtcattgggatcgtcgaaggcgcacagcaccaccacattgtttgccacgtagtggttgatgtaggaccagtccacgaagccttcatcgtccttcagcgtggtgggggcggggacgtcgaggatccgtaggggccgtccctgggcatccacctcgctggacagtacgtcccgcagttcccggtagacctcgtagtccgggtgggaggggtcgtcctgccggtgcagcaggatggtgcccgcgccggcgaaggcggccacgatgtccacgtgcccgcgggtgccgaattcgccgtagtcgcgggtgagcccgcggggcaaccagatggccttggtggtgcccagggcagcgtggatttcggcttcgacagatttctttgtggcgcccgggttgcggccaggatccagttggacagtctcggtcaacagcacggttcccttaccgtccacatggaatccgccgccctcgttgaccagggagctggacctagaaggaacggaactttccgccgcgatggtgcgggcgacgtcctggtccttgtcccacgcggcccactcctgggcaccccacccgttgaaaatccagtccacggcagccagcgagccgtccggttggtgtacgaatgtgggtccgctgtcccgcagccaggcgtcatcgaggggaacttcgaggacggtgatgccgtcgccgagccactcccgtgcggcggtggcgtcgcgggggtcggccaccacagtgatgggttcgtagcgggcgatggtctgcgccaccttggtccaggcggcgcgggcacggtccagggttggacttcccgcttcgccgaaggtgtcgttgggcggcgggaaggccatccaggtgccctggtgggcgtcccattcagcgggcatgcaggttgcaggtgccggtccggcggcggctacggcgggggcggaagcgggtttcatcggtattcctgggtctctcggtctggcttgtggtgggggatgtcttaggcgggttggcccacgcgggcaccgtctgcggcgggacgggcagccggggaggctccggcgtcgtacgccaccttcccgcccacgaccgtgagccgggcggagttggtgagcagttcggcggcgtccgcctggagcgggttggtgtccaggacggtgaagtctgccaggtagccggccgcgatcctgccctgccggtcctcggcccggcaggagtaggcagcatcacgggtggcgtggcagaacgcgtcggcaagctccagggcgtagtggggaaggttcgcttccagcgcggggtcaagggccgagcggcgggtggcggcaacgtacatgttgggcagcggctggtgcggtgccgtcggcgcgtcggtgctcagtgcaagcgtggccccggcttccgtgaactcggtccaggggaaggcccgttcgcagcggtggtcgcccagcatgctgcgccagttgtcctggatggcagggtcggcgtggacgggctgcatggaagccaccacgccgaggccggccaaccgcaaaacgttcgcctccgtgactgtttccaggtgttcgatgcggtgccggcgctcccgcgaaccgttgcggcggtacgcctcttctagcgcatccagggcaatgtccgacgcgtcgtcgccgatggcgtgcagggcgatctgcagcccggcggcgtccgccgcaaccactaccggcgtcagtgatgcgcggtcccagatgggctcggcgctgctgccgtccacgtacggctccttcatggcggcggtgcaactgtcgatgactccgtcaaccaccagcttgataccgcagatctgcagccagtcatcgtgcagttcggctgcgagccgtgcggccttggccacctgtgccaggttggcagactccgcttcgtggcgggccacgaggatgtgccccttgacccgaatgggcagggtgccgtcccggcgttccatggcgcggcgaaaagcggtcaggtcgtcgtcctgcacggccatgtccacggcactggtgacgccaaccgccagatagttggcgaaagcctcctccaactgggcgtcgcggtcctggtcggtggcatgcgccgcgagggcgggccagacgatttgctgggctgccgtttcgtacagcatgccgtcagcctggccagtctccgggtcccggccgatgcgtccgccgatggggtccggggtgcccccatcgatgcccagttcagccagggccgcgctgttgacccagacagagtgcaggtcattggcgtctaggtagaccggccggtccgggaccgctgcatccagcagctggcgggttggggcctgcccgtccagggcactgtagagccagccggcgccgaggatccgcggagcattggttgccgcggcagcgtcccggaggcgctgctgcaggtcggcgaggctgacggcgtcccgcagctggaccttctgcagggcctggcccgtcatcagcaggtgggtgtgcgcgtcgacgaagccgggcaggacaaagcggcccgcaaggtccacttccgcggcaccttcacccgccgcttcgcgggcgccggattcgtctcccacgtggaggaactgcgatccttccacgacgaaggcttccgcgggagcgccgtcggcggtgaacacggcggcgttggtgtagagcgtgcgtgcaggcaagggagtgctttccttgtggtcggggacgggcattagacgatgaccgccttgttgatgctgttcggaaggtcgggggccgcctcccggtccatccgtacggacaggcgggagataaggaccagcggaaccgccaggacgagggtcatacctgccaggacgtagccgaggatgtcataccctgccgaagccgagacgaaggttccaaagaacggggcgaacgaggatccgatcaggtagacgccgagcaccggggcggaccagcgcccggatgcgtccagagcggccgcggtggccacgatgtagatgaaggtcagcatgtagatggtgttccaggcgacaatcacggccatgtagaggcccggctcagtgacggttccggacagcatcttcaatgctgcccccgccaccagcgctacggccagcggcgctgtcctgccgagccggcgcccggcaagcccgatgaggcccgaggccaggagcccgcccagcgtggagaggctgaggaccagccccatgccggtttcgtcgagctgcgcctggtcggctcccatggtggcggccacagcccagagggagtcctcactgagggcccacagggcgaaacaggccagcaggccgaggccggcgagggttgtggtccgggagtccttgcccggcgcggcggctgccggtggcccatctgcggtaccggcagggctgccaggcagccaggccgtggtgaacagggctgccagggcaagtcccgcgagcaggccgaacgcactgcccatgccggcgcccagggcaggaatgatgaaaaggaccaccgaaacgatcgcgcggttggtgaagccgctgatgccggaggcgcggtccgggttacggagggcgcccagggctgcgccgccagccgagacggcaccgcccgcgccgagcccgccgagcaggacaccggcgacgacgacgggaacggacgggataaaggccgcggccgcgaagccagccgcagcaagcccaaggccggcgcgggccactgggtgccttccgttgccggatgccagcctggacgtcagcaggcatgccacggcacaggcgagcagcgagccggtcatcagggtgccggcttcggtgtccgaaaagcccagttcgccggtcagggcgacgatcatgacgggaaccagattggcggtcatgaagccgacaacgctgatgccgaagacggatacggcccggcgcggcgtcagggccacgcgccctgtggtgagttcgtcctgggacatggacttctccttgctggaatggagtgaatgccgtcacaaaatgaatggccttcatttattatggagatgcacccggtccagcacaaggttttggtgaaagcctttcagaaacttattcttgttacctgccggatcccggttagaatcatctccagtccgaaggcgaaggcggcatcggagcgctcggcaggggaacccagtccggcgatggctgcggtcagggcagggaattggccaggcgggggagaccagacgacgtcgggagcagtcagttccagtgcggagccaaggaccaggtagtccaccgtggtgatggccgggatgacaaccgaagggtgcaggcctgccttgcccaggactaccgccatatcctcgtagatccgcatcacgcccaggtcctgcacggtctgggttaccaggagcggcaccagccgggggtggtccaccaggcagtctcggtattcgtgagccagcgtccgaagtgcctcgtcccaggggaggctggcaggatcgaggtgcctccgcccagcgaactcggagaagacgagcccgcgcatcagctcgatgatgtgttcccggctgtcaatgtggttgtagagggaggcctggctgacgccaagttccttggccactttgggaaaactgaaatctccggtggagtcaaccagggacagggcggcgcggatgatggcatcgacggacagcagcggtgatcgcgggcgcggcattggaactcctaggcacggggcggtccgttcaatgtagctggcctttgcggtccacggcggcaaggatggcccgggccagttccgctggcttggtgaactggggccagtggcccgttggcaggtccacgtactccacgtcgcgcatcctcgaaagctccgccacgaagggatggccggcctggatccactcctgcaggagcgaggtcgggaattcgcacgcaatgatggtggccggcacgtcgtagcgccgctcgtcatggagatgctgccggccgtaggcaacgcccctgggctccggaatggcccgtgcccggaaagcctcgcgaaggccgtcgtcgaggtccaccaggtcggcgtcctcgaatgcttcccacggcggcagcggaacgtcgtcgccgtcggccggcagttcatcgttgatcacgccgccctcacccagcggtccgctgtccacgtagattgcccgtgccacccggtccgggcgggaatccaaggcgccgtggatgatggctccgccgccggaatggcccaccagcaccaccttgttgtccagggcatcaatggcggcaactacggcatcgatgtggtcctgcaggccaatgccggagcggtctgcgtcgacggattgcattccgggaagcgtgagcggatgagtgcggtggccagccgcctccagggcaggcgttatctcctcccacgaggaagcatccaaccagaaaccgggaaccaggatgatgtccatgatggaaccctactcccggagaaggggggtggcgcgtgatcccggtcggggtgcgggggcggcggagcaccagggctttcgcggagccttggcgggcagtaaagtccccggagtagcctgcgtttctccgacgtgacctgagagggagccctcatgaaacggccagaatgcctttgcggacccgccggccctgttcccggtccggccaggatgggaggtgtggcggcatgagcggcccaacgtcgccgggccaggccgcgccggcgaagcgtgaaaccttttcctcccgccggctctttatcctctcggccatcggctcggccgtgggcctgggcaatatctggcgcttcccctacattgcctatgacaatggcggcggcgccttcctgattccgtatctggtggcattgctgacggccggcatcccgctgctgttcctcgactacgccgtgggccataagttccgcgggtcggcgccgctggcctaccgccggctccaccgggccgccgagccgctgggatggtggcaggtgctggtgtgcttcgtcattgccgcgtattacgcagtgatcatcgcctggtcgctgatgtacaccatcttttccttcacggaggcctggggtgacgacgccgagggctacttcttcgggaacttcctggccgtcgctgaggccccgggcatcggcttcacctacgtgccgtccgtcttctttccgctcctgctggtctgggtcacggtcatcatcatcatggtggccggaatccgcaaaggcatctcccgcgccaactccatcctcctgcccttgctgatggtgatgttccttctcctggtggtccagtcgctcttccttccgggcgcagcggaaggcctgaacgcgttcttcacgccggactgggccgcactcgcagacccctctgtgtgggctgcagcctacggacacatcttcttctcgctgtccgtgggctacggcatcatggtcacctattcgtcctatctcaagcgccggacggacctcaccggttccggcatggtggttgccttttccaactccggattcgagatcctcgccggcatcggtgttttcgcggctcttggatttatggcgcaggcagcaggcaccggcgtgaacgacgtcgtgacccagggcatcggccttgccttcgtcgcattccccaccatcgtgtcccaggcacccttcggcggcctgatgggcgtgctcttcttcggatcgctggtgttcgccgggatcacctccctgatttccgtgctggaggtgatcgttgccgccgtccaggacaagcttggctggggccgggtcaaggcttcagtggtggtcagcgtcctggtggcagccgtctccctgggcctgttccccaccgcaacgggcctctacctgctggacacctcggacgccttcgtcaacagtttcgggatcaccctgggcgcgctggtcaccgtggtggtcctcgcttggttcctgcgcaagctgccgctgctctcggcccacctgaaccgcgtctcaaccatcaggatggggcgggtgtggatagtgctggtggccggcgtggtgcccctcgccctgatttacatggtggccaacgaattcatcagcaagatctccaccacctacgaggggtaccccgagtggttcgtgggcctgtttggctggggcatggccggcgcgctggtggtcctggccctcgtactgacggccatcccctggagccgcagttccaaagcccactatgaccccgagtacgacgaagtagtcaaagaggatgcacaggagacggcaccatgacacccatcgccatcaccatgatgatcattgcgatcctcaccgtctggggcggactggcgctcgcaatggtcaacctcaagaggcacccggaggacgagggcgccctgcccgaagagcacgcacccgagctctgaccggtctgtggtcagcacggctgcgcccctgccatggtcacggggtggattgtccgttgccactgctgttgcggccgttggcggcgggcaggacgacggcgtcggtaactgccttgccatgggcgttctggaacaccgcccgcaccaggactgcgggctgcccgggcgtcgcggaaggcagctcaagagttgaggtgtacgtgccctcatccgtccgtttcgtcacgggctggcgggctgctttctgccagcttgcgccgtcgtcggacgaggtttcccacactgccaccggacccggggtgcctgtcgccgtagccgccacactggctgtgctgcccgccgccctggcctttggctgcttggaaacctgcggcagttccactgtctggtcgaaggcgggccagccgtccacccagtcaattttctggaggccaagggtggggaagtaggggatgtcctggttggagccgtcgtagtagtggaaggccaggtaatcgccaaacacggactggccacccggaccggtgacggcaccgtgcgaatccaggaccactgaccctccgccgccgaacatgtcgcggccgtccttgtccaggtaggggcccttgacggaggcggaacgccccacggccaccttgtaggtggagtcggcaccgcggcagcaggagtcgaaggagacaaacaggtagtagtagccgccgtgcctggtgatgtacggcgcctcgacggggttgcctggcatgaaccggtccgcaatgtttacggttttggactgccagtcagccaccggcttgccgctgggccattcgatgggcaccaggaagatcccgtaccagaacgatccgatggccatgtacggtgtgccgtcggtgtcctcgatgatgccggcgtcgatcgcgttgaacgtcttgccggggttgttcgggtccaggccggtagcgggggaggagaccaccaggccccggtccacccactcgtagtccgggtgggtgggatcgagggtggtgttggtggccagggcagtcagggacttgttgccgccaaagcgcgacgccgagtagtacaggtagtaggtgccgttgtgttccgtgatttccggcgcccacaggttgccggggagctcgccgtcggagaagtgctcatcgatccaggcgggaatccggtcccagacggtgccgctgtactcccacgtggttccctggtcatgggaagaccaagcctggatggtgccgccgttttcccggttcaccatgcctgtggagtagacgtaccaggtgccgtcgtcgtcgatgatgagggctggatcgtggatgggggaggtctggccgacgacggtctttccgcccggcaggtccgccggcctggtgtcgttctttacggccggcgctgacaccgtcccaagaacctccggggccggagcggttgcccctatgtggggaccggccgccgtcgggagcgctgccgctgtgagggtgagggccagggctgcagccaatcctgcagcgcggagcgcccatggacgtgacttcgtcatcacgtggtccttccgggatgtggagcggtttcaaccgcagggatacgtgcctgtattgcaacgttgtaacgaagaatattgcacgagacctggatcacgtcaaggagggtccgtgacggctaaaaactaatcgtcggggtgcccttgacgatccttcccctcgtgtgtgattgtttcttacaacgttgcaaagcagcaacagctccgatatcggcccgctaccgcggacggcggagcctggtaccgcccagcccaataaacttgtttgctccacccaacccggaaggactgcgtgatgatgaagtcacgtcccatggccgcgaccctggcgctttttaccgccgccggcctcatgctcggcggttgctccgccccctctggcggggacgccggcggcgaaaagaagctcacctttatgttccgcgggggtgaagatgagaagaaggcctatgagaaggccgttgagcagttcgaggccgcaaacggcgttgacgttgacatcattgttactacggcggaccagtacgccaccaagctgaaggccgcaattgccggcaagcaggtcccggacgtgttctatatcggacccggcgacgtgcaggcgtacgtgcagaacggaatcgtcaaggacatcacggagtacgtggaaggctcggacacgattgacctggacaacatctgggaatacggcgtggacagctaccgctacgacggcaagcgcgtgggcgaaggtgccatctacgccctccccaaggacgtcggcccgttttccttcggctacaacaagaacatgctcgaaaaagccgggattccgctcccggacaaggacaagccctacacctttgacgagttcgtggccgcagccaaaaagctcaccgccgacaccaacggcgacggcacgctggaccagtggggaacaggcctgaacgtccagtggaacctgcagccgttcgtctggtccaacggcggggactggctcagcgaggaccgtaccaaggtcaccgtggacacccccgaattcgccgaatcgctgcagtggttcgctgacctgcaaaacgtccacggcgtcaccccctcggtcgctgaagcacagaccctggacacctaccagcgctggatgaagggcgaaatcggcttcttccccatcgccccctgggacctctccacctaccagaaactgggcttcgagtgggacgtcatcccctacccggcaggcgacaccggggagacggccagctggatcggaacgctcggcgtcgcggtctccgaaagcaccaagcaccccgaagaagcagtaaagctggtggagtacctcaccgccaacaaggaagcccagcaaagcctggtggacgcgggcatccagatccccaacctgaaggacatggccgagacctgggcggcggacaccagcaccaagccggccaacaaggaagagttcctgcagatcgtcaaggactacggccgcgccctgcccggcggcaacaccttcaacgccgagtggtacgacgagctgttcaccaacatccagcccgtgctggacggcaagcagaccgctgccgactacctgaaggaagcccagcccaggatgcaggaattcctggacgccgccaaccagcaggccggcaactaaggggatcaccggtatgacaacaaccatcacccgccgctcgcggcttcaccgtaaggaacaccgggccgccctcgcttttgttgccataccggtgatcggcttcctcctctttacgctcttcccgctcctcttctccgtgtacgcctcgttcaccaactggaacggcatctccgccccggtcttcaagggcctggacaactacaccaagatgttcggcgaccgctacttcctgcagtcgctctggaacaccctgtacatgatgatcggcattcccatcggcctggtcatctccctgggcctggcgctggcaatgaaccggaagatgcgcggcaccacgttcttccgcaccgtctactacctgcccgtaatctcctccattgccgccgtcgccattctctggcagtgggccttcaacggcgacttcggcctcatcaaccagggcctggccctggtgggaatcgacggccccaactggctgcaggacaccgccaccgtgaagccagccctcatcatcatggccatctggaaaggcttgggttattccatgctgctgtacctggcagccctccagtcggtgccccgctacctttacgaggctgcagcgctggacggtgcaacggcctggcagcagttccggcacatcaccatccccatggtccggccggtcaccttcttcctgattgtcaccagcatcatcggcggctcccagatcttcgtcgaaatcaacatcatgacccctaccggcggccctgagttccagtccgcctccatcgtttggtacatctggcaaaaggcgttcgacaacctccagatggggtacgcgtccgccatgtccgtggtcctggggctgctggtcttcgccatcaccttcatccagttccggctcaaccgccgcaaccagttctcgatcgattgaggcaggcagccatgtccgcacagaacgtcatcaccacacccccgctggagcccgcgcaggaaatccccggcggcgccgggagcggaaagcctgccgggcgcgggcgggcaggcaggggctcgcggtccgcgaaggaaacgctccgcctgggcaacatcctcaccaccctggtcctcagtgtcggcgcgatcgtgatgatcgccccgctcgcctggaccttctccacctcgctcaagacgaaagacggcgtcttcgagctgccgccgcagtggattccggatccgttcgtgtgggagaactacgcccgcatctggactgccggcccgctcctgaccggcatccagaacagcctgatcgttgcctgctcggtaaccatcgtgggctcgctgacctccgcgctcgcggcttttgccttcgccaagatgcggatgcccttaaagaacgtcctgttcctgggactcctgtccggcctcatgatcccgtttcccaccctgatgattccgcagttcaccatcttcgcgagcatcggctgggtagacacgctgctgccgctgatcgtgccgggactcttcggtaacatcatcatgatcttcttcctgcgccagttcctgaacagcatcccggactccatcgtggaggcagcccggattgacggcgcctcctacctgcagatcttctggacgctgatcctgccggccatccgcccggcccttgctgcccagttcatcctctggttcatggccatgtggaacgactaccttgcgccgatcatctacctgaactccccgggtacgcagaccttgcagctggtcatcgccaatttcaatgcccagtacgccatccagacggactacccgctgatcatggccgcatccttcgtagcgctcctgccggtgctcattgtcttcgtggtgttccagcgccagatcatcgaatccattgcgctctccggttccaagggctgagccgtgccagtgaacacagacatagataccgaggagatgcttccgctccccgccggtgccgtccaggagccgtcctcctggggcgcgcggcatgcgcatgaccccacagtggtgcgcgacgacgacggcacctactacatgttctccaccgacgccgtggcgaacatgaaagatattccttccggggtacatgtccgtacgtccgccgacctggtgcggtggacgtacctcggaaccgcactcggcgaagtgccggaagcggcagcggcgtggtccggcgcccaggggttgtgggcgccggaggtggtccgctggcccaccggggaatggcatatgtattactcggcgtcgactttcggttccaacacctcggccatcggccttgccgtcgcggcatcgccgaagggcccgtggagggaccgcggcttggtggtggcaacccggaagggtgaacattcccaaaatgccatagatgctgcggttgccttcgacgccggcggcaacccctggctgacctatggatccttcttctccggcatctacatcctccccctggaccccagctccggcctgcccagggtggaaggagatcttggcctcgtcatcgcccggcgcccacggtctgtggaaggggcagtggaaggcgccttcatcctccgcagcccgcacgatggccgttacatcctgttcacctcctatgattcgctgttcagcacctacaacgtgagggtggccgtcgcggaccacatcaccgggccctaccgggatttccgggggctggagatgaccgacgtggacgcgccgcctgccgcggtaggcaccaaggtgctgggcagctatcagttcgacggcggaacagcctggctggcgcccggccacaattcagtcctgacgcagaaggggccggacggagcagccgagcactttatggtccaccatgtccgctttggagcggatcccagccagcacgtggtccaactgcgccggctcttcttcactgccggcggctggcccgtcatctcaccccagccgttcgccgggctccggagtgaggctgttcccgctcctgccgacgtggccggaacgtgggaggtcctgcgcttcgaccccgagtccacagacgttgtgccggccgtgcggatgggcgtggagagcgttgacctccatcccgcggacttccgcgggcatccactggctgtccgcctgcgtcccacgggccccggtggcgaaccgggcacagagattgacgccgtggtcttcggttcgtgggactggtcccgcaacagccgggccctttccttcagcggcatcgaccagtgcggggtggcctggtccggaacccgggaggggctgctgtgactgatggtccactggggtgggccgggcggctgatggactggctccgcttttccacccggctggtcctggtcaacgtgctcttcgtggccggagccctggccgggctggtggtcctgggcgtctttcctgccgcagtggctgccaccaccgtcctgggcaggctgcggaacggttcggccggggacagcctggtgcgggagttcatcactgcctaccgcttccagttccggcacgccaacagggtgggaagcgccttctggattgccggcgtcgtccttgtcctggacttcgcatcactgctgggacctgccggggcggccatgccggcgcccgtacacgccgtcctcctggcgctgtccacagctgccgcgggagtcacgctggctgctgccgccaccgctgtgggcctgtgcagccgctaccgggattccgtggccaggacgtggcggacggccttcatgctcccgcttgtatcacccgccatgagcctttccctgctggccaccctggcggcggccgccgtcgtcttctccggaatgacggcgctggtgcccctcattggcgcctcggtcccgctcctcatctccggatggctggtgggccacaggctcgccgggctggaagcaggaccttcccccgcctagattcccccatcaccactcccaatcagacgcaccacctttacaacgttgaatagaacaggaatacacaccgtgaccatcacttccgccgcccctgaacaggccgacctggctgtcgtggcacccaccgtcattaccgtggaccgctccgccgtcgtggcgcccgtcaaccgccgcatcttcggctccttcgtggagcacctgggccgctgcgtctatgacggcatctacgaacccgggcatcccaccgccaacgaggacggcttccgccaggacgtcatcgaactggtcaaggagctcgggtccagcaccatccgctaccccggcggcaacttcgtttcgggctaccgctgggaggacggcgtcgggccgcgggagcagcgtcccgtacgccgggaccttgcgtggcactcgcttgaatcaaaccaggttggcctggacgagttcgcccgctggtgcgagctcaccggctccgaactgatgatggccgtgaacctgggcacccggggcatcgaggcggcccttgacctgctggagtacaccaaccacccctccggcaccgcactgagcgagcagcgcatcgccaacggcgccaaggatccctacaacatccgcatgtggtgcctggggaacgagatggacggtccctggcagatcggccacatgtcggcagaggactacggaaagctcgctgcccgcaccgcttccgccatgaagacggcggacaagaacctggagctggtggtctgcggctcgtccggatccgccatgcccacgttcggcgagtgggagcgcgtggtgctggaacacagctacaactacgtggactacatttcctgccatgcctactaccaggagcgcaacggcgacctcggctcctacctggcgtcctcgctggacatgcagtacttcatcgagaccgtggtggccaccgcagaccacgtcaagcacaagctcaagagcaaaaagaccatccagctgtcctttgacgaatggaacatctggtacctggacgagcaccaggcctccgacgaggtcaacgaggaatggacccacgcgccgcgccagctggaggacacctactccgtggccgacgccgtggtgttcggcaacctgctcatgacgctcctgaagaaccacgaccgcgttgctgccgcttccctcgcccagctggtgaacgtgatcgcgcccatcatgaccgaaccgggcggtgacacctggcgccagaccacgttcttcccgttctccgtcacgtcacggctcgccaagggtgaggtgcttcgtccccgcatcgacgccggaacctacacgacggcggtctacggcgaggcaccgctggtggatgcggtggcaactgccgacgccgccacgggagagtctgccctcttcctggtgaaccgcagccagaccgaggcaattgacatcaccatcaacgtctccgacctcaacgcgaaggtgatcaccgaggccgtcaccctccacgacgaggacgtgtacgccaagaacaccctccaggaccaggaccgggtgggactcaagcagctcgacggcgccgtcctggacgagggcacgctcaccgtgaccctgccgcccgtgtcctggtccgccgtcgcgcttggctgacgtgccccgggaaacacagggctccgctgccggccgcactgctgttccaaccttggtggtgcggctggcagcggtgctggccgtcgtcgtcgtgctggtcctgggcggttgcgttgccccgccgcgtgcggcaccggaggacaaaccggctggactcacgggcgacttcttcacccatgaccccgcgctcgtgaaaggggaggccggggaaccctggttcatctactccaccggcaacggccaggtggcggacggcaacatccaggtgcgccgctccaacgacggtgtggactgggaatacgccggcgaggtctggcaggagaagccggcctggctcaccgcagcagtgccgggcgtggacaacctctgggctcccgagctgtatgagcatgacggcacctggtacctgtactactccgcgtccaggttcgggaagaacctgtcagtgatcgcgctggccaccaacagcacgctggatcccggggacccctcgtacgaatgggtggaccgcgggcaggtgatctcctcgaagggcgaacggttcaatgccatcgatcccggcgtcgcggaggacgaaaacggcacgccgtggatgtccttcgggtcattctggacaggcctgcagctcgtggaactcgaatggcccacaggcctgcgtgccgacgctgctgaaccgatggccatcgcggaccggaaagcgctgcccaacgccatcgaagcaccctacatcctgccgcatggcgggaagtactacctgtttttctcccgcgacttctgctgccaggggctggacagcacctacaacattgccgtggggcgcgcggacaccatcaccgggccctacgtggacgccgagggcagggaactgctcgacggcggcggcacgccgctgctggcatccgacagcgggcgcgtggggccaggcgggcagtccgtttcagggaacaccctcgccttccactactacgcggaagaactcgacggtgcttttcgcctcgggcttgctgacctggagtggaaggacggctggcctgctgcgcggtggggctgagccgcgagtttttgtccagatacgaggacttccttggcgcggttatcccggcgcatctggacaaaaactcgcgacgtgcgccggttaggggaaggagggcacgtagctgggcaccccgacggcgtccgttgacaccggcgcaccggtgttattgatgacgtggtccagcgtgccggcgcccaggttgacggtcagcaggctgtgcagcttcacgcccggcgtcaccggcacctcaaagccccgggttgcatggatggtggggtccacgttgttgtagacgtagctgccgccgccccagagttcgtgggttgtgacggagtctgcgatcttgtagccggcccagcccaggaccccgtcgtgctgccaggcggcctggttgggtgcgtcgtagggcagctcattctggaagaagacggtcctgccgttttcgccgttccagatgacgttgtactcctggtagtgctccacgaacaggccggtggccgtgacattgtcaccgttgatgatcacgccgttccggccggtgttggtggtccagcccaccccgttgccgtggtcggcgcgccaggcccagatgtggtccaggaggacgttgtcgctgttgacctccaggctgacagaggctttgcccacgtgcggcccgccgatgcggaaaaacacgtcgtggagcgtggtgggattggcaggatcagtgtggacagccgagttcgcggacccgctgccctcgccctgctgggcctttccgatccgcatcaaagccggtgaattcacttcaccggcgtcgatcgtgacggcggcaatgtccacgccgggcacgtccgcaaccgtcagcgggacggcgccgttgacggcggtgagggtggcaatgcccagcccaaggacgacggtgttggcccttttgacctcgatgctctcatcgatgccgtagacccccggggtgagcagcaggttcttcccgcgtgccagctgggagttgatggtcttgacggaatcggaggggcgggccacatagaaatcggacagcgggatgctgcgccccggcgtcggaccgttttcccaggtggtcccggaggagtccatgcggacggcgggaacgaacacgctgtactggccggccgtatccagcgtgaggtaaggcttctcgcggctgatcggtgtgtccgccagggtggtgtacggcgggttggggaaggactgcgccggtgccccgtccactccggagaagacctggttccagaccccgttggaccagtggccaatgctgctgtcccggacgaagtactgctgttgcgagccgttaatgacatcgcccgtcttcgaatcggagatgaagccgccgctggcgtactgcggcccggcggtgcagtagtccatgagggagaggttgccgccggtgatgttgatccgccgcatgggcgacgcctgcgaggccgcccagaaattggcggagctgcggcagccctcgaggccggtgacgttgatggtgaggttggacagggaccgccagaagttgttcagggcgatgcagttatccgcggtgaggcaccggttgtagacgtccacatgcccgttgatggtgacatccgtgggggaagcgcccagccccgccacctcggtggagtagcccacctggatgatgagcggctcctcggcactgccgtaggttcccggcttgaacagcagtgagtagcgtttggaccccatctcatcgtccacctgttctgcggcgatggaatcaaccgtggcctggatttcagccaccggcatgctcggatcgaagatccggacattggggccaaagtccggttccgcgccctggggaagggccggggcagcggcaggtgcaggggcctgttgcaccgatgcctgcgaaacggggggagctgccggcgcagcggtggccatgcttcctccgctggcgaccaggccagcgaggagggcgacggtgccggcgacgtgcgggcgccggccctgggtgcgccgcaggcgcggctcctgggggctgtctgcacgcggaggatgggggacgtgggctagcggcattgctggtcctgttcgttggtgggattcgtcgagcctgggcggcagggtaaggctgcggcagtgggagcgctctcgtcggggaagcgtaacaccgccgggaaagaccggcaaggatcaagtggaagcgctcctaccgcctcttgacaagctcttgtgaggtgggacaccatgtggtgagagcgctcccacatccgtgccgcacccggtgcggttccaccgctcaccccctcttcgcctccgaccgtcatgccggtcgacagggcattttctgacgaaggagtctttcctgtgaaaaacccaaccaagttcaccgtgttatccgccgcggctgcctgcctggccctgtcgctggcagcttgcggatcctctgctaccgaatcaggcggggtggacggcgccaccggttccgaacccgtcacgctcacggtgggtaccttcaatgagttcggctacgaggagcttttcgaagagtacgaaacgctgaacccgaacgtgaccattgagcacaagaaggcggcaaccaccaacgaagcgcgggacaacctcaccacgcgcctggccgccggctccggcttgtccgatattgaggccgttgaggtggactggcttccggaactcctgcagtacccggaccgctttgccgacctggccgaccccgccgtggaaggacgctggctggactggaaggccgaagccgccaccaccgccgacggcaagctcctcggctacgggacggactccggcccggaggccgtctgctacaacgccgagctgctcaagaaggccggcatgcccagcgaacgcggggaagttgccacgatgctggggaccacctgggacagctacttcgaagccggcaaggcctacaaggccgcaaaccctgattccgcatggttcgattcggcgggggcaatctaccagggcatgagcaaccagcttgagaaggtctacgaggaggaggacggaaccgtcatcgccacggagaatgagaaggtcaaggacacctacaaccaggtcctgaaggcctccaccgaggacgggctgtccgcccacctcagccagtggagcgatgactgggcctccggcttccagacaggcgccttcgcaacaaccctctgcccgggctggatgctcggagttatcgagggcaacgcagccggggtcaccggctgggatgtggccaacgtcttccccggcggcggcggaaactggggcgggtcctacctgacagtccccacccagggcgaacaccaggccgaggccaagaagctggcaggctggctgaccgcccctgagcagcagatcaaggccttcacggccaagggcaccttccccagccagaaagaggcgctggaaagcagcgaactgctgggccagacgaacgagttcttcaacggcgcgcccaccggccagatcttcgccgaacgcgccaaggccgttgaggtgactcccttcaaggggaccaagtacttcgccatcaatgacgccatgcagcaggccctcacccgcgttgacgttgacaagacggacgacgccgcctcctcctgggagaagttcgtcaccgcagtgaagtccctctaagcatggctgtcaccgaccgggtccggccacggagcgccggcgggcaggtcccgcctgagggcacgaagggtgtccggcgcctggccttctcgcagcaggtctccaagtgggacgtcaagctgtccccctacctctacatctcgccgttctttatcctgtttaccgtcaccgggctcttcccgctggtgtacaccgcctgggtttccctgcataactggaacctcatcggcgggcaggggaagttcacgggcctggaaaactacgccttcgttgtggcccagccctacttctggaacgccgtgggcaacaccttcagcatcttcatcctgtcctccgtgccccaggttgtcatcgccctggtcatagcggcggtgctggacgcgaacctgcgggccaagacgttctggaggatgggggtcctggtgccgttcgtggtggcgccggtggcggtgggcctgatcttcaacaacctctttgcggaccagtttgggctgattaacgggatgttgacggcggtagggctggacccggtccggtggcattctgattccgttgcaagccatctggccatcgccaccatggtgaacttccgctggaccggctacaacgcgctgatcttcctcgcggccatgcaggccatcccgagggacgtgttcgaagcggcaaccatcgacggcgccggcaggctgcggcagttcttctccgtcactgtccccatgctgcggccaacggtgattttcgtggtgatcacctccaccatcggcggcctgcagatcttcgacgagccgcgggtctttgaccagtccggcctgggcggagcggacaggcagtggcagacgctgaccatgtacatctgggaacttggctggggccagcgcaacttcggcagggcctctgccgtagcctggctgctcttcctgatcattgtggtgatcgccctgctcaacttcctcatcaccaagcgcattgcaagccagggaggccgcaagtgagctccatccccatgatcgaacagaccgccgggaagggggcagccaaggcagcagcgcggcgcgggccaggtgcccggaaaccaaggtccggccacggaagtgcccgccggcccggcttcctcacctacggtttcctgggggctgtcctcctggcatccctctttccgctctattggtccttcctggtgggcagtcatgacaacactgtcctgagccgcggcatcccgctgctgcccggcgggaacttcctggccaacgctgcgaaagtctttgacagcatcccgttctggaaggcaatgggcaacagcctcatcgtctcgtgcgtgaccgcggcatccgtcgtcgtgttttccacccttgccggattcgccttcgccaagctccgcttccggggcagcaaggggctgctggtgttcgtcatcgcaaccatggcggttcccacgcagctgggcgtggtcccgctgttcatcgtgatgtccaagctggggtggaccggctcgctgtgggccgtcatcattccgggtgtggttaccgccttcggcgtcttttggatgacccaatacctccgtgacgccctccccgatgagctcatcgaggccgtgcggatggacggggcctccatgatccaggccttctggtacatcgggttccccgccgcacgccctgcggccgccatgctcgccctgttcactttcgtggctacctggaccaacttcttctggccgttcattgtccttgacccgtcaaaccccacccttccggtggcgctgcagctgctgcaggccgcccacttcgtggactactccgtggtcctggccggcgccgtcctggccaccgtcccgctcctgctcctgtttatcgcggcaggccgtcaactcgtatctggaattatgcaaggagcagttaaaggatgagttccacccaacttccgtttccggagggctttctctggggcgcggcaacagctgcgtaccagatcgaaggcgcagcacacacagggggcagacaggactccatctgggacgtgttcgcccggctgcccggagccgtggcggacggccacaacggtgacgtggcctgtgaccactaccggcgctacaagcaggacgtggcgctgatggaccagctgcacatgaaggcctaccggttctccacgtcctgggcccgctgcatgccggacggcgttacgcccaatcctgaggggatcgctttctactcccgcctggtggacgaactgctggctgccggaatcactccgtggctgactctctaccactgggacctgccccaggcacttgaggacaagggcggctgggccaaccgggacaccgcctaccgtttcgccgagtacgcggcgctcatgcacggcgtcctgggcgaccgggtccggatctggaccaccctcaacgaaccgtggtgctcggcgttcctgggctatgcggccggtgtccacgcgccgggaaggcaggacccgcgggcggctctggctgccgcccaccacctgctgctcggccacggcttggcagcccgtggcctgcgccgcgaggatccggacgcctcggtgggcatcaccctgaacctgacggtcccggatccgcgggatcccggcagcgagggagacagggacgcagccaggcggatcgacgggcagttcaacaggatcttcctggatccgttgttcaggggcgagtacccggccgaccttctggcagacgtggcgcaccttggactggctgacctggtgcaggacggggacctggaggccatctccacgccgctggacctgctcggcgtcaactactaccacggggaatccctcaccaaggacccggcggatcccggggagcgggcgggccaggagacgacggccgctccggggcaggcagaccgcccggtatcctccccgttcgtggcagccgatggcgcacgctcggtaccccgcggcctgccggtgacgggaatgggctgggaggtccagcccgaggggctgcggcgcctgctcaaccggctgcaggcagagtacacgggcccggccggcatccccatctacatcaccgaaaacggcgcagcctacgatgacgtcccagacgaggcgggcttcgtcgacgaccaggaccggctggggttcttcgcagcccacctccgggcagtgcacgatgccatcgcggacggcgtggacgtccgcgggtacctggcctggtccctgctggacaacttcgagtggtccttcggctaccaccagcgcttcggcttggtccgggtggactacccaacccagcaacgcatcccgaaagccagtgcgtggtggtactcggcggtggcggcctccaacgccattccggccagcagcaaccccgtgtctcctgcggagccgggtgtcgtattgtctgtgtaatgaacgaaaagtcccgccggcccggcctcctgcaagccgggcggcccagcccgacgcttgaagatcttgccacggccgccggagtgtcccgctccaccgcgtccagggcgatcaacggcgggctgaaggtcagcccggaagcccaggccgccgtggacgccgccatcgtggccctcggctacacgccaaaccgtgcggcccggagcctggtgaccaggcgcaccgggtccattgcgctggtcattccggagccggacgcacgggtgatgatggaccccttctttgccgccgtcatcaccggcgtcaacgaggccctccggggcacggacatgcagctggtgctgctgatgtcccgggcgggggatgactccgcccggaccatgcggtacctgcggggcgggcacgtggacggcgcgatcgtggtctcgttccacgaggcggacgactgggcggagacccttggcacaaccggcctgcccaccgtcttcatcggccggccctgggcgatgggcttcggggtcccttacgtggacctggacaacttcgagggcggccggcttgccgcccgccacctggccgccaccgggcgcacccggctgggaaccgtggcagggcccgccgacatgacggcggcagttgaccgcctggaaggatggaagcagggtgtccgggaggccgggctgcagcccgggcccgtcatccacggtgactttacgacggcgggcggcgccgaagcggcacgggacctgctctccgggtcgccggagctggacggtgttttcgccgcctctgacctgatggcgctgggcgttattgacgtggtgcggggcgggggccggaaggttccggaggacgttgccattgtggggttcgacaaccattccctcctggccgccaacggtatgggcctcaccacggtgacccagcccatggtggacatggccgtgacggccgggaagctcctgatccgcgtgatcgaaaacccggaagagcagctggagccggtgatttacccggccgagctggttgtccgcggcagcaccgcgggacacggcgactagattcaatccggcagagcggattgatcagccggggtggtgtgtcaggcgatggccgcgcctacggtcgattcccgcggaaccacccggaacgccgtctcaacttcccggggcggcattccgtccgggtccttgatccgttccatcagcatccggatggcggtctcggcgatctcggtccggccggggtccaccgtgctcagggtggggagggtgtaccgggtttcatccaggtcgtcgaaaccgatcaccgcgacgtcgtccgggacccggtaaccggcttcctgcaggacgcgcacggcgccctgggccagggtgtcgttcaggccgaagacggcgtcgaaggaggcgccgcggtccagcaggtcgtgcatggccgccgcaccgttggaccggtgccagtccaccacgtaggcgataatcccgtcgtcgtacggaatgccgcgcccttccagcgcctccctgtatccgcgcaggcgcaggccggccgagccgatgacctcgccctcgtgggcgccgacgacggcgatgcgcttctttccgaggtccagcaggtgttcggtggcggcccgggcggccgtaacgttctgcatggtgacgtggtccgaggaactgccgaagatgcgctcgccgagcaggacaatcgggacatcggccttgatcaggtctgcgtcctcctggccgagcgccagcgggctgaagatcaggccgtcggacatcttgaggcgcggactggccatcacctcaagctcgcgctttcggtcggcgccggtctgctcgatcagcaccaccagtccgtgcttggcggcagcctcgatgaccgcgtccgcgagttcggcgaagtacggaaggctcagttgcggcagggccagggtgatggcgccggtgtgcccggagcggaggctgcgggcagtgaggttggggcggtagcccagctccgcgatggccttttccaccttggcgcgggtggtgtcccggacgtgcgggtggttgttgatcacgttggagacggtcttgaaggacacgcccgccatccgcgccacatcgtgaagagttgccgccatcccagtccctttaggttcaaccgcggcccgcaggccagtaccgctcactttacaacgttgaatcgactcaacctgttgaaaggacggcggtgccccgcccctgcggggcaccgccgtgattcaacgccgcttgcgccccgcccggtcctgccggccctgccgttcacgctgttccgagaggtcgcgttcggcggaacgctgggactttccggccatgaccactttttggtgccattcccgctggtaggcacgctgcgctgcggcgtcgctccggcgggccagggcggcaagctcccgctgcagtttcaggtagttgtgccagcggcgttcctccagcacaccgtccgctatcgcctcctgcacggcacaccccggctcgctctggtggccgcagtccgtgaaccggcaccggccggccagggcttcaatgtcaccgaacatcccgccgatgccgtcctcggcgtcgaacaatccaaaaccccgcacgccgggtgtgtccatgaggaccgtcccgttgggaaggggcacgagttcccgggacgtggtggtgtgcttccccctgaagtcgcgggaccgcacctccccggtgtgctggacatcgcggcccgccagggcgttgatgagcgtagacttcccggcgccggacgggcccaggaggacaatggtgccgcccgccggaatgtgcgccagcaggtcggggatgccgtcaccggtttcggctgaggtggtgaccacttccacgcccgccgcctgcaggatgactttcccgacgacgtcgtccgccaccccggcgaggtccgccttggtgacgatcaccaggggagtggcgccggagtcccaggcggccacgagggtgcgctccagccggttgtgcgtcagtggccggtccacaggcaccaccacgcccaccatgtccatgttggccgcaaggacctgcgcatcggaggagtcctcgaaggcgcgcttccggctgagctccgagagtcgtggaaggacaccgaggacctggcggtcgccggccctgttgggccccatccacacccagtcgccggtgactgccacgtcaccggtcagcgggtatggaaggtggagcaggtctgttcctgccgccaccaggagcagggaacggtccacgcggaccacgcggccgcgctccgttgcccctggcagggggtggttgtcgaagtgccgggcgaccgccggggtgtagccgtaggcaagcgggccgtttggaggggcgttgtgtgtggtgctgcttgacgtggtgatgctgtccaggccgttgcctgatgatgatttcactgtgatacctcagggaaggcccctgcgctccggccgccttgggcctgggggtgttggcgctccgcggtgaggtcaggcggggccggtgcggtacaggggaggagtctggatgatgggtgcggagcgctcaaggcgcggggctgtaacagtcatcaaaaccacctccctctccagccgttgggaccggcatcaggtcccgtgggttccgccggcagcatccggcggaacccactttagccccggccggcggaatccaccagagcccggaatcgaacctgcaaatccgggaaactggcccggaccagcacgttgttctttgagggggtgccggttggggcataggttggctgcagttgtgttttccagggacgcaggacgagttgaggaggaaccatgggcgatgacgccatggaccgggccgctgcaaggaacgatgccgtgttgaacgcaggcaaggagagcgggcccggaatcagccatgctgacaggattgatgacgacggcggccgtccggcgaagtggcgcatcgtcggtcccggcctggtggtggctgccaccggcgtgggtgccgctgacatggtggccacgctggttgcgggctcgcgctacggctacggcctgttctgggcagtcattgtgggtgtggtgctgaagatcatcctcgtcgaaggggccggcaggtacacgctggcaaccggaaagaccatcttcgagggctggcgctccctgggaaaatggaccacctggtacttcggcccgtacatcatgatctggggtttcgtgtacggggccacggccatgtcctccgcggccctgccactggctgccgtgttccctttcctgccgctgtgggcgtgggccatcctgatgggactcgccggcttcgcgatggtgtggtggggcaaatacgccaccttcgagaagatcaccgccgtgctggtgggcttgatgttcgtgaccgtggtgggtctggccgtgattgccgcgcctaacattccggagatgctcgccgggctgatcccgatgatcccctcgacggacggcggcatcttctacacgctggcgctggccggcggagtgggcggcaccatcacgctcgccgcctacggctactggcttcgcgagaagggctggtacacgcccaagtggatgaaggtcatgcggatcgacaactccatggcctacgtcatgaccggcatcttcgtcatctccatgctcattgtcggcgcggaggttgtgcgttccgcaggtgtgtccctcagcgccagcgatgaagggctgctggacctctatggtgtgctgaaggcggaatacggagacgttgtgggaaccgggttcctggtgggtttctgggccgcgtccttctcttccatcatcggcgtctggaacggcgtctccctgatgttcgccgacttctgggggaacatgcggggcaaggagtccggccacccggatacccgcgtaggcggaaaatatttcaggttctacatcctgtggctgacgttcccgcccatggttttgttcgcgctgggccagccgatcggcctgatcctgctgtacggtgcactgggttcgctgttcatgccgttcctggcgctgaccctgctggggctgctcaacggcaggcggatccccaaggcgtgggccaacaagctccactccaacatcgccctggggatctgtgcgctgctgttcatcgtcctgggcatccggcagttctggacgtccctctcgccgctgtttggcggctaaaagccactaacggctgctagcggggccaggctcctaccgctgcagttccagcgcccgcttctgccgcgccgagatgctcgaaacatacccgcagttggtgcacgtgatgttgtatttccgggacgtagtgaacaccggaacgaagaagagcgtgaacttggtggcccgctcttcaaggtggtggtggacgaaggagcggcagtactggcaggtggccggtttaccgggctgcgctttcagcaccgtcttgaatccaaagagaaggaacatgggtctggcctttcggggcagtcctgctggctgtcctgacaaccttaggccctgggcccagtgatagtgccatcctgacagcctcccggaccggtgcgatactgggggtccgcgcaatgttcgcaatcagggggatttcggcaaacatggtcctggataccgcgacccttcgcattgcgttcggcctcatggcgctggtgctggtgttccttttctatttctccgcgtaccgggtgacgcgctcgccgtacagcggctggtggtgcctggcgctgctgtttttcctgtcaggatcggcgtgcttcctgctggacggcacggcccaccaggtctgggccaacccgctgggaaacgtgctgctggtgcacggcggagtggccgtgtgggcgggtgcccgatcgctgcggaccgtgccgccgccaaaatgggccttcaccggcatccccctggccaccctggtggcctcggtcctcgataatccggccaccaacacctggtccggcgggccggtgttcctggcggcaatgagcctcaccattggactcgcatcccgcgaactctggcgcctggaaccgggctactcccgggtccggatccccatggctgtggccgcgggcggactgtccgtgttttacctgctgcgctggggtgccttcatgctggaaggccagcacgggccggtcttccagagcgtcttcggttccgcggtcaccaccctggtgaccatggtcctgctggtggtggtctcgttcagcatggcggccctcagcagcgaacagcagaccagggccctgcgtgtggtggcttcccgcgacgatctcacggggctgctgaaccgcaaggccttcctggaaatggcggcagagcagctggcggacctgtccatcaccaggggatccggcgccctggtcctggcagatctggaccacttcaagtccgtcaacgacacctacgggcatgccgccggggacctcgccctgcaaaccttcgccgatgcgtgcactgcaacggtgcgtcccaccgacctggtgggccgctacggcggagaggaatttgtcatcctcgtccccggcgcaagcgccgaacgggcggaactcatcgccgagtcgatcagcaaccgccttgcggcggccaccacggcggacgggatggagatgcccaccgtcagctacgggatttccacctacgacggcgcctcgacggacgtggagcgcctgatcgcctcagccgacgccgcactctacatggccaagtcgctgggccggaaccagactgcccgcagcgacaggatgcgctagcgggggtccccgcaccggggcgcgtgcatgccgcgctcccggcctgttgccaaactgtggcttccgggcggtccgtaacccaagggcagcgggaacccctgctgataaaatggcggggttgcagggcggccttattgctggtccaaccagcgccgtaaccaagtaaggaccagacactcatgacggcaggcgggtcacaccccgggacttcggagactcagccgggcgcgccggccaaagcctccggccctgccaccggccgcgcttatctcgccacccttgagggcttcatcggagccctcatgatgtttaccggctccatcggcacgggctggatcgccaacggctcacccatgatccgccagccggtagtcattgccctccgcacagaaggctggggagtgacggtgtctaccgtgctgctcaccgtgggcgccatggtgctgatccgttcctggctgcggctgggccagcggctggcggactggggacagtccgcgctgcggtccgtggtggtcgccatctccgcctggtcactgccgctgctcttctgcgtcccggtgttttcgcgggacgtctacgcctacaccggccagggcaggctggtgatggagggccaaaacccgtacgaggtgggcatctccagcctcagcaactggttctcgctgggggctgaccctgcgtgggcggaaaaccggacaccgtacggcccctacttcctctggctggcacgcggggtggtggggctgacaggagcgcagcctgacgtttccgtgctgctcttccgtctcctggccggcgccggcgtcctgctctgcgtcatctatgtccccaaactggcggaactgcacggcatcaacggcgcccgggccctctggatctcggtggccaacccgctgttcctgatcagctttattgccagtgcccacaacgacgccctcatggtggggctggccgtggctggcgtctacttcgcagccacgcgccgctacctggcgggcatcctcctggtcaccgcgtccatcggcatcaagccgattactgtgctcctgctgccgttcatcggcgtgatgtgggcgggaccgtccgcgtcgtggccgcgcaagttcctgatctgggctgcgacggcgggcatcagcttcggcgtgctggtcctgagcggcatcccctacaaccttggcatcgggtggacctgggccatcatggaccccacgccggggtacacgggctactcgccgtccggcttcctgggccagcaggtggagttcctcgccaacgtcctgggactcccgggcggaaccttcgccaccctgctgcggacgggaatgaagtgggccgcgatcggggtggtcctgctgctgatgttccggggtgactattcgctggcggtgcgccggatggcgctggcgttcaccgccgtcgtgatgctttcccccatcatccagccgtggtacatcctctggttcctgccgttcctggccgtcacgggaatccgtgacgactggcagatcaggtcgctgtacgtcggcgtgacgttctttgtggtgttcggggcgcaggaccagctctctgtctggtccttcgtggagctgcccatcgatgcgtcgtcgctagcgttcattacggcgctggcatttacgttctaccttctattcctcgatgtgcatacacggaagctgctgatcgaaggcaagcccctggacctggccaggcggggctggacgtggctgctggcgctgcgggaggccaggcggggccgggcggaagagccaggccgcgagaagctgggaagccgctgacccgggatcagccatgggcggtgaggtaggcgatcagcccgcctacggttgaaacctgcggatagtcgcgttccggaatatttacgcccgtggaggtgtcaatcgtttccaccaagcgcaggaagtccagcgaatccagctccaggtcctggcgcagccgggcctcagcctccaggtccgccggctcaacgtccggcgccacctggttgatcgcccggtgcacggcctcgcgggcatcgtgtccgttcataactcctccggtttctgcagcagctcgtccagccgggcaaggaagcgggctccgcgaaggccgtcgctgacccggtggtccgcagacagcgttgccgtcaccacggggcggatgcccagcatcccgttgtgggcccacggctgctccatcaccctgcccagccccaccatggccacctggggcggatagatgacgccgaagacgctgtccacgccaagatcgcccaggttggtcaccgtgatggttggatctgccatctccgcccgttgcagcctccctgcccgggcccgggccacgaggtcgcggagccgctccatcagctcgtccacagacagggtgtccgcgtcatggatggcgggggcaacaatgccgcccttccgcagtgcgacggcaacgcccaggtgcacggaggggctcggccggaattcgtcgtccacatagaagccgttgacctccggcaccgattttgcagcgagggcagctgccttcagcagcagggcagacgccaccagccgggaggacacgggacgctgcaggttcacggactgcatccagaccatcgccgcggccatatccaccgtgctgctgaggtagtagtgcgggatggtccgcttggatttggacatcagcgccccaacggcccggcgaaggctcgcctcacgctgccgggcctccggcgcctggacgctttccggttccggtgtctttgcctgggcctcagcccctgcggcgtccagtggcagggcggcctccggcggcggtggcgcgactggtgcggcggccacagcctggaggacgtcctcctcccgcacggcaccgccaggccccgttcccgtcagtgacgcaaggtccagtccgcgctcggcggcaagcctccgggcgcgcggcgatgagcgcacccgccccggttccccggcgtctaccccggccgggcgtgctgcggccgcgggaactgcggcgcgttccacgtcaaaccgcgtcactgcaccatgccgtccggtgccccggacggtggccgggtcaacccccagcacatgggcgaggtggcgcaccgggggagagacggcgcccgggtgttctgccggtgcttctcctgcccgcgccccgccgtctgccggcgcttggcctagtgccggtgcccggcgttcggccgcagccgctgcaggcggggccggagccacaccacctgccgcccgcccagccggcgcaggcgtgccggcaggtctttcggccgccggggatccgtcgtcgggcgtggccgtgatgcgggcaagcggcgtgccgatcgggacggtggcgccaatgtccaccagcagttcggccaccacgccttcctcgaaggactcgatgtccatgacggtcttgtccgtgtccacaacggccaccacgtcaccacggtggacgtagtcgcccggcttgaccagccattcgatcattttgccgtggtccatgtccgcccccagggacggcatgcggaaatcacccacccttgcccgtcacctcccgcgccgccgccacaatccgcccggctgacggaagggcggcaagctccaggtgctttgcatagggcagggggacctccgcgctgcagacccgccccaccggtgcatcgaggtcgtagaaggccgtttccgtgatccgggcgctgatctctgccgaaatgctgccgcttcgccacccctcatccaccaccacggcccggtgcgtgtgtcctacggaggccaggatggcggcgtcatccagcggccgcagggtgcgcaggtccagcacctcggcgtcgatgccttcctctgccagctgctccgcggcgtcgagcactgccggaagagtgccgccgtaggtgatgagtgagacgtccttccctgtccgcctgagcgctgcggtatcgatgtccaccgggccggcgccgtcatcaatttcaccaggcatgttgtacagggtcccgtgttcaaagatcagcaccgggtccggatcctgcagggcggtccagagcatgccgcgggcgtcctccagcgtggcgggtgccaggatgcgcaggcccgggatgtgggcgtaccagccctccaggctgtgggagtgctgggcgcccagctgccgtcccgccccggtggtcatcctgatcaccagggggacgttgaactggccgccggacatgtgcaggagggttgccgcgttgttcacgatctggtccagggccagcaggctgaagttgacggtcatgatttccacgatgggcctcatgccaccgagggccgcgccgatgcccgcccccacaaagccggattcggacaagggggtgtcgcggatgcgttccgggccgaattcctcgaaaagtcccaggctgacggcgaagcagcccccgtacgcgcccacgtcctcgcccatgaggaacacgcgttcgtcacgctccatggcgtcccggatgccggccctgatggcctcccggtaggtggttttcattccgggccccgctcgctgtagacaaaccgggtgagttcctccaccggctccggcgtcccggcctcggcaaattcgaccgctgcggccacctcggcgtcggcgtcgcgctgcagctccgtccactgcgcttcggtcagctggccggcgtcctccagggcgctgcggagcagggtgatggggtcccgctccagccagtgcgccacctcggccttctcccggtagcgttcgggatcgaacatggagtgggcccggaaacggtacgtccgcagttccaggaagtgggggccggcgcccgaccgcaccgcgtccacggcgcggcgggcggcctcgtggacggcgagcacgtccatcccgtccacggcccatgccgccagttcgtagcctgccgctttcagcgcgatgtccgtctgggattcggagcgccccagtgctgtgcccatcgcgtacaggttgttttcgcagcaaaagagcaccggtaactgccacagggcggcaaggttgaggctttcgtggaactcaccttccgctacggcgccttcgccaaagaagcagacggtcaccccggagcggccggccatcttgtccgccagggcaaggccgaccgcgaggggcagcccgcccgcgacgatggcgttgccgccgaaaaagcgggtcccggcgtcgaaaaggtgcatggagccgccgcggccgcggcagcatccctggacatgcccgtacatctcggccaggatggcgcccgcgggtacgccccgcaacagtgcgtggccgtgttcccggtaggtcgcgacgacggcgtcctccccttggaggttgtccaggacgcccgcggcgacggcttcctcgccgatatagacgtgcaggaagccacggatttttgcctcactgtaaagttcgacgcatttttcctcgagccgcctgacgcgcagcatctggagcaggaggtgccgggccagggcggcctggtccgcgccgatgcgccctgccagggcggtcatggtgcctcctgcggggtttcgatcgtggacgtgtccccttcggggagccccagttcacgggctttcaggagccggcgcaggatcttcccgctgcgcgtcctcgggagcgccgtggtgaactcgaccatccgcggggccacggcggcaccgagccgtttgcgtgcgaagccgatgatgtccaggcgaagctcctccgatggctcccacccgttccgcagctccacgaacgccttgaccacttcccctgccacgggatcggggacaccgatcaccccggcctgggccacagcctggtgctccatgagcgagctctccacctcgaaggggccgatgaggtggccggaggatttgatgacgtcgtcgccgcggcccacgaaccagtagtacccgtccgcatcacgtttggcgacgtccccggtgaggtaccaccctccggcgaagcagctgcggtaccgctcctcttcgtggaggtagcccctgaacatcgatggccagccggcgcgcagggccagttcccccatggtgtccggctccgtgaccagcacaggttcactgtccacaatcaccgctttgccgttcccgtcccgctggaccagggctgcctccacgccgggcagcggcctgcccatggaaccgggccggatctcggtggcggcgaagttggcgatcatgatgccgccggtttcggtctgccaccagttgtcgtgcaccggctggccgaaggcttcccggccccagaccaccacttccgggttgagcggctcgcccacgctcgccacgaagcggagcgcggacaggtcatggcccgaggcgcggtccgcgccggccttcatgagcatccgcagggctgtgggcgcggtgtaccagaccgtaacgcgctgctccgccaggatccggtaccagcggtccgcgtccatctcctcctggtccaccaccgtggtgacgccgtgcaccagcggggcgatgacgccgtaggaggttccggtcacccagcctgggtctgcggtgcaccagtagacgtcctccgggtgcaggtccagggcgtacaggccggtggcgtaatgggcggtgacggcctcgtgcacatggatggcacctttcggggtgccggtggtgccgctggtgaaatggaggagggccatgtcctcgccctgggtggaggcaatcctggcgtcaccaggcgcggcctccatgagcccggcaaggtcaagggttcccggttccggctcaccgtcggcgtcgatcagcaggacgaacttgaggtccggcagcgcgtcccggatcctggccactttcttgcggtagagggcccttgtggtgaccagcagccgcccggatcccagctgcaggcgttgcctcacgggctccgggccgaaggcagaaaacagggggcagaagacgcttccgttcttgagggttcccagcaccgcaacatacaactccggagtccggcccatgagggaaaaaacgcgttccgtccggccaatcccgagctgcgccaggactgcggcaaagcggctggtctgctcggcgagttcccggtagctgagggaatgggtggacccgtctgcccggacaaaccgcagggcctcgtggcctgcgcgggggcctgcggcgtggcggtccacggcctcgtgcgcgatgttgaggcccccgccgggaagcccggacagcgcctggcgggcactgtcccaggaaaacgcacggcacacggagtggtaatccgccaggttgggctccacgggaaaggcctgagggtccttcgagatccgtggccagcgcgtgggttgtgtggtgcctgcggtcatgctccaatccgactcctgcaggccgggagtggcaagggtagaaagtcccccggggtgggcaggagggcgcgtgaaggcggggcgcggcgggccttttgaccctgttgcgcggtccggggcaggtgtctagtgaaagggtgttggccccgcgcccgtggctcttgcccgcgccggccggagcagaggagaagggtgcttggcatgactgaggtagtccggtacgaggtgggctccgggactgtcctggtggaagtggcggacaacagctacggcgtggagcacccggcaaggaacgaacaggggatcctggatgcgggccggcgcctggaggatgccctcgccgccgtccgccccgctgcggccgccgtcgtcgacgccatgcgtgaaatcgcacccgaacacatggaagtggaattcggcgtgaaactggcgggaaccgcgggggcggtcatcgcccggaacaccgcggacgggcacttcatcctgaggatgtcctggtcggcctccccggaggtcctgtccgaggaagagtaggccggcctgcaggaccgggggtccgggatgcagcagcacatgactgggagccacacgaggaggtggccggatgcatgaattccgggaccgggcggaagcgggccggaagctcgggctcgccctggccggcctgcgcgggaaggacgtggtggtcctggggctgccccggggcggtgttccggtagcggccgaggttgcgaaggccctggacgcccccttggacgtgatagttgtgcgcaaactgggggtgccgttccagccggaggtggccatgggtgccatcgcggaaggcggcgcccgggtattggaccggcgggtcgtttccgtcgccagggtcaccgaggatgatctccggacagttgaggcgcgcgagcgtgcgctgctggaatccaggctggaacggtaccgccggggacggcctcccacggacctcacgggacgtactgccgtcattgtggacgatggtatcgctaccggatcaacggcccgggtggcatgcaaagtggcgcggcagctgggcgcagaaagggtcatcctggccgtcccggtggccccggaacgggccatggactccctgccggaggcggaccaggtcctctccttggtctccccccgcaacttccaggccgttggctactattaccgcgacttttctcccaccgccgacgaggacgtggtccgcctgctcgacgccgcagcgcggcggaaccaccgtgaccgcctggaacagttgaccggcgtcgaccaggatgtccacatcgccgtggacggcgtgtcaatcaacggcgacctgcaccttcctgaccagtgcggtgcggtggtggtctttgcccacggcagcggcagcagccggcacagtccccgcaaccgctacgtggcttccgtcctccagggagcgggactgggcaccctgctgctggatctgctgactcccgcagaggaagtcaaccgtgacaacgtcttcgacatccccctgctggcacagcggctcagcgcagcaacccgctggctgaacggcagggaggacaccgcagcgtgccgggtgggctacttcggggccagtaccggagcaggcgctgcgctgtgggccgcggctgaacctggcgcgcacgtcgacgccgtggtttcccgtggcggcaggccggaccttgccgggccgcgcctcgcagcggtgcgtgcgcccaccctgctgctggtggggggtgccgacacccaggtccttgccctaaaccggcaggctatggaccggatgcgggcgccggtacacctggaaattatcccgggagccacccatctcttcgaggagcccggcacgctgggccaggtggcagctctggccagggaatggttctcgcgctacctggcgccggaggctgccgcggaaggggccccgggggtttcttaggccttcagctacgcgccggcaggcaccgctgcaggtttccggcccagctcggcggtccgcttcaccgaccaccagagcagcaccaccaggagcacgttgcgggtggtgaggatggctgccatcaccgggtgggcgtggatcagcggggtgtagaacagggggtagatcacgaacgtggtcatggcgatgcccatcagcagcgccgcggggaccttccaccggtcccagtcgtgcgtgagccctgcgatgatcaccggtgccagccagatgatgaactgcggggagcccaccttgttgaacactatgaacgcggtgaccatcatcagggagccctcaaggaacagttcctcccgttcggcgccacggttcagggcgcggaccagcaggacggcagcgatcacggccgcgaggatcagcagcggctgcatcaggaaagccgccacgctggcgccggggccgtagacctcggtggagttgatggcggtgttgtccgccatcttcgagcccgcaatgttgaagacgctcagccacacccacggcgtggagaaggtggcttccagctgcatgccgcgctcgccctggttggtgaggaagtccatgatgtgcggcagcccgccggacagccaggtgcccagggctacaaccactgtcaccgccaccccggaaaggactatgtggatccgcttccggctggcgatcacgatgggcaccaggacggccgccggccacaccttgatccaggtggcgatgctgagcaggacgccggccaccaccggccgctgcgccgcatacagcagggcgatgagcacgatgggcgcggtgatgccttcaacgcgggcgaagctgaggtagcccatgaagacagtgaagaacagccaccaccaggccggggcgatgccgcccgccttgcgcggtccgcgggtgaggaaggcgagtccgacggcgttgagggctgtgatgatcaggaaccacaccaggaggtacaggtccggcccggcgatattggccaggaagatggggatctgcgccagcacggggtatacccaggggctgatcttcccgtcgaggttcgcggggttgtagccgtccgtggcccactggcggtactgctccgtgtcgctgaacgtgtcgccgtgcaggaagaaggacgccatccagcccaggaagtacagatggacgacggcgaatccccaccacacgctggaagggcgggtgaaccagtccaccacctttgcgggcaggactttgctgcggacggtgaccagccggtcgaagaacctcgtggaaatcttaggactccttgagcgcgggggcggcagcgggcgccttcttgcccagcaggtagaggcgccggacgctccagaggaacaggaccaccaggaggacgttgcggatggtcagcaccagggccatccacggattgttgtggctgagggcgtcgtagaacagggggtagatgaagtacgtggccacggcaatgacgatcagcatggcggccgggacccgccaatcacgccagctgtgggcgaggccgacggcgacggccggggcgagccacaccatgaactgcggggaacccaccttgttaaacaccacgaacgcggtggccagggtcagggcaccgacgaggagcagctcggtgcggtcaacgccgccgttgagctggcccttgtgctgctttccgttgtgcagtgcccagaacgtcaggccggccaccagcagtgcggccaggatcaggaggggctgcatcagcactgacatcagtgcggtgccggggccgtccacctgcatggagttgatgtccgtgttcatgtacatgcgggagtcgccgatgttcaggacggacagccagagccagggcgtggtgaaggtggcctccagctgcatgccgcggtcaccctgctgggtgaggaagttcaaaagcttggggacgctgcccaccgcagcggccagcgcgactacccccgccgtcgtcgcaagtccggcgagcaccaccaggacgcggttttttacgacggcgaacagggccagcatgacggcggcgggccagaccttcacccaggtgccgatggcgagcaggacggaggcgatgaacgggcggccgacgccgtaggcaagggccaccaggaccagcggggcagttaggccgtccacgcgggcgaaccccagccagcccatgaggaaggtgaagaccagccaccaccagcctgctgggattgcctggcggtcccggccgcggttggtaagtttcagcagtgcccagccgttcaggactgtggtcatgaggacccacaggaaaaagaacggaccggggccggcgacgcccgcgatggccatggggatcagtgcaaggatcgggtagacccaggggctgggcccgccggtgaggtttgcgtcgttgaaccctgccatggcccagtcgcggtagatgaaggtatcgctgaaggcctcaccgcggagcgagagggaggctgcgaagaccaggaaaaccaggtgcaccacgatgaaaccgcccagcagcccgcggccggtgttgagccgggtccgggcgggcgcgggaaggatgacgttgcggatccgggtgagattgccgaagatagcgtccgtggaaatggcaggatccttgtcggttcgtggcacacgcaggttgccgcactggtggcttgggttctgccgtgtggccggtgttcagggtttcggagccgtccggaaacagcccccactctgttccaactctaattcacgcctctgggggccagtaattggcggggacgtggaaagcgacatccgcgcctgacctgctgcttttatctaaagttgctggcgtgtgaagcgtaggggagcatgtaccgcgaggcgccaaggtgccttacttcgcctgcagccttggggagcgcagggtgcgagttcccccaaccccgatccacgaaggcctgccccaaatgaactttccgttgacccttaccgttgccgaccgcgaaagcatggacagcgagctcgacgccgctgtcaccgccgcgaaagcccatgcactcgccggacggcggcacggcatcctggtcacccgtctcggcgtggacaagttcacggtggacctgagtgaggccgttcctttcggcttcacgcgcgaacaccaggcctggtaatacttccgggccggttcacgtaaccggcccttcagccgttcccggtgttggcgggactgcttcggcccccttccgctccgctgccgcaaaggctcgccgccagtgcgccctcaagggttagggaaccgtgaccttcaggtcgttccttcccggcgcaacgcccactactgtcgacagcaccatcggggacgacggaagaggcacgatgagcatcgacatcgaaattggtacaagcctcagcaatgaggacgcagcgcactttgcggccacaacggaagcaatcacctcagcgatgcagagggtgcgggaacggcacgcggcgtacagctgggtgtggacggacgagatccgctgccggggctgcaacgccagcatcgacataccgctgctcgccagcacgaacgtgagcgccgacaaagccttccaggcacatcagtccgcccagctcgacgccctcctggctgctggcggacatcagcgcggggaagcattcgaggcttcctgaatcaggggtcgttgccgcccatcggtgctgcaggtgcttgaatggcgggatggaaaaatggggaagcgcgcggccggcaccgaaactccgtaagggggaccgggtggctattctgtcaccgtcattcgctgctcccggctttgcccctgcggttcatgagcaggccatgaagcggtttgccgatgcaacaggcctggtgcccgtcgagttccctacaacccgtcagcttggcgcttccgctcaagaccgtgccgctgatctcaacgcggccttcgctgaccccaccatccgcgccatcctggcaaccataggcggtgatgaccagatcactgttattccgcatttggacgcggggctcgcccgggccgaccccaagattttcctcggctacagcgacaataccaacgtgctgaactggctctggttacacggtatcggcagtttctacggaggttccacccaggtgcacctcggtcccggtcccggcatcgacgacatccacctggcctcccttcgggctgccctgatggccggcggtgagctcacggtcaccgatcccggcgaatccgaggacttcggccgggactggcatgacccccaagccctcgtcgaatacggggaacgtgagcccaccgagctttgggcatgggccgggccggagcgggtggtgtcaggacggacctggggcggatgcctggaggtcattgaccagcttgcgttggcggaccgcctgccgcgggtagaggacctgcacgggtgcatcctgttgctggagaccagtgagctgatcccacctgccgactgggtgaagcggtgggttcgctcgctcggagagcggggcgtgctcgatgccgtccatggggttctcgtcgcccggccaccaaccagcaacttcgagtacaggccggagcccgtggaacgctcccgcctgcgggccgcccagcgggacgcagtgattgaggaggtcgcccggtacaacccggaggccgttgtctgcgtgggtgctcccttcggccatacccgcccgcagtggatcctcccgtacggcggcagcatcaccatgaacggaacagcccggaccatcagcgctctctacaactgagcgtccagttagcggtaccagcccaccgaacggtcgtaactggaaaccagcgctcccgtgcctgctgcgccttccccgcccgcggggaagtagatggccccaaactcggcgccctgggcttcgatccgtttctgtgcccaggccttggcgtcctcaatgtccttttccgggatgctttcgcgggtgttgcttccggcgctgagatggatgtccaactggtactccccgggctgggacgctccagcatgccggccaggatcccgctcatcgcgcctgctgaccatcacctgcgccaaggcatgaagaacggagggctccctggcggcactgccatgctgttgttgttccatccgcagcgctgaaaccacgctctccactgtgtcctcatcgctgaccacatacgaagctccggcgacgtccgcctccgagcccccaacgcttttcaagtactgcataaattgctcggagctggactgtgtggagttcatgcaccctccctgagggctattcgcggcgagtgccgactcgcccaacactagacccatatgggccgcccaggtccctgcccgggaaaatagtttgaggacggaaagtgcggtcaggccggctcttgctgcgtcgattggcggggttcgcgccgtgccccgttcccgcccgtcttcgacagggtgaagatcccatagcgcattgcaccgctgcggtaggccaggatcaggcgggggatgctcaggacgaagatgcggttgcgtgcgccaagggcgaggcggcgggtcccgcggtcgacgagcagggccttcgccagtcgacgggcgcagatcggccaggtgcgcgcgacgcggcggctgacatcctcatagccggtgatctcaaagccggccgccatggccatcgcctcatattcctcgcgcgtgcccatcgacggcaggcgcccttcgcggcagatgggctcgagcaggtggcggaccttccagccgctggcctcagtcccggcgagccacgcgcagacgaccaagcggccgcccggggacagcacgcggtgcgcctcggcgaagaacctgggtttgtccaccatatgctcgctcgactcgagggcccacgcggcactggccgaggcatcgggcagcccgttgacgagccagtcgcggagatggatgtcaacgtcgggtacaggatgcgcggcggcatagtgggcctgctcagcggaaagcgtgaaaccggtaacgctgaccctgcgtgtcaccgcgagccgccgtgcggtggagccatagccgcagccgatgtccaagcacgcctcgccgggcataaggcgcagccgatcgccgacggtgtcgaccagcgcctcgacggcctcggcgggcgtctcgcgacccgttgcccaaagcccgtggtggacatgctcaccccacacccggcgataaatcggatcgagctcgtcgtaatgatccgcgaccgccgcggcgttctgggaaatctcggggacgatcacgccatcacagtacaacgccggcagagcgtcaagccgctgaacatcaccggcgcgaccggatcgccggcgaacgccactgccttggtgtgaggcgggcctgttgggtcagcccaggcgctcgccggtcagaccggccaggtggtccaggagttcgttctggaaccgctcatcgcggacagcgggatgcggcttttcgcggtgctggtggtaccagtagccgccgctggtcagggcctccgggtcatcgctggcggccagccactcctgtgtgaggtggccgagccggaggtcgtccggggcgccggctccgcccatcctggtgggcacccagccgggatcaacggcgttgctgaggacgtccggccacaaacgcgcgacggcggctgccagggctgtgacgtagagcttgctgtccgaataggtcaccgtccgggcgcccgtaccgagggccgcgagcccggcgtggccgccgcggtgcatgccgctgctgacatatatcagccgccgcggacggtggatgagcgcggtgagaaggtagggggcggcgacgttgacctggaaaatctccgggccgtgaagcaccccggcgttgtggatgacggcgtccatctggcccagccggtttacctgctccgcgacaccgcggacctggtccatgtctgcaaagtcgccaacaacaccgtctgcaccgcggtccagcagatgctggacggaagccaggcgttccgcgctgcgggcatgcacaacgatgtggtgaccgttttccaagagcgtccgggctgtgtgccgtcccagcccgtctgcggagccggtgataaagatgcgcgccactgatcctccctaagttgtatacaagtatgcacctagcgctagggttgctgtggaggtaacaacatgcctggtgcaaccacccgcaataccggagcggatttcgtctatgccgagctgaagcggcagatcatcagcctggagctgaagccgggggagcgcgtttacgaacccgcaatggcgtctgcgctgcaggtgagccggacgccgctgagggaagccatccggcggctggtctcggagagcttcctggaacagcaaaccaccggcggcgtcctggtgccggccttggatgaggcagcaatttccgagctgtacgaagtccgcgctgcaatggaatccctcatggcgcggaacgcctgcctcaaagccaccctggctgacatcgacgcactcgaaggcatcctggagcgcaacgctgccatggtgggcttcgccgatgaagcgatgaagcaggggatgtcgctgcacgggaagatcgccgggatcgccggcaattcgtgggcccggcggttccatgaccagatctcaaaccagatggagcggtaccggcacttcaccaacagcacccaggaacggcgggagcaggccctagcccagcaccggaccctggtggcggccgtggctgcaggcgacccggaccaggctgcaaggatcgccttcgagcatgtcatgggcgcccgcgatgcggcggtgcgagccatctccggcaccactgcatgatcggcgaactgggccgccggtccactgcagccctcctggtccattccaccctgattcaggcactgaccttcctgctgcggccggccgccacgtaccgcgcgctggaactggacgtccccggcttcgcccttgggctcctggcggccagctacgccgtcttcccgctgctgctcgccgtccccacgggcgccctggtggaccgcctgggtgaacgccgcctcatggcggccggtgccgccgtcgtcctggccagcgctttgttcctgctgctgtggggttcgtccatcgccgccctgatcatcggaaccgccctcctgggcgtcggccagctggcctgtgtggtggggcaacaggcggtggtggccaacaacgccgcggcctcccggatggattcggccttcggctacctcaccttcgcggcgtccctgggacaggcagtagggccgctggccatctccctggtaggagggacggccatccgccccgacacccaggcgatcttcctcctctcggcctgcatgggcctggtgctcctggtgaccacctttggcatctcggcaactgtcagcgccaggaagggaacggcagccccggcgaacggcggcaaaggcaacgtggcctcgctgctgaagactcccggcgtggcgcgggccctggccaccagcgccaccgtccttgccgtggtggacctgaccatggtctacctcccggtgcttggatccgaacgcgggctcagcgcggcaaccgttggcgccctgctcgccgtccgtgccgtgttttccatggtgtcccggatcctgctggggcagatatcccggaaactggggcgcaagcgcctgctcgtggccagcctggcgctgtccaccagcgctttggccgccatggcggttcccatgccggtgctgctgctctttgcggtcatggccgtgcttggcctgggccttggcattggccagcccctcaccatgtcctggctttcggcgcaggcacccgccgggcagcgcggccgtgcgcttgccctccggctcgccggcaaccgggtgggccaggtggtgcttcccagcgttatcggtgtggcagcggcaggagttggcgcgatgggggttttcctggcgtccgcggccgcggtgggcgggacgctcctgctcctccggggcgtccggctggactgaccggcggacgccctcccgatctgcgtcacacagggcatgcttttggggcgcgtacgacgtcggagccccgggtttccggggcttccccaccccgggtgggccaaaagcgagccgtgcgtgacgccgtcgtgcgtcctccgggggtgccgcgcggttacggcagccggcttggcctcagcaaggtgggcacaccggcctgtttcggatccagcggaacggggctcatcagcaccgacgggccgcgatggagcgttccgcttgagagtgcccggcagcggatgccgccccggccccgcatcgaggcgtgggctcccggggcaagcacctcattcatccaggcgcaggggtgggcaggcctgccgccgtggaactcaacccgggaaccgccggattccagcgcgaagtcctggctgagcagcggggccaggtgggctccgcggaggatcacgttccgccgggtggccagcggatcgaacgggccggcgcccagctcggccgcgatggcctccagggattcgacggcgaacagggtcaccgcggcgtccatgtgggccgctttgccgaagaaacggtcgcccacgatgcccttgcccgccaccacctcggcaacatcggcatccgtcgtgggcacatctgcggcgccgtcccgtgcccggccgaagtaggcgtgcccgggcgacaccaggaggtgcaggatttcgacgtcgtacctgtactcctccgtcatgccgcgggggcaccgacgtacgcggccaggtgcttgccggtgagcgtcggggagccggccacaagctcggccggcgtgccctcgaaaacgatccggccgccgtcgtgccctgctcccgggccgaggtcgatgatccagtccgcgtgcgccatcacggcctggtggtgctcgatcacgatcacggacttgccggactcgaccagccggtccagcaggcccagcaggttctccacatcggccaggtgcaggccggtggtgggctcgtccaggacgtacacgtcgcccttctcggccatctgggtggcgagcttgagccgctggcgctcgccgccggaaagcgtggtgagcggctggccgaggctgaggtagcccaggccaacgtcctcgagccgcgccaggatggtccgcgcggccggcgttttggcctcaccctcggcaaagaaggccgcggcttcggtcacggacatggccaggacctcggcgatgttcttcccgcccaccgtgtattccagcacggcggcctggaagcggcggccctcgcagtcctcgcacggggactccacggtggccatcacgccgagctcggtgaaaatgacgcccgcaccgttgcaggtggggcaggcgccctcggagtttgagctgaacagtgccggcttcacgccgttgaccttggcgaacgtcttgcggatgggctccagcagcccggtgtaggtggcggggttgctgcggcgcgaaccgcggatggcaccctggtcgatcaccaccacgccttcgcgcttggccacggaaccgtggatgagggagctcttcccggagccggccaccccggtgacgacggtcaggacacccaggggaatatcgacgtcgacgtcctggagattgtgcgtcgaggcgccgcggacctcgagcactccggacgttttccggacggcctccttcagggccgcgcggtcctccaggtggtgcccggtggtggtgtcgctgcttcgcaggccctccacggtgccctcgtagcagacctcgccgccgttggtgccggccccgggaccgaggtcgacgacgtggtcagcgatggtgatcatctcaggtttgtgctccaccaccaggacggtgttgcctttgtcccgcagctggagcaggagctggttcatccgttcgatgtcgtgcggatggaggccgatggagggctcgtcgaagacgtacgtaacgtccgtgagcgaggagccgaggtgccggatcatcttggtgcgctgggcctcgccgccggacagggtgccggccggccggtccaggctgaggtatcccaggccgatgccggaaaaggagtcgagcaggtgctggaggcccttgagaaggggagccaccgaggggtccttgaggtcccggacccacacggcaaggtcgctgatctgcatctggcacagctcggcgatgttcatgccgttgatccgtgaggagagggcctgctgcgtcagccgggtccccttgcactcggggcaggtctggaacgtgacggcccgctccacgaaccggcggacgtgcggctgcatggcctcggggtccttggacagcatggacttctggatcttggggatgatcccctcgaaggtcaggttgacgccctccaccttgatcttggtgggctccgcgtagagcatggtgtccagctgcttgctggtgaatttggcgatgggtttgtccatcgggaggcccatgccctcgaacaggcgcccgtaccacccgtccatggagtaccccggaactgtcagcgctccctcgttaagcgacttggcgtcgtcgtacagtgctgtgcggtcaatgtcgctgacgttgcccatgccctcgcagcgcgggcacatgccgccgaggtagacggcgtggttgaccaccgacttctccacccgaccgcccttgtccgtggacatgacgccgctggccttgcgggtggggacgttgaaggagaacgccgtgggcgggccggcgtacggggtgcccagccggctgaagaggatgcggagcatgacgttggcatccgttgcggtgcccacagtggaccgcgggttggcgcccatgcgttcctggtcaacgatgatcgcggtcgtcaggccttccaggaagtccacctcggggcgggccaggttcggcatgaagccctggacaaacgcactgtaggtctcgttgatcatccgctgcgactctgcggcgatggtggcgaacaccagcgagctcttgcccgaaccggaaaccccggtgaacacggtcagccggcgcttgggcagctccacgctgatgttcttcaggttgttttcccgcgcgccctgcacgcggatgaggtcgtgggtgtccgcgacgtgcagcccgttggcctgggtagtggtgccggtgtccgtgctcatcgggtctccatctgttgggctgcgctatctgttgggctgcgctgaacggaagctgcgtgcccagccgccggccgccgtcgttggtatcagcctaggcctgctggttgatccgtacggtgttcccggcggggtcgcggaaggcgcagtcgcggattccgtagggctggtccaccggttcctgcacgacgtcggccccgctcgcctccacctgggcgaaggctgcgtcgacgtccggggcggagaggatcacggtggcgtaggtgcccttggccatcatttcggcgatggtgcggcgctcgtcgtcggtgatgcccgggtccacggccggcgggtgcaggacgatggaaacgccgggctgcccggcggggcccaccgtgatccagcgcatggcgccgcggcccacatcgttgcggacctcgaagcccagggcgtcgcggtagaacgccagggaagcgtcgggatcggtgtgcggaaggaacgttgaggagatggtgatgttgttcatggcagtcatgctagttgcggctccggaaccggcgcttctcgattcctgaccggtctggtgacctgcttcgccacgcacgcggggatgcccgccgtcgcgctctttgcctcctgcttgtagacgctgggcggcatgcccaccagctcactgaagcgggtgctgaaggtgcccagcgaggaacagccgacggcgaaacacacctccgtgacggaaaggtcaccccggctcagcaacgccatggcccgttcgatgcgccgggtcatcaggtagctgtagggcgattcctgataggcggccttgaaccggcggctgaggtggccggcggacatatggacaccgcgggccagggcttcgacatccaggggctgcgcatactcccgatcgatccggtccttgacccggcgcaggagcatcagctcgcgcaggtaggggtcggcagcggggctgatagtcacctttcagatggtgctccctggcgggggagttgtccatacttttgaaggcgcagttgctgcgtaaaaggcccccttttcgcggggtatgattatgccgccagccggcatgaggtcctcgcccgaacagggctcgagtcaacgcagtgttgggtgatgtccgctcatggagcagtggcatccggcgaaaccaaacccttttcatcactgtcaaagaccctgcccggatactgcgcgggcagcaccctgaaaggaccccatggaactgctgtgggaaaccgccggctgggccggcgcggctgcgattctcagcgcatacctggccgtttccatgggctggctgaaggccggcaagggcttccagaccgcaaatcttgttggtgccgtcgcgttcatcatcaacggcaccttccacggagcctggccttccgtggtgacgaatgtggcctgggtcctcatctccgccgtcgcgcttatccggatgcgtcctgagagcattccgacggcggtggccgccgatccgcaggtccagttcccgggcgtccccgacaccacgggccagatgaccgtcatcgaggttctcaccggctccctgccagcggtagggtccatgactgccggggctgacgggcagcgcctggcgcactgaaggcctccgccggtcatccgcaaggtggctggcgctacgcgttcctggttgcgggccgccggtaaacacgcagtccgtcactgtgcaggaacagtgcgcggccctttccctcgtcctgctgaagccagaggaggctgccatccagggcgagcatatcgatgcgtcctgatgcgatgggccgcccttgacggtggatttccacctggtcgcttcgcgagagtttgcaccagttgggaaccggctcgggagcgaggggtgcggcaccccgtccggcaggctgcgggcggttgtacacggtggtctcattctccttggtcgaggcttcgtccatgccggactgctttaggaaagttcatgggaggaggcagggtgaccggtggtcaccctgcctcccttgcgtgctgtggcgtccccgcgcccgtccttcgggctacctgttgcgatggagtgcgggaacggcagcacgcgggccggacaagaagtccggcagttagtgggctccggtcagagtttgtcggagcggaccgcgagcaccgggcaggtggcgtcgaggaggatcctctggacggtgcttccgaggatgagctttcccaccatggaccggtgccggaggccgataacgatcatgtcgacgttgcggtcctgggcgatctggatgacagcgtcccccgggtcggacaggaccgaggattcgatggtcagggccaggccggcctcgcccagccgggcttccagcacgctcacttcctgtggctccagatcgtggtggccgcggccgatattcacgatcagcaggtctgacttcctgaggtgcgcttccttgattccttctgacagggcttccctgccttctgaagcaggtgcgtaggcgacgagtaccgtcatttcatatctccaatggccaaagtgtgtggcggacgtctaaacgagggtgttgagccagccctgcggcaggtcgatcggcagcagtgacgggagtgcgaggagcactatgtacaggacgccggtgtagatgatggctaccttgagccgggcccttgcgactatcaggaggaaggccgggatgaagatcgtgactgcaatcaggtatccgaaggcggccgtgagagccaggaagcctgtcatccataggaaggtcttcaatgcgaactttgcgtcaagggtccaacctgccttcgcgggctgtgtgcggatcccctctgtctcctcagcaagggtttcatctgccttcggggttctgtcgtgaagccttctccggatctcaatgaagagcaggatgccggagaagatcaggcctccggtgctcaccagctgcgggaccagtctggcttccggtgagaatgaagcggacgagattagggctgcggcgaaggcgacggcgaagatgcccgctgcgacgagggaccagttggagttcttcagcggtgcttcgtcgtcctcgggctgttcgtcccggtggccatcgtcaaggttggtgtgtcggcgggcgcggatgaacttgatgaaggcccagatcataggcaggatcaggatggccaggaagaccatgaccccggggcgggccatccagtcgaatccttcgtagaggctgtcggtgaggaagtagtagcgttccagcgggatggccaggacgaaaccgataaggaacggtgcccgggggaaccctgtcgatttcagcagccagccgaagatgccgaggatgatcatgatccagaggtcgccgagctggccgccttcctggaaggagcccaggagcatgatggctacgaggcctgctgccaggatggcgaaggggacctttgtcagcttggcgagctgcttgacactcaggaagcaaagcagtgcgccgagaacggacgcgatggcgaaggaccagacgataaggtacatcaggtcgaggtgttcggtgatgatggaggggcctggctggatgccgtaggtgaggagcattcccaggagcatcgctgaggggacgccgccggggatgccaaagaggagggtggggatcaggtcgccggcttccacggagttgttggcgctttcggggccgacaatgccgcgggggtctcccttgccgaactggcgcttgtctttggcggttgcgacggcctggccgtaggccatccaggttccggcggtggcaccgacgccgggaaggacgcctgcccagataccgatgagcgctccgcggatgacctgggtccagtgggtgagccattcgcggatgccctggccccagccgccgccgaggctgatggtttgcttttctccgcggcgctggctggcgcgggatgcgatttcggccaggccgaagatgcccagggccacggccacgagtgacaggccgtcgccgaggaagagactgccgaaggtgaagcgttcctcagcagtggtcggcgaggttccaaccatgccgaggatcaggccaaggaggcctgccgagacgcccttgatgatgtttccccgtgacaggaccgccgccaaagatacaccgaggacggtcaacatgaagagctcaggactcgcgaaggacaggacgagtggccgggccagcgggatcgcgagggtcaggccgaccgcgccgatgatgcctccggccatggaggagaggaacgccagggtcagcgcgcgggctgcctgccccttcttggccatggagtagccgtcgagcatggtgacgctggctgatgctgaacctggggctccgagcagtacggcggagacggtgtcggaggtgtgaacgacggcgagggcgccgatgaggagcgccagagcctggggcggttccatgccgaaggtgatgggcagcaggattgcaacggctcctgtgccgccaagtcccgggatgaggcccatgatcaggccggcgacggtgccgatcaggagcatgatgaggagggaggggtcagcgagggatgccagcgctgccattgcggagtcaagcatgatggtccttattcaacgtggatgttgtatttgtccgcgagcagtcccgtgacgtaggaccggacggagctgctgacggtgtaggcctcgcggacccgttcggccacgccggaatcggccaccaggggatatccaccgagtactttggcggccttctcctggaacgccggatccgtgccgagcttttcgctggactcgcgcagcaattggtacgccttctcgggggtctcttgcggaacccagagccccttttggtaggtataggtgagcccgagcagggttttgtaggcctcgtacttttcgcctgagggctttgttccgtgcagcgtctcgtaggcctccgcaaccgtgggaacgtccggaaagtttgggtcacggactacttcccctgcctcgtccagctggccgaacgacatcaggacaacggctttgccttccttggcgatgccttcgactgccgagccgtaggccgaggtcgtctggtagtccagatcgatttcgccacgctggagggccaggttgacgggtccgcggccttcgaagccaaaggtgctcgtgacgtctgcctcgagcaggtcgaaagccaccagggtggtgatgtccaggcccgtagcactgatgccgccaaatactagcggggtgtccctgttgatcaggtcctgcacgctggccacgccggcttcagcccgggcgtagatgacgccgccggttccattgacgacgaccggcttgaggtcttcgaaggagtacttcaccgctgagcgtcccaggacccagggcacaaccgtcgatgcggtgcctaccaggatctcagtcccgtcagtcttggcggagcgggcgaaccggttggtcccgaggatgccttcaccgccggcttcgttgacgggggcgaagccggggcggccggccacgtagttcgtcagttccgtgccgatgaaacgtgcccacgtatccgttcctccgccggacgccaacggaatgaggaattcgagggtctcgccgctgaaatcgccgtcttcagtgctggagggcgggttcagcaggcttccacccagcactgttgtggccgttccgagcagcgcgaaggctcctaccgtggcaaggatagtgcggcgcgagtgcttgggcggctcgggctgctccgtctgctctgcctgtccggcagtgccgtccggagagactccgggcggctccaaggatgacttgttgctcgtcattgaggaatcctttggggtcagtgcctaccaccatgaaacaccggtttggcgcagctgggaggggaggctgttgtgggtggtcgtttaccaggtctgtggaaggagcagttctgcgtcggcgatgcggcgggcgctgcgaagggtgccgacgacggggacgccgtcacgtacttcagcccatgtctgcacgaggcccgccggtgtccgcatggtcaggcctgctgaaggatctgtggagagcaggtcccggaccaccgtgccctcatgctgggcggccatggtcagggccacgcttccggtgatcgcgagggcggggtgaagtttgcccatggacagcattcggacaacgaggtcagcctcgtcgtcgggcgatgccctggctacgatcgcgagcttggggatggcccgctcagcttcggcccggctggcggcaaggcccatgcggacggccgcatccctgcgcacgtcatcgaggtgcaccagcaacgccgcctggctgtcgatgtccaccgcggtttcgtggccggtgagcccgatggacgcggcgtcgaggatgatcagcggggcgccggcgtcaatgagcgtggcgggaacctgccggccgtcgaacgtgactttgtccaggggctctccggtgggaaacagcttcccggtggtgcgccctgcaggatcaaggaaacccatgcccaccgaaagtccggggaaagggacacccgggatcacttgggttccgggatcctggagctcgccgccgggggtggggaccttctgcaggatgagctgatcggtgttggtgttcagcgtcctgaccgatgtgctttcctggccgggttctacccagccccgttcgatggcgtacggggctaccactgccgagcagttgccgcagttgcttccccagtccactttctgttcatcgatggacacctgggcgaacgtgtagtcgacgtctgcttcctcgccgacggagcgggacaggatgacggctttgcttgttgtggacgtcccgccgcccactccatccacctggcggtggtcggggctgccaaagaggcggaggagaacttcgtccacgctctttccggggacctggaggttgtcccattcgaagacccagcacttgctggttccgccccgcatccacactgctgggatcttaaacatgattgcccttcacatcttttgggcccttctttgggccatttagccttaccggctttcacaagtgtgatccgagcctcggatgaattacaaacgccaaattctgcaccgccatgcactttttcttcaatcaaaagaccgtctgacgcgtctttttgtgctcctccgcggggcactgtcatgacctgccctcagcaggccgttattttccgccccttgtgaagcaccggattagaatagtgaggggtatagaacaaacacttcaatcggaaggccgccatgttgaacgtccgcaggctcgaactgctgcttgatgtcgttgagctcgggtcaatcaccgctgcggcggagaagcacgtgtactcgccgtccggggtctcccagcagctgaggcgcctggaagccgaaatcgggcagcccctcctgcagaggcagacgcgcggcatggtccccacggatgccggacacgtcctggccgcccatacgcgccgcatcctccggcagatggcagcggccgaggcggatcttgcggagatcgcgggccttaatcggggcagcctcaccatgggaaccttccccactttgggtggttccttcctccccgtcgtcatcagcaggttcaagaaggagtacccggccatcgagctgcatgtccgcagcagccggttcgaggacctgattgagatgctggagaacggccaggtgggcatgtccctgctgtgggactacgaatggaaccggatgaattcggaggactttgcgctgaccactgtgttcgaagacgcaacagcgttgatcgtcggcaaggaccaccgcctggcccgccggaagcaggtcgacatggcggacctggcggacgaggaatggatcgtccgcggccaggaacacccggtagtcgaggtcctgcagcgcagtgccagcgctgcaggatttacgccgcggatcgccttccatgccaatgactaccaggaagcccaggccatggtgagtgttggcctgggcatcgcgctggcgccccgcaccgccgtcgtcaataaacaccccggcgtgagcatcgtgtcgctcggctcgtcggccccatcacggcgggtcctgctggcgcaccgccatgacagggtccgtgctgctgccgagattgccttccagacgacgctcctggaggtcgctaaggatgcaacggctgatttccgctgagtccgcccgggtgccgcgccgaagaagatcgtccatatagttgcacttttctgccatgggcagccgtggcgtttgtccatagcctgaaggggtgacggacgccaaccacttcaagagccagattcatttgcccgatgcgccgccggaccagcgggctgtcctggaggccggcggcgttgcctgctggagcgagccggtgtccatcgatacctacgcgcccggcgtgccggaccggtacccgatgtacctggaccgccgggtgtaccaggggtccagcggcaaggtctacccgatgccgttcattgacagcatcgccggctcgaaggaaccccggctctggcaggcgatccatctggagaacgaatacctgaggctcatgctgctgccggagatcgggggccgcatccacatcggcttcgacaagacggccgggtacgacttcttctaccggaacaacgtgatcaagccgggcctggtgggactggcggggccgtggatctcaggtggcgtggagttcaactggccccagcaccaccgcccggcaacgttccttcccgtggaaacatccatcgaacgcggcgctgacggggccgtggtggtgtggcacagcgacctcgatccgctgcaacggatgcgggggacccacggggtccggctccgcccgggctgttcgctgatcgaggtggaggcccggctctacaactgcacggatgtgccgcagaccttcctctggtgggcgaacgccgcggcccgcgtccacgacaagtaccagtctttcttcccggccgatgtccgctacgtggccgaccatgcccgccgggccgtcacagctttcccccgcgcggaccgcccctactacggcgtggactatcccgccctagcacgggaaggccatccggatgcggaccgcatcgacttctatgccaacattccggtccccacctcctacatggtcaccgacaccaaggacagcttcttcggcggctacgaccatgaggccggtgccggcttcgtccactgggccgaccgcagtatttccccggggaagaagcagtggacctggggcaacggaccggtgggcaaggcgtgggacgcacacttaacggacgacgacggcccttacgttgagctgatgtccggcgtcttcacggacaaccagccagacttcagctacctcgcccccggggagacccgcaccttcagcgagtactggtacccgatccgccggatgggcccggcgcaccaggcgaaccttgaggtcgccgtctcactccaactggacgaagcggggcgcacggccgcagtgggagtctccagcacagcggaccgtgccaatgccacggtggtgcttgaacaccatgggcaggccatccggtcctggaacgcccggatctccccggcccaccccttcaccgaaatctgtgagcttgacgggcgggcagaggacgccgacctcaccctctgggtccttgatggggaagaagagctgttgtcatggtcccccgcccggtccggcgataccccggaggagcctagggtggccaccgagcccgggcagcccgccggcatcgaaagccaggacgagctctacgtcaccggaacacacctggcccagaaccggcaccccaccaggtcgcccctgccctacttcgaagagatgctccggcgggatccccaggattcacgcgcagcgatcgcgctgggcgctgcgaaatacgccgccggccagtatggggaggcgcggaggctgctggaaaacgcgctggaccggctgacccgccgcaacctgaatccgcccaccggcgaggccagctaccggctcggcctggtgctggagcgtaccgggcaaccggagaaggccgccgaacattttgcgaaggccgcctgggacagggcctgggcgcatccggcccgtcttgcactggcccgcctggccctccggtcggggcggtccgccgaagccctccgccaggccgaagcggcgctgggcctggacccggccagccctgcggccaagcatctgctctaccttgcactaagccgggcggggcgccaggatgaggccgcccgccagctccgactcatcctcaccgccgacccgctggaccccatggccctggcgctgaacggggccctggacgtttccgatcccaagacatcgctgaccgtggcgtgccggctggccggcgcgggccagtggcagcgtgccctggacctgacggagcagccggcccggtccggcgacaaggggttcggcaacccggagccgctccgccgctacctccgggcatgctggctggacgagctactggaccccgaagccgcctcgcgggaacgcgcggccgcccggcacagcgacactacctatgccttcccccacggcctcgaccactacgacgccctgcagcgcgcgcttcaggcttatcccaaagacgcggtggcccacgggctgctggggtgctggctgctggacagcggccgaacccaggaagcgcttgcccagctgcaggcctccatggccaacgcgtcggaggaccccgtggtctggcggaacgccgcgatcgccaccgtcaacaccggcggggacgcggcatccgcggactcctacttggggcgggccctggagctcagtccggatgatgcccggctggtgttcgagcgtgccgtcctggccggcctcccgggcgcgccagtccaggagtgcatcgacgccgttgaacggcacggccccgctgtgttccaccgcgacgacctgaccctcctctatgccaacctgctggttgacgccggccggtcggacgaggccctgggcatcctgaccacccgcagcttccagccgttcgaggggggcgaaggactgaccctggcggcctatgaccgcgcgtccgtggaggttgcacgcgggcttaccgagcagagtccgacggcggccgtcgccctcctgcgaaaaggcatcgacgcgccgccgaacctgggcgaagggcggcaccctgccgggagcctggccgagcggctcgtggcactgggggacgccctcagccaggcaggggacgctgaagcggcagccgaggcctggaacgacgcctgccgggaaggcaccccgcttgccaccgggccagctccggcgggacccgccgactactggaaaggcattgcctgcagcaggctgggcaggaacgctgacgccgaacggatctggcaacaactcgacgcccgggccgatgaactggaaaccgcccccgcagtgcctgactactttgcaacatccctgcccgaactcctgctcttcgacaccgacacggcaggagcccgcctcgaaacagcggcactcctgcgcgcactggccgcagagggccgctcccacctcacagaaaaggcaaactcttgaccgacgcaccgagatacctcggctccggaaccatggatcgcgacactgaagccgcatccctgacgggcgcaccgccgtcgcaccttccctcccggctgaccatcaccctatgggacttctcctggtacacgcgggcggaagaaggcggcccgtacgccagcttggacgctgcgtgcgcgaaggctgcgcagctggggtacaacaccatccgcatctgcgccgcgccgctgctcctcttcggcgcgctcggcctcgacgatctggccgctgacctggagatcgaggggctcggaaccgcaccggacggcggcttctacggccgcggcacgcgctggtatgacgctcccggcggctaccggctcaacctgcgggagcggctgctggaactcttcgacgccgccgcccgccacggcctggtggtgatcctcgccagctgggagtaccagcagtcgccggcctttgcccgttccccgcggtggttcgaggcgatcgatgccgtcccgctgcaggacaggtaccgggcgctcgcggacgcgtgggaccggctcatcggggcgctgacaactgcggggcaccgggaccggatcgccatggtggagctgcataacgaggtggacttctccatcctgcccgcgctcgcggagggcggcgccgaacagctggagcgcctgcgggaacgccatcccgaccttctggtcacggcaagctatggcaaacccccgcacctggcaatgcacaccgtcccggacgggctgggagcagcccagttccacgtctacagctacggcgtgctggatgccctccagcagcagatcgatatcaggtccgacggcgccgccggctttcccaacccggcttttcccaaccctgccctggccgccctgctgcggcctgacgcaccctttgtcgaagaatacgggcggctggccgactggaaataccgggcaacggtggtgacagaccagatgttctacgggtacgactggattgatccggatgcgtgggacacctggctgtacaacaggtttggtgagtacagggaggtcatgcggcgggagatcgagtcccgtgtcatcgccatcgcagcctgggcgcgctggaagaacgtccctgccgtcgtcggtgaagggtggattggttacacgccccttcacggtactttcgaggaggggcccatagggcgcgacctggctgaacgcggcatcagggcggcgctggatcacggagtctgggggatggtcctgtgttccaacgccgcgccgcaccaccccatgtgggccgacgaagcgtggcaactccgcatgaaccgccgcatcctcaacgcacccaccagctgaaagaacctccatgtcaatcgaacaagggacccttggggtgcccaacaccggaatgctcagcgccgggatgctcagcgccgcccaccggccgcacgacctggcactgcagttgccgcccatgagcaacaccgaggaccgccacaatagttggcggctcaccagccattacatagagtgcgacggcgtccctgcggtgccggtctcaggggagctgcatttcagccgcctgccccggttccgctgggaggagcggctgcggctgatgaaggccggcggcatcaccgtggtggcgtgctacatcttctggatccatcacgagccggccgagggcgaggcacgctttgacggcaacctggacgtggctgcgttcgtccggctctgcgctgacgttggcctggacgtggtgctgcggctgggcccctggtgccacggcgaggtccgcaacggcggcttcccggactgggtgcaggccgcgccggtggcacaccggacgaaccaccccgcctatctggccatggtggagcgctggttcaaccgcgtcggcagggaactggacggcctcaccggcccggacagcaatgtcattggcatccagctggaaaatgagctctacgaccagctccggcacatcacagagctcaagaaactggccagggcggcaggcatgggcgcacccgtctggacggcaacagcctggggcgcggccgacatcccggaggatgacgtcatgccggtcttcggtggctacggggacggtttctgggttgatgccgacgccccgtgggaccccaccttccgggagcactacttcttcagccacgagtgggatgacccggggatcggtgcggatctgcgtgaacacttctcgggcagcggcgcggcaccgtcccgatccccgtccacgctctatccgccggcaacgtgcgaactcaccggcggcatggcaacggcctaccaacggcggccgtggcccagcggcaaggatgttgccgcggtggccaacaccaagatcggcagcggctccggatggcagggctattacatgttcaccggcggaattaatccgcccggcggcctccaggaatcccaggcaacgggctaccccaatgatctgccggtttttgactacgatttccacgcccccatcggtgccgccggaaggctggcgcccagcttcgcggaactgcgcaagcagcacgcgttcctggcagctttcggtgcccggctcgcgccgatgccgaccaccctgccggacaatcttccgtcaggcattgatgacgcggccacgctccgctgggccatgcgctcggacggccgttccggcttcctgttcatcacctggcaccagccgcacatccccctgccggactacccgggagcccagttcacgctggccctggatggggaagcactcacctttccgcgtgagggcctcaccattccagccggaaccatcgcgcgctggcccgtcaatctggacgttgcaggtgtttgccttcgctgggcgacggcgtcggccttgacactgctggacccggacggtgcgcccacgctggtcctcgctgccgaggaaggtattgtgccgcagctgtgcctgccggaaggaaccgttgtggatgggccggccaccgcgctgggcgagggcgtgtacgccgttgacggcggcggtccggtcacgttgacggcgagctcggacgcaggctctttggccattcttgtcctgccctcccatctggccggccaggcgtgggctttggaaacaccgcaggggcggcagctggtcctgtccgcaggcccgctctgggttggtgcggatggccgcctggccggcaggtcgcagggagaacccgccgtgcggcgctactccaccgcgaccggcctgttcgaggacgtgcggacaggcactccggcgccggactcccgcaaccaagcggtgcgtacagaactgatccgcgccgggaagcccgtcccggcgtccttcggctccctggcgggccgcgctgccgcgcccgcggaggcggacatcgacgaactggcagctgtttatgcgctggatgtggcgggggcggagctggccggggaccatacggagctggaggttgcctgggccggggacgtggcccgcctggtggttgacgggactgtggtgggggacaggttctgggatggttccccctggattatcgaaaccaatgacgccgggatacgcccgggctcggacgtgcggcttgagatcctgccgctcgccaaggaagcccaggtggggctgccggccgaggcgcagcgacggcgggacacggcttccggtgacctggtttcgctggacagcctgcagttcctccagtgggcaaggtggacggaggagcccgcctaagctgccgcgttgtgccatagcatggacacttcgtggcggaaggagtgcggggtggagcgggcaacagggttccccaaccagcgcctggtggtggttccccggcccctggtccgggaggcgctgaatcgtcccatcacgcggcggctgatggtcaccgacgccggcgtttttcccgcggcggaggagcatgggcggtaccggcctcagggcgccgaggaaaccatcgtcatcctctgcgtcgcgggggcggggtgggtggaaaccggcggtgcgcggtacgacgtcggcaaggcaaccgccgtcgtacttcccggcagcaccggtgaggcgcatgcctacggtgcctccgccggggacccctggaccatctggtggtgccacgtccttggctccgatgctgccgagctcgttgaagaatccggggttcgcgccggccggcccatcatcccgctggtggcggtggaccggctgacggccatgctggacgagatcattactgccctggaggaggaccagtcgccggcccgtctggtggccacggccgggatggcttggaagctgctggccaccctggcggtggaccgccgcctcccggagcagggaacgccgctgcagcaggcgatgaagttcctcgaggaccgggtggacggcgccatccgcctgccggacctggccagggtggtgggtgtttcgccgtcgcatttgagcaagctgttccgggaggcgacgggcgggggagtgctggcccaccacacggccctgaagatggcacgggccaggctcctgctcgacacaacagacctgacgattgcggaggtgggccgggaaatcgggctgaacgaccagttctatttctcccgccagttccgccgtctgcacggggtaagccccagcgcgtaccgggcggaccggaagggctgaggcgctgggggagtggcttccgggcggcattccggttcaggcctggtgtagcggacgggccgctccagacccggcgagattagtgtcaggctaagacctgaggccttccgcaggggtatccggaatgcgggcgcagggtcctaatctgacgtttcatcgggccaaacctgacgtcaggttggggtgttcttctgctggacagattgatcggctcatggctcttgtgatttgcggggataaatggggtcttttgcggccgctatttgtcgcctccggatgaaccgcggaaggagccgggtgagtcctggagggtcccaccgtcgcgccaggcagtgttcccaaggaatagcttcttggatgccggagccgtcagctttaccaccaaccagtggggggaaacggctgctcggacgagctcgacggaagccgattgcacgccgtccagggctcgaaaaaagaggggtatacccttcctccgcggaagtcctaatctgttgctgtgggcgagactcttcccgcccattccagccttatggcaaaacaatggaaaacctggccatgcgtcctgaaaagggatcaggcaccgttggggcgctgtcggcttggggaggagaatgcgatggaaactcgtgtggaaccaagtgcactttggggaaggatcggtgcgattgcgattcccctcggcgtgattttgttggtggctgccacggcggtgcacccgtccagggaagacgtcatgaaccatacggccgtcttcacggagtatgccgagaccgacgcgtggattgccatccacttcacacagtgggtcgctgccctggtgttcttcggcggcctcgtcgccctgtactatgccattacttccaagcgggagcggcccggtgtcctggcgcgctttggcttggccgcggtggtgctgaccgcggcggccatcacgacactgcaggcggtggacggcattgcgctgaagtgggcggtagatgcctgggtggctgcgcccgcggagcaggagcctgcggcattgtccgccgccatggggttgaggtggtctgagtacgcgctgcagagctattccaatatcctgctggggctcacgctgatcttctttggcctggccatcgcctacggctacgcgtacgcccgctggccgggatggctggcagcggcctcggggatcgcctggatcgtccatgggctgatggtgtcctacgtgggtctattcgactcggcaccccggctggttgcactggttctcttggccacctgggcgtttgtcatggcctttcaaatgtggcccaggagccacggccgcaccatccgctcaactgcaccgacgggtccagccaccgtgtaggtcggggcgcgggaactctcgaaccgtgccggaatcacggctgcatatccgcacagaacgcctgatcctgcgccgtttcgaggccgacgacctcgacgccttccacggctaccgcttccaggtcaccgtccgagctgggaagaacccggcctcgcgacggcgatgttgcttggtcgtctttcgtggttgtttgaccgtctactcccggtggtcaagcgccaatgaaaaaagattccgtcaacctgccagacgaggtaaacccttgcttcctgatggcacggacggaactgatccgtcaatggcaggggtgaattcaggttatccacgggtgagaattgggagccgttggggaactccctggcagcagtagcggtggataacctatgggaattgtccccggctgtgggtgggcggacctcacttctctttcgagagtagatcaattccgttgttcctaaagcagcgagggaccctgtgtcagctttgggtgtacttgagctgacgtaacaaggcgcccggggcgtcggactagaaactcatctttcgctctgatcaataccaaacggtactgcgagacgctcttggctcgatttcgtcagaatttgatcgaccagtgcttcgatgccgccttcagaggtcacagtcattccggcttcggctgtctccagggcctcaagtgtctccagctgtgaggtgagaagagaaggaggcatgaagtgtcctgggcgctggaccagccgctccatcagtaccgaagggtcaacctttaagaggatgaactgggtggagggagcggcggcgcggatcgcgtcgcggtatgcgcgtttgagggccgaacaggcaaccacgatcccgtgggggtgttcggccgcgagttctgagccgaccaggcgaagccagggccatctgtcttcatcggtgagcggtacgccagccgtcatcttttcgacgttcggcaaggggtgcaggtcatcagcgtctttgaaggtggctccgagccgggcagcgagggcagctccgaccgtagtcttgcccgatcccgacacgcccatgacgacgatgggactatgcactacagcgctccctgttgtgctgttcctgcggggagcggaaccatccgggtcacttcgacaggcttttccagcaggccttcgagggaagcgttcaggcgtttgaccggttcaccttgaccgtgggcatcgagcagcgcagctgattcccatttctcgatcatgaaaatctggttgtttggggcttcgtggatcgcgtagagcaggcagccgggttcctggtgtacttcgctgattgcgggggagagagcggcgacgacctggtcgaaggcgccttccttcgggctgaaagcagcggtgacgacgacggtcatggtgagttctccttgctttgtgggtgcccctgaggggcgtgggagggtccctggggacgcgtcgcggaccgacggctaacgcccgccggtccgcgacggacatccacagggtgtacttcggacttagccgcgagcgacgaggttttcctcaagggcaagggcttcggtttcacgacgcagttcgagggcctgggcgagcgagtcgtccatgatgacgtcttcccagcggacgatcccgcccttggctacgtcattgcgcagttccacgtggtgggccagagcgaccggcagtgcaccggtagtgacggagtgcttcgcggaaacgagttggccccagacggtgtatccgccttcgccgtcaaggaattcaccggctttgaggtccttcttggcggtggcgacaacgtcgccgaagaacccgatgggtgaacccgtggggattccgcggaggacggcgttggcgatggatacgttcagttccaggccaacgtagtggtacgggcggtagagggcggcgtactggccggtggggtccgggtgccaggggtattcgttgaagcaaccggagacgtaggcgttggttgccttcacgacgacgaagacgccttcctgggtgttgtgggggatccaggtgccgtcacggttaacactggacatgacgtcgacggtcccttcgtgtgcgagggctcctccgacgtcggcgggccggcagattgaggcaatttcctcaacgtctcccggcgtgaacgtcagcccggtgtcagaggggaccagtcccgccccgttggccactgcagccatctcgatggcggccttggtgccgtcgcggaaggaggtatgcatgttggggttcagctgcccggagtcggtgagttccttggagaattcccagttttcccagacgttgtcggggttcatctcgtggtaatgctcaaggaatttggcgcccttgccggcgcagacgacgtcgaatccgctggtgcgggcccagtcgacaagttccatgatgagggccggctggtcgccgtatgccattgagtagacaacaccggctgcttctgcccgcttggcaagagcgggccctgccaaagcgtcggcttcaaccgtgaccatgatgatgtgctttttcgtttcgatggcgcgcaacgcgtgcttgacgccaacgatggggtttccggtggcttccacgatgatgtcgatgtcgacgtcgaaaagctcgtcagcattggccacgatcgccgttgagcggtccctcagggcggttgctatgtcgggcgcgatctggtctttgggccatccaacgagttcaaaagcaccttcagcgcgcttgacgttgatgtctgcgatggcgacgacgtggatgcccgggatgttgtttgcctgggccaggtacatcgtcccgtagcgtccggccccgatcaggccgacccggatgggctttccgtcggcctcgcgctgggtcaggagatggtgcagattcatgggttgcctttcaagggatacggcgctgttccggaagggatgcgggctggtctgggatcaaccgcagcttttggggctcttacttttcaccttgcgtctcgccgcaattggtagtgaggctgcggaacaggcgggtcgaatcgaactaaggtaaaataagtggaaccggtacacttttatgtcacaggggcaggcccaaggtcaagccctaggctgaaaaaggttccagatgtccaggaagtgccagacaaaggagtaggcgtgcagaaacaaccgaccatccgcgatgttgcccaggcggccggggtgtccgttgcagtggtctcccgggtgctgaatccggggtcaggtccagtcgctgcagctacacgcagcagggttaacgacgtcatgaagaccctcggctaccatccccgcacggcggccagggagcttaagtttggcccgcctactacgctggggctgcttctcgccgatgtctccaacccctttttcgcccgactcgcggaccaggtggtgcaggaagcgcacgcccgcggaatccaggtgctactgatgacgacgcaggaggatgaccagctggagtcggagcgtctggcgaccctgatcgaacgcagggtcagcgggattatcgctaccccgaccggcaacaacctggccatctggaagcagctccaggatctgggcactgaggtcgtttttgtcgaccgatccataccttcgctccccgaggtggacgttgtcagcatcgacaactttgaatccgcccggtccgcaacggcgctgctggccgcccacgggcaccgccggatcgggatcatctccgggccggctgcctccactaccggaagggaccggatcgccggctaccggcaagccttggaaacagctggcctggagcaggatgagctcctcatccggcacgccgcgttccgcgggccagcgggaggagacgccgcgtccgcactgctcaatatcgaggagccgcccaccgctttggtggtggcaaacaccgcccaggtaaccgaggttctgcggcgcctctcccacgccggaatcgacattcccggcaccctatccgtcatcgtcttcgacgattcaccctggaccgaactcatgaccccggccctgacaatcgtcaggcagcccatagatctgctcgcccggcattccgtgcagctcgctttgtccaacacgcagggcaagaggtcgggaaaacccaacgtcatacgcgtagccgccgaactggtcgaacggtccagcgtcgcccggctgcagttctcgaagtaacaagctggcatccgcttctcaatggtttacagccgcgcccgccctgtggtaaaaaagtgtaccggttccactgacaccgcaatcttccactctgttctgtaggccgcgtctgcaaggcattgggcaagcgggatgaggaagcagcaggagcagcccttctcgaccacatccgcaaagcccgggacgccttaaccaccaccgccatccaagcttcagtacccctgtccgtatcggtcaggaaccagcacgtattcaaaggagaatcagatgccaaagcgcatcctggccgccgcagctgtggccgttgcactcaccgttagtactgtcctcaccggttgcggcgggggtgcgaccggcggcgctggcgcggccagcacaaccgtgcgcctcggcctcggggaccccgcagcctcttccatgggcgtgagcgcaaagcacttcgctgagaaggttgcggagctgagcgacggcaaggtcaaggtcgagacgttccccgacggcacccttttcggcggggaccagaacgcagccgtcaacctgcttggaaacggcacgctggactcgaccatcatgtccacctcggtatacgcgtccttcgaaccaagaatgaatgcgatcagccttccttaccttttcaaggacacggaggaggtcaccaagtacctcgaaggcgagccgggcaaggaactgctgggctcactggacaagctgggcatcaagggcgtgtccatgctgacccgcactccgcggcacaccaccaactcggtgcgtcccatcacccagcccgaggacttcaaggacctgaagctccgcgtaccgcagaatgacctctgggttaagttctttggctcactgggctccaacccgacgccgatggacttcaaggaggtttacaccgctttgcagctcggcactattgacggccaggaaaaccctctggaagttcctgtcaacaacaagttcttcgaagtccaggactacctctccctgacgggccacatctccgacgccttcgtcctcgggttcagcaagaagaagtgggactccttcgatgaggacacccggaagatcctgcaggaagctgcagacgagaccgctgacttcaagacgaagtacgacatcgacgaagccaccaaaaccctcgagaagctgaagggcgaaggcgtgaagatcaacgagctgacgcccgaagccagggaaaagttccaggcggcagcgcagaaggtctaccccgagcttgagggcaaggtgggcaaggaattcgtccagtcaagccttgaattcctcggacgttaaggtgacgggtccagtgcaggagacgagtccagtgcatgatgatggaaccaccccaacccggggggccgaacaccgggcggccgaagatagcatcaaggtgcttccggtaagcgaagtctcggaacctcatggcctgatctggaaggccgtggatgctctcctcttcatcggaatctgcgcgatgctgctcagccttgctgcccagatggtcagccggcagatgggagcctcgctgtcatggaccgaggaactgacccgtttcctgttcatggacaccaccttcctggggatggcagcaggcttccgggccgccgtgcacccccgggtgaacttcgcggtggcgtggggaccagcctggcttaagcaggtcagcatgcatctctacgccatctgcgggaccgtgttcttcagtgtcctgatctacaagacgtgggaactgatgctgcagcagtacgccgccggagagaccagtcctgccctgggactgaagatgttcctggtaaccctgccccttgtgatcagcgcggcactggccatcgttgcccatatcacgaccgtctacttctccccgtatatgcgtaagcggatcctcgaaggagagatgatcgcatgagcctgaccctgctgggcattttcctcctcctgttgctgctgggcgttccgctctcagtttcactcggcattggcgtcatcgccacgctgctgatcttcgacatcccccttgacctgttgccgcagtcgatgatgagctccatgaacagcttcctgctggttgctgtccccttgttcgtcctggccggcaacctcatggccggagggggtatttcggaccgcatcttccgtggcgccgaagtcatcttcggccgcttccgtggcggcctgggccaagtgaacatcgcatccagcgcgatcttcggcggtatctccggttcttcggttgccgatattgtcagccttggcaagatcgagatcaaggccatgactgaccataagtacccgcggccctatgcggcagcgatgaccatggtcaccgctaccctgtcctcactgataccgccgagcatcctcatgatcatcgccgcctcgaccgcgaacgtgtcggtaggcgcggcactcgcgggaggatttggaccgtccattgtcctgatcctcgtcctgatgcttgtgaatttcttcctgtcggcacgccacggttacggcgaggtctcaaggacacctttcaagaagggccttcggatcgtcctcgaaggaatccccgccatgggcggcccggtgatcatcctggtgggcatgttcagcggaatcgtcacgcccacggaggcggccgccgtcgccgtcttctacagcctgttggtcggcatctacgtctaccgggacatgaagtggcgccaaatgcccaagatgatcgtggacgccgggctcaccaccggcaccatcctgctcatcgccatgatcgccggcgtcgcctcttacatcttcaccatcgacgggctgccggcaaaggtcagcagctggctgctgagcgtcagcactgaccccaccatcgtcatgctgctgatcggcctgatcctgatcatcatcggaaccgtgatggacaaagtcgcagccatcctgctttgcacaccggtgctcatgcccgcggccgtgtcttccggggtggatcccatccacttcatcgtcttcctcgtcgctgcccttgccgttggcctggtcacgccgcccgtgggcgtctgcctgttcgcggcgtcctatgtcagcgggctgccgatggagaagatcgtgaaggccgcggtgccgctctacgcggtcatggtggttgccatcgtcatgctggccatcttcccgcaacttatcctgtggccggctgatctcctgaccgaccaataacccctgccctcagttcgcaatccaaaacgtgcctgcacgccctaatccctaaaggatcccaatgcctgaacatgaccacccagcgcttgccctgatgggattagggccgatgggggaacccatggcgcgccggctcctgaagggctacggcgagctgacagtttggaaccgaactgcttcgaaggccaaagccttggtgggcctgggcgcccgcgttgcggcctcaccttttgaggcggccgctgacgttgttctcaccgtgttgccggacctgggccacgtcgaatcgttgcttccgggagacgagggcctgatagccggatggacagccagggccatcagcagcccaatactcgtcgtgcacgggaccgtctcgccgggggcagtggcggccttcggcgaacggatgcttcgcgaccatggcgtccgggtccttgacgcccccgtcagcggcggcaccgtgggcgcccaggacggcaccctgagcatcatggtgggcggggacgaggacacgtttaactcggtcaccccggcgttccagttcatgggcagcaccatccggcacatgggccctggaggttcgggcgcattggccaaggcctgcaaccagatcgtggtcgccggcacggtcacggcagtttccgaagccatgcttctcgcgcgcggcgggggactcgatccatccgtcatgcttgaactgctccggggcgggctggccgactccgaagtgctgcgccaaaaagggcacagatggattgacgccgacttcacaggtggcggcagcgcccaaaaccagctgaaggacctcaacttcgtgctgggggcggctggagcggcacatttggagctacccctgagcacggtaatcaaggatcttttcgaggatatgatcgcgcggggggacggcgccctcgaccacaccgggattttccggacgctggctcagcgcagcagcgctctcacggagacctgaaaaccctcacgaacagcgagaaccccacctcacccaataggcgccggccccagctcatcaagcagcttctgcatggccacatacgccttgttgcggtaggcgatcagctccggggtgcgctcggccgggacgttgaggaaccctgcgccggtcttggtgccgagcttcccggcctccaccagctcactcaaaatcgcaggcgtggcgaaccgctccgggaactccttctgcagggacttgtagcagaagttgtacacgtccagcccggccatgtccgcaatcgcgaatggcccgaagaacggcagccggaagccgaacgtggtgcgcaccagggtgtccacgtcatccgccgtcgcaatgccctgctccaccagctgcgccgcctcgtggaacagtgcgtactgcagccggttcagcacaaaaccggtggtgtccttgaccacggcggtctgcttgccggcggcatggaccagctcgcggacggcgcccacggtggaggcggacgttccggcgtgcggaatgatctccacgccgggaatgaagggcgacgggttcgagaaatgcacacccaggaaccgttccgggttgctgaccggcccggacagttcggcgatggagatggtggaggtgttggaaccgatgatggcatccggccgggcggcggcactgatgcgggccagggtctggtgcttgatggccaggatttcggggaccgcctcctcgatgaagtccgcgtccgccacggcttcctcgatgtccttcgcggcccacaggttctgcttcaggatctcggtggaaccggcaggaaacagtccgtcggccacgaactggtcggactcaaccaggagcctgtcgtagttgctctgcgccagctcagcggacacatcggagagggccacgcgcgccccaccaagcgccaggacctgcgcgatcccgccgcccatgtagccggagcccacgatggcgatcttcccggcgccgggagtgcccgggccgccgccggtgctggttgggtgggatgaattttcggtcatggtcagactgctttcgtggattcgggttcgtaggagcagatggcgtccacctttgcggcggaggccgaggtctcgtcaaaccggtagccgagccattcgcctaccaatttcttggccagttccaggccgatgacgcgctggcccatggtgaggacctgcgcgttgttgctcagcaccgagcgctccaccgagtacccgtcgtgcgcggtgaccgcccggattcccgggaccttgttggccgcgatggccacgcccagcccggtgccacagatcagcagggcgcggtccgcctcgccccgggccaccttgcgggcagcgtcgacggcgacgtgcgggtacgcggtggtgtcgccggcaccaacgcccacgtccaggacggacgcaacgcggctgtcagcttcgagcagcgccttcagcgcttccttgtactcgacgccggcctcgtcgttcccgatgacaatccgccatcctgccgcagcgccggcgctcatgcctgagccccatttccggccaccaaagcggccgccctgggataggacagggccggcgaaggctcaaagtaatcagaaatccgagtcgctatcagggcgaaggacaccgctccgggatccgggtggcccaggctcttttcggccagcggccgagcccttcccttcagcgggcgcagggatgcggtggcgtcggccgcctgccgggcggcggtaaccgcggcggccagggccccgcttactggcgacccgccgtcgaacgcggctacaaacgcgtcccggaagggaagcagcgcgtccaccatggtcttgtcgcccacatcagccttgcccaggctggtgacggcgtccgcgaaggcggtcacggcgacggctgcgtcctcaccagagtacgattccttgttgccgagggaccgcccggcagcggccagggcggatccccagagcgccccggaggtgccgccggcccgctcgctccaggcctcgcccgccgcggcgagcacgcggtgaaccgaaagtccaaggccggcagcttcaccggccgctgccaccgctgcgtccacgccccggcgcatgccgacgccatgatcgccgtcgccggcaatggcatccagcctgcccagttcacgttcatggtcgacgacggcgtccctcgcctgggtgagcacggcggctgccagccggcccagcccggctgctgccgccgtcgtatcttctccttcggcggccagggcaccttccggtgcggccagttcccgccgaggccgcggtgccaggctgcccttgcggtacccgggtgtgtcggccggggccgtccagtagcgctccagttcgtcatcaagccacagcagcgtcagggacaggccggacatgtccaggctggtgaccagttcgccgcattccggctccacgatggtcaggccggcggcggtgaggagcttgtcgatcttgccgaacagcaggaacagttcctcatacttcaccctgccgagcccgttgaggatggccaccacacggctcccggcatcatcaggcttgtcccggagcaggccggagacgagcagttcggccagttcggacgccgtgggcatgggatgatccgagatcccgggttcgccgtggatgcccagcccgagcgacatcccgctggccggcacgtggaacagcggttcggcagcgcccggcagggtacagccgtcgaaagccacgccgagggaccgcgtgcggtggttggccagcacggcaagccgttcgacgccgtccaggtccagtcccgcttcggctgcggcgccggcgatcttgaagacggtcaggtcaccggcgattccacggcgtttctcgatctggtccagcggggcgctggcgatgtcatcggtgaccaggacggtgcgggtctcgatgccttcggcgttgagccgctgctgtgcctcgccgaagtggatcacgtccccggcgtagttgccgtagctgaacagcacgccgccgccggcgttggccgcctttgccacccggtacgcctgcccggccgagggcgacgtgaagatgttgccgcacaccgcaccggcggcgaggcccggccccaccaggccggcgaaggccgggtaatggccggagccgccgcccaccaccacggccacctggccggctggcacctcggtggagcggacaacgccgccgtccaccctggccacgtagccgcggttggctgccaccaggccgtccagtgcctcctccgcaaagtccgcggggttgtcaaagatctgggtcatggtttcctcatcgaatccttgggttgggataggcggtggtgcagcgattacacgcgggcgggctgcgccggctgctgccggccctgggccacctggctgctgcccaaggcgtaaccggcggccttggggaggatgtggcggcggaggtactcctggttgctggccgagacacttaggccgtccccgccgtagtgttcggtgcaaaggatcccctggaacccggcggccagggccactttgaacgcctcccggtagttgatgaggccgctttccatgggagccggcatggtgacgtatgaatcgcgggccgcgtcctcgtcccggaagtagttcttcatgtgccagaagttggcgtacggcagggttttggccaccagctcccgccagtcctccaccggccggtgcagccggatcaggtttccgaggtccgggttgaggcccacgttggaaagcccaatgtcctggacaaggcgcacggaggagtccgcggtgcccaggtacgtgtcctcgtacatctccagcgagagcaggaggcccacatcggcggcgtgccggccgagttcccggaggcgcgaaaccgcattgccccatgcttcccggtctcccttcgggtccttgtgcccttcaaccgtccagaaccaaagctgtttctgctgctccggcgtgatggcctggtgcaggccaaaggaaacaacctcacaccccagctcggccgccgcgtcaatggtccggtggctgtacgccaggttggcttcccagttccgcccgtcaatgacgctgcgacggatggcggagacggcaggggtgccgatgcccacgtcctgtgccgtctgcctgaactcggcgagccggcccgggctgaggtcaccgggccggacccagctgtccgtcaggtccgcgttgacgaacccggcctccttcacctcggtcaacgccgccgcccaggcggaggcatcggcgtcgttgatgtgggttccttgggcgctggtgcccgggaagggcagcatggccgcggtgatgggccagttctcggcggtgtaggccatgcctacgacgcttcctgggcctggagcctgtccagctccccggccaggacggtcagctccacgctcgccggccgctccacggtgctgcggatggctaccgccgcgccgctgttggctgattccagcacggattccatcacttcgagggcgtggtaggccatcgctccgccggcgcggggctcggccccggcgggcgtggacgcaaggtccgcgatgccgaagccgcgaccggagtcaacgtagccggcggacacgggaagggtttcccagtcctcggcgccgagggagaacagctggacgtcgccgtcgaagtggttcgggtccggcaccaccagggatccgcgttccccgtggatctcgatgttgggggacttggacttcacggcgtcgaagctcatgaacagggtggagagcgcaccggaggcgtgcaccaggacaccggtcacatgggaatcgatgtcgacggggaccttctcgccctggcggggtccggagccgatggtgcgttcgttgcgggtgtggcttgcggcgccgatgaccgagaccaccgggcccagcagggtgacgagtgcggtcacgtagtacgggcccatgtccaggagggggccaccgccgggctggtagtagaagtccgggttcgggtgccaccgctcatggcccggagtcaccatggtggcgctcgccgagatgggggcaccgatcaggccgtcatcgatcgccttgcgcgccgtctggatgccggtgcccagcaccgtgtccggggcgcagccgacggcgactcccgcctcccgcgcggcgtccagcacctgccgtgcttccgcggtggtggtagcaaggggcttctcgccgtacacgctcttcccggcggagatggccttcagcgccacctctgcatgggcggcggggatggtcaggttcaggacaagttcgacgtcgtccgcggcgaggagttcctcgacggagatggcgcggacgccgtcgtaggcatccgccacggcctgggcacgtgcggggtccaggtccgccacggccaccaggtcaatctgtccgagtttgcggaagttcgccaggtactgcgcgatgatggctccgcagccaatgattccgactttcaacgacttgcccacagcaggcccctttcgatgatggtgcggacgttggtgtcctggaggatgtcgacccggtggccgggggtggcgacaaagatgcggcctttgccccattggcgggtccagatggcgggggaggtgacctcccggttccaggggtcccactcgcggaccttctgggtggtggtggccaggacatcgatgtagtcgtcggagagcacccagtactgctcggtgaccaggtcgaagtcggagaggcccttggtgatggggtgttccgcggccgccgggagcatgttgaccgtgtagggaacgtagttgtccgactgctcgccgatgcactcgtccgggtgcttgcccgggtggcaggcgaactggccgccgatcaggtgcaggtagtccgagttgttgcggtaggaatcggcgatgccgccgtgccagccggccaggccggtgccgttttcgacggcggtccgcagcccggcgaactcgtccttttcgatggtggtcatggtcatgcactgcatgatcaggtccacgcctgccatgtattcggcgtctgcatagaccttgggggattcttcgacgcggacgtcgtagccgttgtccttgaggtaggggatgaagagttccgtggcctcgtacggctggtggccgtcccagccgccgcggaccaccagggcgttcttgcgttctgtcatgtcggggtttccttttgtttggctgccggccggggccggaaagtctgggccggaaagtctgggccggaaggtctgggtcagcggctggagaaggcggcgtcgaaagcggccgctggcggggcgatccgggcgagttccttgaccatcgccagcgcctgcggtgcgccgacgagccggtccatgccggcgtcctcccactcgatgctggtgggcccggtgtagccgatggcgtttaaggtacggaagatccggttccactggacgtccccgtgcccggcggtgacgaagtcccagccgcgccgggggtccgcccaggccaggtgggagcccaggcgcccgttgcggccatcgagctggcggactgattccttgacgtgcacgtggaggatgtggtccgcgaagtcctgcaggaacatcaccgggtccaggtcctgccagatgaagtgggacgggtcgaagttcaggccgaagccctttcggtgcccgatcgcttccagggtgcgcttggcggtccagtagtcgtaggcgatctcggacgggtggacctccagggcgaaccggacccccacctcgtcgaagacatccaggatggggttccagcggtccgcgaagtcctggtagccggcgtcgatcattgcctccggggcgggcgggaacatcgccacggccttccagatggaggatccggtgaaccctgtgacggtcttgacgcccaggcgggcggctgcccgggctgtgtccttcatggactccgcggcccggcggcgcactccttcaggttcgccgtcgccccagatttccgccgacaggatgccctggtggcgttcatcgatggggtcatcgcacacagcctgcccggtgaggtggttggcgatggcgaagacctggagattgttcttctccaggatgtccagccgtccctggaggtagttgtcgtcctccgcggcccggcgggggtccaggtggtcaccccagcaggcgatctcgagcccgtcgaagccccactcaccggcgagccgggccacctcctcgaacggcaggtcggcccactgcccggtaaaaagcgtgatgggtcgtgtcatgactgttccttcgcttgttcctgtgttcacgttcctagaccttctgccactggctggagttggcggcgctggcctccacggcagccaggacccgctggacctgcagggcatccgcgaaggacggctccggctggcggccctctccgattgctgtgaccaggtccaccacctggtgggtgaaaccgtgctcatatcccaggccgtggccggtgggccaccagttgccgacgtacgggtgctcgggttcggtgacgaagattttccggaagccggcgtcaggggactccgccgcgtcgtagaaggacaggacgttcatgtcctcgaaatcgaaggcgagggagcctttggtgccgttcagttccaagcgcatggcgttcttccggcccagcgcgtaccgcgtggcttcaaagacgccgatcgcgcctgcggaggcaccgccgtcgaactttgcgctgaagatggcggcgtcatccacggtgaccttcccgcggggcgcgtcgccgctgaggtcgccgtggccgcccaggcccacaaggtcgccggccagcgggcgttccgggacaaatgtttcgagcagcgccgagacgccggtgatgctctggccggccacccactgggcggcgtcgatgctgtgcgcaccgatgtcgccaagggacccggacccggacttgctcttgtccagccgccaggtcatgggggcgttggcgtcggagagccagtcctgcaggtactgcgcccggatgtggcggatctcgcccagcctgccttgctccacgaaccgtttggccagcgccagcgccggggtgcggcggtagctgaagccgcacatggacacgactccctgcttggcggcggcctcggcagcgagggtcatccgctcggcttcctccacggagttcgccagcggcttctcgcacagcacgtgcttgccggcctcgagggcagcgatggcgatctcggcgtgggtgtcgccgggcgtgcagatgtcgatcaggtcgatgtcgtcgcgctcgatcaggcggcgccagtcagtctccaccgagtcccagcccagcttgtccgcggctgcctttgcagcgtcggcgttccggccggcgacggcggtcagctgaggctgcagcggcaggtcgaaaaaccgcggcgcggtgcgccaggcgtgggagtgggcggcgcccatgaaggcgtaacctaccatgccgacgcgaaggggctgtgcgggggtcatgtgtctgtcctttcgtgaagttcctggttgttacttgctgaagccggcggtgaggccgctgagcagctgccggcggcccacgacgtagagcaccaggattggcagggtgctgagcaccactgaggcaagcacggccgggatgttgacgctgtattcgccctggaaggtccacagcgccaggggaaggacgcgcaggccggggctctgggtgaggaccagcggaagcaggaatccgttccagacgtgcaggccgttgtagatggcgacggtcacgattgcagggcgggtcagcggcagggcaagccgccacatggtctgccactcgctgcagccgtccagccgcatcgactcgaagagttcgttcgggacgtcgcggatgaagttggacaggatcagcacggtcagcgggatggcaaaggcaatggagggaagcatcagcgccagcaggctgtcgtaaaggttcagccggatgatcatcaggtagatcgggatgatggtggcctgcagcgggatcgccagtcccatcaggaacatgccgttgaccagcttgaggaacctgcccttgccccggacaatcgcgaaggcggccatgaaggagatcaggaccgtggggatgacggcaccgagcgtgacgatggtgctgttcatgaagtactgcgcgaagtcggcctcaaggaccatctggtagttttccagcgtcggggaggtgggaaccgccagcggattctggccgaagtacccttcctgggtcttcaggctggtgatgaccacgtagtagatcggaataatgatgatggccagccaaatccagccgccgaggcctgccgggacgttcagccgcctcatccggttaccgagtccccgcttgggggcggccgggttgggccgggaaccggtgggagtttcctccgcgttgcttttcaggacggtgctcaccctacataccttccaattggctgccctgcttgtccttgcctccaaggcgctggaggaacagggcgagtgcaaggccgatgagtacgagaatgacggcgatgacgctggccgggcccatgaggttggcccggaagccccgcaggtacatgtccagggcaaggatccgcgtggagttgcccggaccgccgccggtgaggacgaagatcaggtcgaagtacgtcagggaccccaccaccatcagggtggaggaggtgatgatggtgtacttcagctgcgggagggtgatgtggaagaactgcttgatggttcccgccccgtcgatttccgctgcctcgtagagtgacctgggaatctgccgcaccccgccctggtagatgagcgtgtggaaggggacgaactgccaggcgatcacgaagatgaccaaccccagcgccaactgggggacgcccagccagtcctgcgccaggaaaggcagccccagcccggtagccaggccgaagttcgggtccagcagggccttgaaggcgatggcgactgccgccgatgagagcagcagcggcaggaagtacagcacggccagggcggcccggtaacgctggcttcccgcggtgaagacacccaaaaggaggctgatgggggtctggaccagccaggaggcgatcatgatcaggaaggtcagtcccagggcgttatacagccccgggtccgcgagcacggagaaccagttgcccagccctgccgacccgatggcaccgatgccgtcccaactggcgaagctcaggatcaggacgccggccagcggcaccacggcgaacgccaggaagaagaacagtgcaggcactgtcagccaggcgagggcggcattacgttggccgccatggccggggtcgcccttggggcggccggcccgggcggcaggcttccgggtagtggagacggcgttactcattttccgagggttgcattcatgttctcggcgaactgctgcggggtgatcgacttcaggaacagctggtcgatgttgttcagcagggcttcagccgcggtggggctcagggcctggtcccacgactgctggaagttgggggcgttcttggccaggtcgtagacaaagttcaggaagtccttgtcctcggaggtgttgagcttgtcctcgatgccgttgacgatcgggacggagccggagttgatgtaggtatcgatgaccgtctcggtcaggatgccgtccttgaagaacttcttcgccgtctccttttccgcgtcggtggccttggaagagatcgacatgtactgggcagggtttcccacgccgttcttcggatcgcccttgccgccggcaaccgttgggaactggacgaatcccagcttcccgtcctggacgaagttctggccgcccttcttcatggcgccgtaggtccaggaaccgtgcagcatcatggctgccttgcccgtgaacagcagggcctggtccgcattggagtccgccgcgatggacgagaagcccttgatgaaaccgtcagcggagacgagctcctggatcttggttccggtttcgatgacggcgggatccatccaggagtccggcttgccctcaaagatggcggtgaacacttcggcgccgccgatgcggtccagcaggtattccagccacatcatggaggtccacctggactggccacccagggagaagggtgccacgcccatgtcgttgaaagtcttgaccagggacatcacgtcatcccaggtcttgggcggctgggcccccgccttttcgaacagttccttgttgtagaacaggacgatcggggcgacgtactggttaggcagtgcgtagatctttccgttgaccgtggccgcaccgaacgacgccgggaagaacttctccttcaggtccgggttctcgtcgaaccagccggtcaggtcatccacctggttggcctcggcatacgttttcagggtgccgccgccccagccgtagatgatggtgggggcctggcctgcgccgatggcggtcttgatcttggtcttgtaggcgtcgttctggaagtaggtgacggcgatcttgttgtccgggttcgcggaggtgaacgcgtccacggccttctgcatggtggtctggttgggttcgccggagaggtaccacatgctggcgcccccgccgctgctggaggtgcccggtcccgacgtcccgcaggcagtggccgtcatggcggcgaagggggtgagggcggcaagggcgaggaatgagcggcgggaggtctgggattgcttcattgcttctccatctgaaattgcttcgttgcaaatgtttgggcgtgagctctaccaacattttcgaaatgtttcgactacgtgatttcggtcacggtctaaactaaaggcccggagtagcaaaggtcaaggcccaattatggaggtttgtttcgacggcaaccgccgagtccttgaccgaggcggcgcaaaactgaacaatgagtcaacgaaacttttcgaaaggtctcaatagatggcaacgaagatcccggaacgggccaagccgacgcttgcctccgttgcccagcaggccggggtctcagtgcccaccgtctctaaggtggtgaatgggcgcgaagacgtatcgccggacacccgggaacgcgtcttggctgtgttgcagcaggcgggataccagtccccgctgcagcgccgttcctccggggagaccggcacggtagttgaagtggttatcgatgtcctcgattccgcgtacaccatccaggtcctcaacggcgtgctgcagtccgccgccgatgccgacgtcgaaatcctggtcagcgtcaccggtcccgccagcgagggccggcgcagtcccgagcgccgtgcccagcgcatggtggacgagggcagggtgggaatgattgtggtgacgtcagccttcagtgagacgcagctgcaccctttccgccgccgccagattcccgtcgtcgtgattgacccgctcaacccgccctccgctgacgtggtcagcataggggccaccaactgggccggcggcaaggcggccacggaacacctgctggagcttgggcaccgccgcatcgcgtacatcggcggcatagagaaggccgaatgcaaccaggcgcggctgcacggctacatggccgcactcatggcgcacggcgtgcaggtggacccgcagtacatctattccggcggcaggttccgccgggaaagcggcgtcaaggggctgaaggcgctgctcgagttggacaagctcccgacggcgatcttcgccggcagtgacaccatcgccctgggtattcttggtgaggccgcccgacacggtatccgggttcccgaagacctgagcctgatcggctttgacgggacgaaccagggcgaagagtcggtgccttcgttgagctccgtagcccagccgctggaggagatgggtcgggcggcgctgcggtctgtgctgcgccaagcgcggggggaagtcctggattcgcaccgcgttgagctcgccacccatctgattgtccgtgactctacggcaccgcctccggcctgagcatggggaaggcagttgggtcagctcaggctccagccaagacctgcgacgcgcctgttgacgctacccgcggcgggtatagctgatttcggtcgcgccgaggggtgccgagtgcaggctcacgtagctgccctgtgctgtgttcccggcgccggtgtagccgccgggcagcgagatgtaacctgcctcggtgcggcgtgagtcggcgaggtgaccgggcagggtgacgtagctgccgccgcggggtgtcccgatggcgacggacggggttgcttcgatggtgacgggacgttcgagtgtctgggtcatggtgttctcctgatgcgtgaggttgggtagctgccgtccgggtccctgccgttcccaaatgcgtcaggcctgcaggtgtccgcagggggcaatgggggtggggttcgatgcagtgcggggagccggcgcattggcgctcggggaactgttcacccgcatacagcccggatagggcttcggtggcctggcatcaacgttacggcttattttgagtgcatcaaaataaggtggcagaactcacggggagccgtcacttcttcgtcagccggtaccgctcaatttgccgaagccgccgcatcaggctgtcgcgccgcgggtgcgggacggcgtcggacgcttccgcggtgaggtcaatgtgtttggtgccgtactgccacaggagcaggtcatccagtagccggtcggggccgggggagtaacggtggtccagggccctccggacctcggtgatgcggttggcgctgagcagccctgccagctgcatggtctggttgaggccgtgcgcggcgaggagttcggccgcccagccccagtcgtcgtccaccttgcggtccacgtgcggaagcagcgtccgccagatatccctgatgcggttgggcgtcagcggcgccgcgccctcgccctcggcatcccagaaactgcggacttcctcgtagcgctcgtgcaggtcggcgaaggcagtctccaccgtctccagcatggccgcggtggcggtgaactgccggtcgaagtgcggcgtccaggcgcgcgggtcctcggccttgaatcggatgtcgtgctcgatctcgctccacgcgtgggcaaaaatggtgcggatctggcactcaaagaagtagctgccgttgggcacggcgtccgggttgaaaacctgctggtattccttgacggcctcgttctggatggtgcgcaggatcaggtgccggctggaatacccgtaggtgccggattcgatggagccgatgtccttttcccggtcgccccggcagtcgaagagctggcgctggtgcttgatgatgttggccaccaccgcgttctcggctgggagcttggtgatcacgcggatccccaccatgtcattgagggtccggaaggggtccgggaacttcaggaccggggggccgcccggctccagcggctcctcgatccgggagatcttttccttgaaggattccaccgttttggtgcgcccggtgacgaacagcggcgtgacctcggagtccttcagcatgtcccgcagggtcagcaggacgtcccgggtgaccagtttcagggcagggcggacgcgctcgtagatctccacgttctgctccacggattcgcgcaggctcgcgtccaggctgtcccaatgactcggcatggttccagcttacggccgggcactgacagaacgacggcggcgggcgtcttcagcgttccgccgcggccgtggatccgcgcaccaccagtgaactttccagcgtcaccccggcctgttcgagcacctggccttccatgacacggcggagctgctccccggctttcaggcccaggggagtggcgggcaggtggacgctggtgaggcccggattgctcgtggccgaatacgggaggtcgtcgaagccggccacagccagctcctctggaatccgcacgccggccacgcgggcctcctgcagcacaccgtaggcgtgagtgtcggtgccgcagacaacggcgctcaccccctcccgctgccatcccggccaggcggcggcgaaggctgaagccgccgtgccgacgtcgatggtggtgctgataatgcgtcccgcccccacggtgatgccgcgggcggctgcctcctccaggaaggctttccgccggagcgcaaaggtttccgtgcccgtgacgctgtccacgtacgccacctcgcggtgcccggcgtccgccaggtgcgccgcgagttcccgcgcaccgcttgccacgtccaggttcaccgacggcgcgtaggcctccagcccgggcgcgtccagcagcacaacgggcgacggcgacgcgaggtcctcgaggaagcctgcgctgggtgcgtccaccaggagtcctgccggacgcagggacatcagccgccggacgtcgtcggcccggggggactcgccggcctccgtgacggacagcagcagctggtactgggggcccagcgactcccggaccccggcgatcaccttggcgaagaaggggttggagatgtccggcgccaccaggatcacgatcgagctcacgcccttggcgagcgaactgccgatgccatccaccacgtagccaagctcggcgattgcctcccggaccctggaaatgttgtcctccgagacgcggccggcggtcttgccgttggccaccagcgagacggtggccgtggagacccccgcccgggctgccaccatcgccgccgtgatccgccgggaacgcacgggctgctgcagctgttccgcggattccatacctcgatcgtagtaggaggcggacccgcaggctgtcctccagggccacacatggcagggcaatcacgcgccgcggaggcggccgccggacaggaaaatgggtgatccccaccgccccgaaaaatgggggtcatacaggccttccggaccgggggctctggtgggacgatgcccgtatgagcgataccagccatgcaacagcgcgggaccttggcccccaccagcacgcccacgtcgcgccgacgtcccagcagatccggaccgtggggcagcgccggcgggaggcagaggagaagcttgaacagcacctccaggaggcccgccaaaggtacgagcagcacgaggcccaggcgcacccggaagccgggcaacccagcaaggagaagcgccactagcccggccccatacacaagccacaccatccagcaccccaccaggcaggcgctggcatcaagcgcttgacctgcgtttacgtcaagcgtttgacgtgtgccgcacaacactgccatgatctctcctgaacgcttcagcttccccgcgcacctgcgggccccaaagacgtggagatcatcgtggaaccccctgccccttcccttgaccggcaatcccccggccgcaggaagatcattcttgactgcgaccccgggcatgacgacgctgtggcgttgctgctcgcgcacggcaacccggacatcgacctgctggccgtgacaacggtcgtgggaaaccaaaccctggaaaaggtcacccgcaacgccctggccgtaggcaccatcgcgggcatcaccggtgtgcccttcgccgccggctgcggacgccccctggtgcggagcatcgaaaccgccccggacatccacggggacagcggcatggacggcccggaacttccgccgtcggacattgacctggatccccgccatgccgtggacctcatcatcgataccgtcatggcgcacgagcccggcaccgtcaccctggtgcccaccgccggcctgacaaacatcgccctggccgcccgcaaggagccgcgcatcgtggaacgcgtcaaggaagttgtcctcatgggcggcggctaccacgtgggcaactggagcgccgtggccgagttcaacatcatcatcgaccccgaggccgcgcacatcgtcttcaacgaaaagtggccggtggtgatggtgggcctggacctgacccaccaggctctggccaccccggacgttgtggaaaagatcgccgcgatcggcaccaagcccgcgaagttcgtcaccgaactgatggatttcttcgcccacacgtacaaggacgcccagggcttcgaccacccgccggtgcacgacccctgcgccgtggcctacgtgatcgaccccagcatcgtcaccacccgcaaggtgccggtggacattgagctgcagggcaagctgacgctcggcatgacggtggcggacttccgcgcccccgcgccagcggactgccacaccagcgtcgccgtggacctggaccaccaaaagttctggaacctggtcaccgaggccttggtcaacatcggtgatccgctcaccggtgccgggcgcaccacacagaacgcggccgacgtcgtacgcggccaaactgcctccctcgcggcgggaggggtcaagtaaatgaccgccaccgtcctcgaaacccggaccgccaagggcaatgtcaccgccctgatggtcgccctgctggcagcctgcgtggccttccagctcaacgcctccatgcttagccccgccctggtcaccatgggcgaggagctcaatacggaccaggccgtcatcggcctctcccagacctggttcttcaccgcggccgccctgttctccctgtttttgccccgcctgagcgacatcgtgggccgcaagaagatcctcatggccatgatgctcctgatggccgtgggatccgtcatcgcagccctcgccccggacgtcacgtggctcttcgtgggccgcatcatccagggcgtcagcggccccaccgttccgctctgcctcatcatgctgcgctccgctgtcaccaacccgcgcaagtacggcaccctcatgggcctcatcacggccgtcaacggcggcgtggcaggcgtggactcctttgtgggcggttactttgccgagcacttcggcttccgcagcatcttctggctcatggtggtcctggcgctggttgccaccgcgctcatcgctgtcctggccggtgaaagcaagccgggtgccggcacccggatggactggctgggtgtgttcttcatcgtggtcgccgtgggcgcgctgctcaccgccctgaacgaaggcgccaagctggtgggcgcattctcctccggcaccctgatgctgagcctcacgctggtgctggtgtccgccgccgcgttctacctgttctggcggaccgaaaagcgggcgacccagcccatggtggaaattgtgcacctgcgccagcgctccacctgggcgccgctgctcaccaccacgctgaccatgaccggcatcttcgccgtcatcaacggcattatccccgcctacgtccaggctgccgaccccggtttcggcattgggcccaccgagatgtcgctcatcatcctcacgccctatgcactgctcggctgggcggtgggacccctcagcggcaggctcgcccccgtgctcgggtacaccaaggtgctccgcatcggcctcctgggcagcatcgcggcgctggccatcatcgcgttcttcggcctggacagcctgcccctgatgatcgccggcacggtgttgctgggcatcatgtacgccggtacggtcaacatcatgctcaacggactcggtgttgtcctgtcacccgccggcaaccctggtttcctgccgggcatgaacgcgggcgccttcaacctcggcgccgggctcagcttcctggtgctgcccgctgtcctggtggcgacgacggcgctcggcgatgcgaaggcgtcctacctgaccgtcgtggtcgtcgggcttgcactcaccatcgccgcgttcgccgcctcgctcctgatccccaagccggtcgaggccgaggtggccgcatgaacgccgccgtcggcaaggcaggccggatcgtcgtcgtcggctccctgaatgccgacctcaccatctactgcgaacgccttccgctccccggcgagacggtgcacggcaacggcttcgcggtgaacccgggcgggaagagcgccaaccaggctgttgcggcgagccggctgggcgggagcgtcagcctggtgggcgcggtgggggaggaccccaacggcgccatgctgctgtcctccgccgcccgtgccggggtggacgtcgggcgtgtccgcacagcgtccgagcccacgggcgtggcggtcatcgcggtggatgccggcggcgagaacaacatcatcatctcggccggcgccaacggcaccctgtcgccggcggacgtggcggaggcgtcggacgtcctggaacaggccgccgtcgtctgcctttgcctggaggtgggcatggaaacggtgctggcggccgcacaggcagggcacgacgccggtgcaacagttctgctcaatctctcgccgtacggcgaggtgccggaggaactgaccgcgctcacggatgtcctgctggtcaacgcccatgaggccgcattgttcctgggcgacggtgcggccgttccgggccccgacgcgcccgattttgactggaatgcagtcaggcagcggttctcggaaagggggatccggcaggtgctggtgactctcggttcgcagggctcggtggtgctggactctgctgctcccgagggttcccggatggcccggattgcgcccaccgcggtcaaggccgtggacaccaccggcgccggcgatgccttcaccggtgccgtcgccgtccggctggccgccggcgacgcgctcgctggggcggctgcgtatgcgtccgtggctgcggccctggccaccacccggaagggcacgcaggctgcgtacccggattcggctgacgtgcagcgggtgctcgctgcgcattgagtgctccgtaactgccgttttcatgggtcaaaacggcgcgtacggagcactcgatgaaacctcggtgcccctaacccgcgttgtagctcccgccgtcgtgctttccgccgggtgcccccggaacttcggcggggcgcccggtgaaacggtccatggtccggttgatgcccagcacgtccatgacccggtcgaaggccccgaccggcagcagccgggccgcggggaccaggttcaccaagggcgggaggaccagcttctggcgcccgttttcgacggcgtccagcaccttggccgccacggcctcctccttgaggatggggagcaggcgcgggaaccgggtccgtacgccgtcgaacatgccggtatcgatgtaataggggcagaccaccagggtgttgacgccggtccttcccgcccgcagctcggcgcgcaaggactcgttgaagccgaacgccgcgaatttgctggctgaatagtcggtctgccgcgcgacgcccaccaggccggccgcgctggcaactgtcacaactgtgccgcggccgcgggcggccatgccggggaggaatgcgcgggttacccagtacagtgccaggacattgacgttgaaagtccgttcaatgtccttgtcggcagcgtccaggagcagtttgcccgtgaccacgccggcgttgttgaccagcacgtccacctggccggcaaccgcggccgccgtctgcacggcctccctgtccgccacgttcacggtctgcgcctccgccaggccgccggtgctgcggatttcatcgcggacgttcctgccgccgtcggccgatacgtcccagatgaccacccgcgcaccccgccgtgcagccgccaacgccatgcggcggcccagcccgctgccgccgccggtgatgagcactgtgctgccggagagcggcgtcccgccggccatcagcgcagccgtcccatcagcgtgagggcgcccttgaccagcctggtgtaccgctggttggtcatgccgggcggaggtcccacgggaaccagccgctgctgggctactgtttgggcttccgtgtacttgaggattccttccttcccgtggcgccgccccacgccggaatccttcatcccgcccatgggggcatcatgggacgcccacgcagcggagtagccgtcgttgatgttgaccgtgccggcgagcaggcgccgccctacttcctggccgtgccgcgcggaccagacgctggcattgagtccatagtgggagtcgttggcgagggccacagcctcgtcgttgtcctccacctggtagaccgccaccacgggcccgaacgtctcctcccgtgcaaccaccatctccccggtgacgccggtaaggatggtgggttcgtagaagtacgggccaaggtccggccgggggcgcccgcccgtgatcacgcgggcgcccttagcccgcgcgtcctccacatgcgcgctgacccgctccagctgccgtaggccggtcagcgagcccatatcgatgtcccagcccgggccggaacccagacggatcgcttccacgtggtcagtgaaggttgccaggaagtcctcgaagaccgcgcgatggacgtagatgcgctccatgctgatgcacagctggccggaattggagaagcagccctgcgcggcacccctggccgccttgtcgaggtccgcgtcggcgaggaccagcgtggcattcttcccgcccagctcacccgagaagccgatcagccgcccggcgcactgctgtgccaccaccttcccggtttccgaggatcccgtgaacatgaggaagtccacgccgccgatcagcgacggacccagcttcggcccgtccccggtcactatctggaacaggtcccggggaagcccggcttcccgcagcagctccagggcgagcagtgccgtgaaaggggtctgggaatctggtttgaggacgcaggcgttgccggccagcagggcggggatcgcgtccgagacggcaagggtcagcgggtagttccacgggctgatgatgccaaccacgcctttggggatccggtactcgactgtctgcgtcaggcccggtgccgcgccggcgcggcgggccgggcggaggaagcgttcggccttgcgctggtagtagccggcagtcagggcggcatccgcgagttcctcgaacgcattgagccgcgacttcccgctttccgcctggaccaggtccaggatctccgcctcccgctggagcagcagcgcgtggaaccgccggacgacggcgcagcgctcgcggaggggaacggcggcccattcccgctgggctgcccgggcgctgtcgacggcggccgcgacatcgtccggcgtgcagacggggactgcgcccaccaggctgccgtccagcggggaatgggaagcctgggttggccggcccggtccgcaggttaccaggtccggcaggtgggaaagaacctcaggcacggcaagctttcggccggttgctgccggcgtggttcccggctgggtggtgctgatcatcgtggtcccctttggcggcaatgtaattcccgagcctagccgcagaagggcatgtgggtccggctgcgcccgggaagttcaggcgccgggaggccggtacttgatctcaccggctttctgcagggcttccatggtctcctccacactcatcagcaccgtggtttcaaacgtgctcagcgcaccgcccccgctgatggccagtgcaaccgccgccatggaaacgttgtccggtgcttcccacaggttgtagccatcgtggctcccaaaggcataccagaatccgtgcagctttccgcctaccgattcgatgtacgcctgcgccgctttccgccggtcctcggggttgttgatcagccggccccaggtctccggtgtgtagctgaaccttgataaatacagtggcattttcctgtcccttcattgagttctggagtgcggatttacccagaatggcagtgcgcggatggcacggcaacgggctttgtcattggctggcggtacgctcggcacatggtgcagcggcataggcattactacggtgaagaccccagccagtggggtgagctgttcctccctgacctgcccgacggcggtgcccaccggggtgtggtggtggtgatccacgggggttactggcggtcgaagtacggggcggagctgggggagccgctggctggggacctcgccgcacacggaatggcggcctggaacctggagtaccgccgggcaggaaacggcggcggctggccgcataccttccaggacatcctggcgggcatcaacaaactgcaggatttggccggtccccatgccctggacctggccaaggtagtggcgctgggccactccgctggagggcacctcgcggtgtgggcggctgggcgcgaccggctgccccggctggggctggaagccgagcgccgtgaggttgggttgaaggacggcggcgtccgcctcaccggggtggtgagccagtccggcgtgctgaacctcgcggaagcggagaggttgcacctcagcgatggtgcggtggccaacttccttggcgggccgccgtcggaaatccccggccggtaccggtacgcggaccccatggccgcgctcccgctggacgttcccgtctgtgccgtccatgccacgaaggatgaggacgtgccgctggcgatgtccacctcctatgtggaggcggcccggtccgggcccgtgccggcgcagctcgtgacggtgcccggggaccatttcgctttgatcaatccccgttcaccggcctacgaaacctgccgcgagcttgtcagggagctgatgcgctgagcgcagcggaggcacaaaacggcgcgccggcctgcagtaaagtggcggccatggacattccctggcagcacggtacctggaccaacccgcccgtttccgccggagcagggcacggatctgctggtcactgccaaggagggcagcgacgcctggcgggttacgtcgtacggctttattcatgacagcgagcacgcgcttctggcgccattcccgcaggattccgccgtggaggtggaattcaccgcaggcttctccgagcagttcgaccaggccgggatcttcgtgcgcgtttccgccgagcggtgggtcaaggccggcgtcgaattcgccgacggggcctgccaagtgggggcggtggtcaccgacgggatgtctgactggtccctggccccggttccggcctggaaggaaagccgggtgctcgtccggatcagccgcagcggcgacgcactgaccatacgggccaaggcaggggacggcgccctgcagttgatccgggtggttccgctcgatcctgcggaggaagcctacgctggccccttcgtgtgtgcccccaccagggaggggctgaccgtgcccttccatgcctggcggaccacggaacccgacggcgccctgcactgacgccgcccacctgccggaaatcgtcacggaccggcgtcggccaacctctttctggcagagtatgaccatgctcactgttattggcgaaggccttgttgacgttgtccagcgcgcctcggggattgaagcacacgtgggcggcagcccgctgaacgtggcggtgggcctggcccgccttgaccacccggtgcagttcatcggccggtacggccgcgacgcctacggcgattccgttgcggcgcacctgcgcgccagctccgtgatgattccaatgggcccggatgacctgcccaccagcgtggccaccgccttgattgacgacgacggcgccgccacctacacgttcgacctcacctgggagcttcccggcatcgccgacaggcttgcgttcatgctgcagggcaccacgctgctgcacaccggctcgattgccaccatgctggcgccgggtgcaaccgacgtgctggccgccgtcgagcacgcccacccgcacgccaccatcagcttcgaccccaactgccggcccagcatcatcaccgatgtggactacgcgcgccggcacacggagaagttcgtgaccctggcggacgtggtcaaagcctccgatgaggatctcgcctggctgtacccggacatggacgtgctggatgccgcgcgccgctggttgtcgctgggcggatccgaggggccggcaatggtggtggtcacgcgcggcgccgaagggccctggggagtgtgccacgccggtgaagccaaagtgccggcaccccgggttgacgtggcggacaccgtgggtgcaggggattctttcatggcggcgctgctgtccggcctggtggaccgcggcctggacggcgcgcagaaccggaaggacctgcgcgagctgccggcggaagggcttgctgagctcctggcgcatgctgcccgggccgccgcggtgacggtttcccggcctggtgccaacccgcccacgcgggcggagctggacgcagtcctgggggagtaggcaactggtgcatcgactgctccacaagtgccgttttgagtgaccaaaaagacacctgcggatcaatcgatggagcttcgcgcgctactccttccccagccccgcggccgaggtcttggctccggttacgccgttgagcgcggccaggtcgaagatgccgttgatatcggcctgcttggtggtgccggcagcgacgccgtcggccaggagcttttcgtacgttccggccagcgggtccacggtgaacacaatgttcttgagggagcggtcaatgacgtcggccttcagctcggcgcccgcggcttccttgagggcggcgttaatgacgctggccttttcgccgtcggccgcatcgttcagccattcgactgacttcacatggcccttgagcagcgccttcacagtgtccgggtgttccgctgcgaatttctggttgacgatcaggatggtggtggggaactcgcccggtttgccggacagcgagccgtcccagaggtccttttcgtccaccagtaccttggcgccggcggtgagcaccaggcgtgaggcccagggctcaggcagccacgcgccgtcgagctttccgtcctggaagagcttcaaggtctgtgcgttctcggtcgggttgatggccacgtcaccgctgccgtccacgttggtcttgtagccctgggaggccagccaggcgcggagggcaacgtcctgcgtgccgccgagctgcggggaagcaagggtcttgcccttaaggtccgcggcggaactgatctccggcttgaccaccagctgggcgccgccggccgcagcgccggcgatgatgttcaccgattcgccgccgctcttcacgaacgagttgatggcggggttcgggccaatgtacgtggcatcgatggcacccgcgttcagtgcctcgatcgcggccgggccggcgttgaacacctgggtgctgagtttggtgccgccgagctcctccgcgatgtagccctggctgacccccaccagggcgggggcgtgggtgacgttgccgaagtagcccagtttcagctccgcggccgggttggcggcgggggcggcttcctggactgcggcagggccgccgctgttcacggcggaggcgacggcggcgcccccgccaatgagggcaaggatgccgacggcgattcccaccttcaggccgcgcgggcgtttgggagcggcggactggccggccacgatgcgggtggagctttgctggctctgggagctcttggggctctggcttgagggatctgacactggaattcctttgctggggcggatgctgagacgaggttatggagcgcccggcagcgccgcaatcgattccgtagcgggcgttcacgggacgtcgtggtagctcaacggggagtagcacagcgacaagaaacgtcgcgggacgtctttttccagggcgcctgtaggggtgccccctgtgcaatgagtcccaggggtcgccggtcccgggggtctgtttcccagctcttaagcggacgtacgatcaggcatggaaaagctgaaatttgaggtgaagatcaacgctcccgcccgaaccgtctgggccacgatgctcgatgatgccacgtaccgggaatggacgagtgccttcagcgagacaggttccttctatgagggcgactggaacacgggcagcgagattcggttcctcggcccggacggtgaggggtccgtgggagggatgatcgcaacagttgaggaaagcaggccgcatgagttcgtctccctgcgatatctcggccaaatcgtcggtggtgtggaggacaggaccagcgatgcggcgaaggaattcatcggagcccacgaaaactattcattcaccgaagccgacggcatcacgaaagtcgaggtcgaggttgagagcgtggatgagtgggcggccatgctgaatgacacttggcccgtggctctcgccaaactcaaggacctcgccgaagctcgggcctgacttagccactctcgacggccatggacggccgtggacgcttggacggctcaggcaatggccgtttaggcagctttcaccaggggaagctcgtcccagtgggtggtgtacctgggggaccgcatgttccgtttcatggtccagtccaggcccgatttgatcccggcgtgccccaggccgatggagccgcgtccaaaacggctgcccacgtcctccagcagggtgccgatgcggtgttcctcatgccggttctcgaacagctccagcggggactggttgccggtaggccgcaggtccgtgagcatgaggcccactttgacgtacttcaggccttcgcggatgttgggcagcagggcgtgcgccgccctggtgagcaggagcgggtcggctgttggcatcggcaacgggacgcacacggacggataggcctgctcctgcccgctgaagggcgaggtgccggcaaatgcggtgaggacttttgcctgcagcccgtgtttggccaaccgcgcgctcgcattctggccgtagacgctgagcacctgccgcagccccgccacggtggtgaccggcgtggagaaggaacgcgagaagatcagctggtcccggcccaggcgttcctcctccatggggatgcagggcgtgccgttgagttcaaggacggtgcgcatcatgactacggagaacttgtcccggatggccacaggatcggtgcgggtgaggtccaggatggtgtggatgccgattgcgttcaggcgtttggtcaggcggccggcgatgccccagatttcctccacggacaggcgccccagcagttgctcccgcacggcgccgggcacactgtcccagtggcataccccgccgaaagctgggttgttcttggcccacttgttgcatagcttggccagcgtcttggtgggtgctatcccgacacataccggcacgccgacgttgcggcggacggcgtttttcatggtccggcccagcgccagcagctgctccggctcgcccttcacccccaggaaagcctcgtcaatgctgtacacctccagccaagcggagtacctgccgagcaactccatgacccgggcgctgatgtccccatagagctcgtagttgctggacttggccaccagtccccattccttcgcgcggggtgcgagtttgaaccacggctcgccggtggcaatgcccagggctttcgcttcgggggagcgggtcacagcgcagccgtcgttgttcgagagcaccaccagcggcctgccctccagcgaaggatcgaaggcacgttctgccgaggcgtagaagcagttcacgtccacgtgggcgatctgcggcatctgccgcatcaaggcgggtttgctcatggccgtgcccgcggacggtgccggttagacatggtgcaggcacctggtggccacgccccagatggtcagttccgagagggcaggcaccttgatgtccgggtacttgggattctccgcctgcagcaccacgcctgtaggggtaaggcgcaggcgtttgacggtcagttccccatccagcacggcaataaccaccgagccgtccctgggctccagcgccctgttgacgatcagctcatccccgtcgctgatgccggcgcgttccatggagtctccggtcacccgtaccacgaacgtgctggtgatgtccttgatcaggtgggcgttcaggtcgatccgcccgtcgaaatagtcctgcgctggtgaagggaaccccgcggcgacaggcaccggcgagatcagaaccgagaataacgaggcgcccgcgtctatcacgcggggaccgacaataacgcccacaacacacccttattcgaatatatgttcgattagttcagtgtagtccttggccctgacaaagcgtattgtccaccaaagtgcatgccatgccgggctgggagcgctaagctgccgaacaagcagtccgatgggggagggggcggtgaagtgcgcttcgttcgtagagcactgctcgaacaccggaagcttcctcggcttgtgcgcatcttccgcacctgccaagccgtgtgcatcgccgtcctgatctcttccatgtttgcggtgtcgatattccggccagccatggtggtcatgagtgtctggctggttgtagtaaccatcccactccttgttttcgtttttggcgtgggcttgctgacttggaggaactacgaacacacggcggagatttgggccgagaacgttaggggccggggcttagacgatgcaggcttgggttggctcatggatacagggtctgtacgcgcaatcggagcagggaaagctctgctcactgccgcgatggtggtagccgtaatcatccaaacaatctggtcctgagtcattgatcctgcttggccgggtccgaactcagtgggaatcctacgtggaggtccaccaatagacgcgtggtcagggcaggtcatggttgtgggactgcggcatgttgtgaccaaggatgtcgacgacgtcattgaagaagctatcgaacggccaacggctggtggcgttggtcattccgacggcagcgatgccgaggtcggggtagatccgcagagcgttccagaagcctccgccggtgccgtagtgctcaacgaacgcgggggaccggttgccatccgccggcttgcggaaccatccgatgccgtgatcaaaccgggggcctttgtggtggatcatgcgcatctggcccaagtcacccagctgcccggttccaccggcaggaccgggatttgggaggtgggctgcggcgagcttcacggcgtctgatgcgggcccgatgagtcccccgtaagcggggccttcgacgaggaacgggcgcaggctgagggcacgtccggcgctggctccagcgatgcccgcggggagcagggccgcaaccatggggtgcgtcatccgcggggaaaggatatagccggtggccctgggtccttcggtgttgaaagtgaacccggtgtggtccatgcccagtggctgaaggaccaggtcggtaatgacttgttcgaccgactggccggtggctgcttcgattaccaggccagcgatcaggtatccgatgttggagtacgatgctcgaccgcccggagttcggcggggcttgccgtgtttgcgcacgatgccctccagcaggcccggcgttggcgcctgtttttcggggcggatccagcggaggggaagagggtttggcaggccggccgtgtgcgtgagtagctggcgtactgtgggttgtccatgctggcccggatcgtagctgggcagatattcaccgaccaaggcgtccacgtcgagctggtcggcagcgtgcaggcgcatgatggcagtggctgtggctattttggtcatggagaaccatgggtactggtcttcggcgcccgctgcccggccgtcggagagccgggcaatgccgacggcgccggacccaatgatgccgtccgccgtagcgaccgcataggacaacgccggtgccttgaaaccttggatgctggaagcggctgcccggagtcggtcctcggtggaaggctgcatggggtccgggttgcggttgttcacgatgcctcttctcgcccgtgattggtgctgctgaagtggtgctgccctcccgggacagcaccactccagcggctggctggaaatacgagtcggctgcttagccggcgacggcgggccgcaactcccgcaccaccgacggcgtgaacatcgccccggtatccgggaaggaaggcacctggatgcgggcgtgggtgtggacttcatgcaccgtccgccgggtgtgctccgcgatctcttccatggtggccacccagatgccgtccatccccttgacccgctcaatcagccgctccagcgccacggccttggagggccggccggagatgaacgggtggttggtgaggacgaagcagctgccctgcgcatggtgcgcctccgcctcaagcgtccacatctccagcaccttcgccgggctttcgatgacgccgctgccggtgacgccggggtagaacgcgtactgctcccagtcgtccagcgcccagtccaccggaatctccacaatgtcccgggagtcgtccggggcgacgctgaagcggtagggggcatcgccgtcgagcaggcttgaatcgtagaggaagccgcggtccgccagaagggcgggggagtgccagttcagttcccaccacggcgcccggtagccaacaggcttaaccccagccaccttggccagcgcctccaggccgcggtcgatgtagcgtgcctccgtctcggcgtcgatgccctgcatgggctcgtgcaggtagccgtggtgggccacctcgtgccccgcgtccacgatgcaacggacggtgtccgggtagcactcggccgtgaagccggggacgaagaacgtggcgcggatgtcctgccgctggaggatctgcagcagccgggggactgccaccttgggcccgtaggactggtgggtcatcagggacatccggctggtgctcttgggatcgtgcgcgatagtgcatgattcagcgtcgacgtcgaaggtgaacgaggctgccgcctgcttgccctcgggccaggtgatcgggtgggcggagtccgggaatgcttcaaaggtcatgtcaggtgctcctaggttagaggccggccggggcgctgggccgggcagggattccggccagggccggggaaggctgggcgtcggcgctggctgccggagcggattcgaggaacttgcggtgaaccctcgggcccaggatggcgtagcttgtggcgctcgccagcccgccggccagccaggacaggtcccagccgcccagggccacggcgatggggccctgcatggcgggaacgaggccgtacataaacagccaggtggcgaagatgcccaccaggagggaggtgactcccgcccagttgacgccgggcagccgcttggtgccgacgccgtcgaacagccgtgcggggttgccgggccagcgcttctcgatccagaagtagtgcaccagcatgacgccgccccaggcggccacccaggccaccagcccgatgagccaggcgtccaggaccgctgcgaagtcctcctggaagatgaagaagacgacggcgatgagcgagaagatgccgacgaacaggttcagcttgcggcggctgatggtgatgtccagggactgggtggccaccgagaaggtgtagatgttcaggatgttggtggcgatggggccgtgcagcaccatcagcaggacgggcagcgcgaggacgccgaagttctgcacgatgagctttccggggtcgatttcaccgctgttggtggccaggctggcacccaggacgccaagccaaacgacagggatgaactggcccaggacggaggccaggtagaccttcttcttggggacttcggtgctgacgaagcgggagtagtcggcggcgtacgtgaaccaggtgataccccagccgatgccgatggccgtcatcacggcgctcatggcagcgatccgctcggagccttccaggatgttgcccgcggggccggcgtaggcccagtcgatcttcatgccgaaccaggcgacagcggacatgacggccaggatgatgatggtgggcgggacggtccacttttcaaaggcggcgattgccttgtagccaaaccatgcgatggccacctgggtggccatgatggccgttgcgacgccgattttccaggcgtagttctgtgccgtgggatccacccagccgagcgttccgaacagtgccatcaccaggtccaggatgatccaggtgttgacggcacaccagccgatcaccaggagggcctggatgcttgcggggaggtagtttccgcgccggccgaaggctgcccgggccaggaccatgccggtggcgccggtcttctggcccagcaggacgaagcagccaaagagcagcatgccgatcaggttgccgaggaccaggacgatgacggtgtccgcgaaacccaaccccaggtggattccgagggcgcccagtacccagttgatgggggcgaggttggcgccggcccagatccagaactggcctgaaaccttgtgcgtgcgctgggattcgggaatgggctggagccaggcttcgcagtcttcggccggcgccattgccggcccagactgcttcgtggagaggttgtcttgcatggggaaagcctccataagtgaaagggatagatccagattatgtggctcatgccacaaccaccacatacaatgtgtcgtgaagatttgccttctatgcgacggagtgtcatgccgatacggctgcaggatgttttgaaacattccaccttcacccccgcggatccagtaatccgcgcggctgctgccattgcggcgcagacgcagctgcgctggatccactccagtgaggttttggacatcgcaccgttacttggcggcggagaactgctgctcaccggtggccaggccctggccgcggcaacggacaagcggcgcaccggctacatctgggagttggcggaacggggagtggccgcactggccatcgagacgggcgcggccctgccgtccattccgtcctccatggtgggagcagccgaggccgcagggcttcccctgatagagctgcgcaaaagagtgcccttcgtgggcgtcatggaagccatcaattcgttgctggtgagcgagtctgctgcgcacctgcaacaggctgaccgggcaagccatgccatggcggtggagctggcccacggtggaagcctcgaccggatcctggccgtcctcgccgacgccaccggtgcggaagttgtcctgacgtccaacgcgggggctccgctggcaagcgcacagcctgccggccataccgctgacgccgaaccggcgcccgcgggggccgccgaccaggaccgggcacccaccacgcatattgatgtgtccgtgcggggcataccgtcagcgcgtctgagcctccacacgttggagggaggagacgtgaacctggcaaggattgccgggaaccgctcggtggacattctggcactggccctgctgcagcgcgtgccgcccggcctgaaggagatggcgggtgccgcactgatccgcgccgttgattccggtacgcaaaactggcggctccagcagctcgccccggctgcgggcattcccccggccgcgcagctggtggcggttgtgatccgttcccctggctcccggcagctccgaaccacagtggagcagctgctggaccgggtgggccggcacagtgccagctacgcggataacgaggagctgctggcgctcgcggcgttgcggaccggtaaagcgcaggaggaccggagcgagatcctggccgggctccggacactcgagttgcctgaaggcagcatcagtgcggtaggcccggtggcctccgggatttcgtcggcaccctggtcgctggcagaggcacggctgaccctggatattggagcccgtgatgaactgcgcccgtccggggcacggttggccagtgcggccctcgacgcagaggcgtttgcggtggaacggatggccttccattcccttgatgcggccaggcgtgaggactttgtgcgccaacagttgggggccgtccttgactacgatgcgcagcgccgctcgcagctggccgaaaccctgcgggtatggctggactccggctgcaacaccgcccaggctgcgcgggagctgcacctggagcggcagtccatgcaccagcggctgcaacggatcttctccctctgcggcggcgacccccgcagcaccggccgcctcgccgccctgcacctggccacccgcctcgccgccatgcactccgactaggccccaacgctctctcccttaatgcccctcttttggcgatcctctctcacttaacgtcgggttccgcgcgatcctctctcacttaacgtcgggttccgcgcgatcctctctcacctaacgcacgttttgggcggacgctctctcaccctggcaggtccaaccgcattcctgtggataacttctgcagccggacgccgtctcgggtcacaatgccagcatgcgaaagcacgattccctgcccctgccgttggcagcggctcccttcaccttcggctcagccctggctgccggcgtcccgttaagcaggcttcgccgcaaggatgtgatcaatgtgggccgcggactctaccgtccggcgggctgggattttgacctggaaggcgcggccagggcgttatccgcggcgtcgccgggagcctggatctcacatgtcaccgcggcccggcttcgatgccaagtactgccaccgtggctggcggactcttcggaactgcatctgagcaagccgcgatcgctgccatcggtccgccggaagggcatcttcgggcataccgtactggcccttgaagatgaaattgaactggtcgatggcatccgcctgagcacccggtctcgcacctggcttgatgtggcacggatcctgccgctccaggacctggtgagcatgggggatcaactcatccgcattccacggatggatttcgagggaagggcgcagccttacaacaccctggcaggccttcgcgcacttgtagaccggcacccgaatctccaaggcatcgtcagggcccgtgaagcgttggaactgatgcgtgtgggcgccgactccgcgccggaaacgctgcttcggctggctattgccagcgtcggcttacccgagcccgaactccaggtgccgttgcgcgccggagacgcgcggtcgccgtcggccgatctcggctatcgccatcgccgccttgcgatccagtacgacggcggacatcacctcggggaggcccagatcttcagcgacaggagacgggacaaggccttcgaatcagccggctggacggttctcgtcttcgacaaggacgatcttgctgacgaatttcgccgcgcagtgcaagggatcaaacgggcactccggaacggttcgcttgaccacccccaggcgtcggggttcgccagcggggcctgagcgtcaaaggactcttgtgcaatgacgacggcggcgcttaaggccgtggcgctccctcaccaggggtgagagagcgtcccgggaaagcctgcgttaagtgagagagcgtcgggtgggggcggggctagcggaggaccaccgtgcggttgccctgcaggatgacccggccctcgcagtgccagcgcaccgcgttggacagggccttgcattcggtgtcgcggccagcggccaccaggtcctcgggcccgtaggtgtggtccacctccacggtctgctgggagatgatcggtccctcgtccagctcgctgttaacgtagtgggcggtggcacccacggtcttgactccgcgcgcgtaggcctggtggtacggcttggcgcccttgaagctgggcaggaacgagtggtggatgttgatcgccttcccgtccagcttccgggtgaggttgtcgctgagcacctgcatgtaccgggccaacaccacgagctccacgtcgaactcgtccaccagctccagcagccgcgcctcggcctcaggcttcgtatcagccgtgaccggcacgtggaagaacgggatcccgtgccattccaccagcgtctggtggtcggtgtggttggacaccacggccaccacgtccaccggcagctcgccgatgcgcgcccggaacaggaggtcgttgaggcagtgcccgaacttggacaccatgatcagcacccgccgcttcgagccgtgcggctcaaggcgccaccgcatcccaaaacgctccgcaacgggaccaaaagcggcccgcagcgtgtccgcggtggaggaatcgccgtcggacgcaaaatgcacccgcataaagaagtgcccttcggagcgctcgccgaactgctggttatcgatgatgtcgcagccgtgctccagcaggaagccggacacggcatggacaatcccgggcgattcagaacagtccagcgtgaggacatgctccacggtggtcacgggcgcggaaagggaagtttcagtctcaattgcggtcatggttcagcactcgatcacattcacggcgagtcctcctcgggaggtttccttgtacttggttttcatgtcggctccggtttcgcgcatcgtcttgatggctttgtccagggacaccttgtggctgccatcgccgtgcagggcaaggcgggcggcgttgatggctttgacgctggcgattgcgttgcgttcgatgcaggggatctgcaccagcccgcccacgggatcgcacgtcaggcccaggttgtgttcaatgcccacctcggcggcgttctccacctgcgcgggggagccgccgaggacctcgcagagccctgcggcggccatggagcaggcggagcccacttcgccctggcagcccacctcggcgccggagatggaagcgttgatcttgaacaggattccgacggcggccgcggccagcaggaagcggaccacgccgtcgtcgttggcgccggggacaaacttcacgtagtagtgcagcaccgccgggacgatgccggccgcgccgttggtgggcgccgtgacaatgcggccgccggcggcgttttcctcgttcacggccagcgcgaacaggttcacccattccatggcccggagcggatcggtcacgccggtgtccgccgtcagggtctggaacaacgacggcgcgcggcggcggacgttgagcccgccgggaaggataccttccgcggcgcagccgttgtccacgcattcgcgcatgaccgcccacagccccagcagcttctcccggagctccgcttccgtccgccaggttagttcgttggccagcatgacgtcggagatggacatgccctcgcgcttgcagatctccaggagatcgtccgcggtggcgaacgggtagggcaggacggtggagtctgccaccaccctgtctgcggcgtcggcgtccccgtcaacaacgaagccgcccccgatcgagtagaagctccgttcgctgaggactgccccggcgtggtccagggcgcggaaggtcatgccgttggggtgggccgggagggacttgcgccggtgcagcagcacgtcctcgtcccagttgaagtccacccggtggtccccgccgatccacagttcggcgtcgagggccgctgcggctacctggtcgtcggccgtgaaggtgtccacggtttcggggtccagtcccttgaggcccaggaccacggccttgtccgagccgtggccccgcccggtggcacccagcgagccgaacagttcagcctgcacgcgccgggtggagctcaggtgtccgtcgcccttgagtccatcggcgaacagctttgctgcccgcatcgggccaaccgtgtgtgacgacgacggcccgatgccaacggagaacaggtccaggacgctgagggccatttaggggacctcaggcgaggcgtactcgcgcattgcatcgaggagccagcggcccaggaaatcggcgaaggacgcgcgggggaagagccggaacgtctcctcgccggtcttccacagcaccacggggatgttgccgatttcggtggacagtgccgtgcccgccaacagagaccgggggtgcaggtccagcgagcagcccttctccaggacggcccgggcccgcggcccggtgagctcgaacgtggtgcggttggcggaaaggtccaccacctggccggcgccgtctccgagggccccgcggagcgcctggatcagctcgccgcccagggactcgtgggcttcccgtggggcaaccaccaggaactcttccgggccaagccacagcacggaggtgtccctggttccgctgacgctgccgcacgtggcgggcaggcccccggtgacggaagcaacgcgctgtccggcgtcgctggagcggttgacccggaggcccaccatggtcaggaaagctatttcagacagttccactacgccgcggacggagccggtttcaaaatcggcccggagctgggcggcggggctgacccggagggagaggttcttctcgtaggaggttgcgggtgctgctgtttcagccatctttgcgggtcccttcggggtcaaaaagtacggtttcggcgacgacgacgtccaccagctggtcgccggcggcagccaccagggtttcgccgatgcggttgcggccgttcttgatcagggccaggccaaaggacctgccgagcgccgcgctgtggtagctggaagtgacgaagccttccatcgggaccggcccgtaggcagggttggtggaacggcccttttcgacgagctgggtgccttccgggagccggagcgtgccgtccaccggcagcacgctgaccaggtgcttgcggtcctcgcgctgggcatctgcccgggcgtaggagcgcttgccgatgaattccttggccttggagaccacccattccatgccggcgtcctgcggggtgatggtgccgtccgtgtcctggccaacgatcgggtagcccttttcggcgcggagcacgtgcatggtttccgtgccatacggggtgatgttgaattcggccccggcggctgccacggcttcccaggtgttcagcccgtaccaggacggcacgttgatctcgtaggccagttcaccggagaaggagatccggcagatccgggcgcggacgccggaggccagggtggtttcgcggaaggtcatgaacgggaaggcttcggtttccagtccgccgttggcggccagttccggtgccaccttggccaggactgcgcgggatttgggcccgacgacggcaatggtgctccactgttcggtcaccgaggtgcagtgcacgtccagttccggccactcggtctgcagccattcctccagccagtccagcaccttcgcggcgccgccggtggtggtggtcatgaagtaggtgtcgtcgtcgaggcgcagggtcacgccgtcgtcgaagatcatgccgtcagccatgcacatcacgccgtagcgagcggaacccggggcgagcttcttgaacgcgttggtgtagatccggttgaggaactcaccggcgtccttgccgcggatttcgatcttgcccagggtggtggcgtccatgaagcccacggactcgcggacggcggcgcattcacgcagcactgcagcgtccatgtcctccccgtcctgcgggtagtaccagggccgcttccactgccccacgtcctcgaacagggcgcccttctcgacgtgccaggggtggatggacgtcttgcgggcggggtcgaacagctccccgcgctggcgtccggccaatgccgcgaaggccacgggcgtgaagggtgcgcggtaggtggtggtgccgatgtcgccgatgccgcgggaggcttcgccggcggtgcgcagcgctgcggcgatgacgccgattgcgttgacgccggaggtcttgccctggtcattggcggtgctgatggaggtgtagcgcttgatgtgctccacggaccgcatgccggccccggtggagcgcagcacgtcggcaaccgactggtcccgctggaagtccacgtagtgctggtgccagtcgtccggggttccctgctcacccgggaccagccacagctggcgggtgggggccgaggccttcggctcggtgagcggcacgggcgttgtgccggatgcgaacccggccgcgatggctgcggatgctccggcggagatgccctcggccaggcagtcggccagctcaaagctgccgcgtccggagccgatggtctgctggttcggaaccacggtgctgggcacgaaagcggccagctcgtcatcccagcgcagcttgccctgccgctgcgagtgcaggtgcaccagcgggctccaaccgccggacacagccagcaggtcgcaggcgatctgctcgatgcccgaggtgagctcgccgtcgtcgttaatgctgcggacggtgacgccgtccacgcggccgtcttctgactgggaagtcgtgttggccacggcgctgccgatcagcacccggatgccggcttcgacggcggcagcggccactgcggtgagctgcggacgggcgtccaccacggcggccaccttgacgccggcggcgcgcaggtccgcggccacggcgtaggcgctgtcattggtggtgctgatgaccacgcgctgcccggcggccaccccgtagcggttcaggtagctgcggacggcggaggccaggatgatgcccgggcggtcgttgttctcgaacaccaggggacgctcgtgggcgcccggtgccaggaccacctggttggcacggatgtgccaaatccgctgccgggacactccggacgcggcgggtgaggagaggtggtccgtgcggttctggacggcgatcacgtagttggcgtcataggcgccgaaagccgtggtgcggttcaggaccgtggactcggcgccggagacgagctcggcttcgacgtccgccacccattccaaggccggcttgccttcgatggtctcagcgagttccggtgccgttgacccggacaggagggacccgcccagctcgggctggtcatccagcagcatcacccgggcgccggtgcggacggcttcgcgggctgcggccaggccggcggggccgccgccgaccacaaggacgtcggtgtggacgtacttcttgtcgtactcggcgcggtcctcctcgggatccagcttgcccaagccgctgagcagttccgccttcaggccgtccaccagggtgacggtggtggcggggagcatggactcggcaacgtcgcccgggaagcgcgcagcgatcttcaccatcgcgttggattcctccaccccggcggacatgatgccgcggggccggtcctcgtagagggagttgccggcgttgatccggccgttggcgatcagggccgaggcgagggtgtcgccggggtgcccggtgaattcctcgccgtccacggtgaaacgccaggagatggtgcggtcgatgcgtcctccggaagcgaggcgggcattctgggaagtcacttggttgctccttccggggcggtggtgctggcgggtgtattgctggtgccggagatgctcgtcccggtcgtactgggtgccgccgtcccggtggtggtgctgtccggggcgaggctggcggtgccggtttcggcggtcaccttgccggcggcttcggggcggggcgagcccatcgggtagacggcctggatttcgtaggtgacggtgtcgcggagcatgttgaaccactggcggcagccggtgctgtggagccagcgctcggcgaaggcgcccttggtgttgtcccggtagaagaggaactcggcccactggcggtcgttcagttcgttcgggttttcggggtagggcacgtgggcctggccgccgtagtggaattcggtctcgtcgcgggagccgcagttggggcaggagatgagcagcatgtgcgtcttctttctaaagtgcagtgttcgctggcggctagtgggccacggcggcggcgccgtgttcgtcgatcagcgcgccggtttcgaagcgctccagcgcaaacggcttgttaagcctgtgcggggtgccagtggcgatgttgtgcgcgaaggtcataccggccgcgggagtggccttgaagccgccggtgccccagccgcagttcacgaacatgttttccaccggggtgttgcccacgatcggggaggcgtccagcgtggtgtccacaatgccgccccaggtccggagcacgtgggcccgggcaaagatggggaagagctcgacggcggcggccatttggtgctcgatcacgtggaatgagccgcgctggccgtagccgttgtaggaatcgacgccggcacccatgacaagttcgcccttgtgcgcctgggagacatagacgtgcacgtggttggacatgaccaccgtggggtggaccggctcgtgcagttcggagaccagcgcctgcagggggtgggactggatggggagccggaacccggccatctcggccaggaccgagctatgcccggcggcggccaggccaaccttttcggtgttgatggtgccgcggttggtcttgacgcccaccacgcggttgccgtccttgacgaagccggtgacttcgcagttctggatgatgtccacacccatttcgtcgcacttgcgggcgaaggcccaggcaacgtggtcgtgcttggcgatgccggcgcggggctggtacgtggcgcccatgacggggtagcggatgttgtcgttgatgttcaggatggggcagagttccttgacctgcttcgggtccagccactcggcgtccacgccgttgagcttgttggctcccacgcgccgcatgctttcacgaacgtcgcccagggtgtgggccaggttcatgacgccgcgctggctgaagaggaagtcatactcgagttcctcgggcaggatctcccagagcttgagggcgtgctcgtagatggccgcgctctcgtcccagaggtagttggagcggatgatggtggtgttccgggccatgttgccgccggccagccagcccttttccaggacggcaatgttggtcatgccgtggttcttcgccaggaagtaggcggtggccaggccgtgcccgccgccgcccacaatcacggcgtcgtaggaggacttgggctccgggttgcgccagaggaagtcggggtgctcggggaggaggtctgcactcactgggctgctccaatcatgtcgttttcgaatgcagcaagctcggcgccgccgtcgttctgggaaaggtgggggtagagggggaacttctccgccagggcggtgacgcgggcgcggagttcgacggcggtgctgtcgcctaaggtgccgttacttgccgaggcgatcagcgccgtcgcgatgatgtccgctacttcggcgaattcctcggcgccgaagccgcgcgtggcgagggcgggggtgccgatccggaggccggaggagaccatcggcgggcggggatcgaaggggacggcgttgcggttcacggtgatgccgatgcggtgcagggcgtcttcggcctgctgtccgtccagctcggaattgcggaggtccacgaggaccaggtggacgtcggtgccgccgttgaccacggagattccggccgcggcaacgtcctcgcggaggagccgttcggcgagaagcttggagccctccaggacacgctcctggcgttccttgaactcgggggaggcggcgagcttgaaggccacggccttggcggcgatcacgtgctccagcgggccgccctgctggccggggaacacggcgctgttgatcttcctgccgtactgctccttggccaggatgacgccgccgcgcgggccgccgagggtcttgtgggtggtggtggtgacgacgtcggcgtacggcaccgggttcgggtgcaggccggcggccaccaggcctgcgaagtgggccatgtccaccatgaggtacgcatccaccaggtcggcgatgcggcggaactcggcgaagtccagctggcgggagtaggcggaccagccggcaacgatcagcttgggccggtgctccagggccagcgcctccacctcggccatatcgatgcggagatcggattcgctgacgtggtaggggaccacgttgtagagcttgccggagaagttgatcttcatgccgtgggtcaggtggccgccgtgggccaggctcagtcccatgatggtgtcgcccgggttcagcagggcgaacatggcggcggcgttggcctgcgcgccggagtgcggctggacgttggcgaattctgcgccgaacagtgccttgacgcggtcgatggccaactgctccacaacatccacgtgctcgcagccgccgtagtagcgcttgcccgggtagccctcggcgtacttgttggtgaggaccgagccctgtgcctccatgacggcggagggggcgaaattctcggaggcgatcatttccagcgtcgactgctggcggcccagctcactggcgatggcctgctggacctcgggatcgactacggaaagtcgctcgttcaactgctcaaccacggatgctcctttgaaataccacttgctgtctaactgatatatcagtgtgagttcaatggtatgatcgggatcacagcagagtcaatagctggacgaaagtgacgcgaagcccgccaaggggcacgccctcgtcacctcagcgaagaacggagcggcgcgttgaatgcacttcttgccctgcctcaggcggaggacgaggcaccgtcccaggcggaggccgcctaccggcagctgcgggacaaactgatcatgctggaaatccgtccgggcgagccgatcaacgagggccaggtggcggctgaactcgggctcgggcgcacccctgtgcgcgaggcaatcaagcggctggaggttgaccacctggtcatctcctacccgcgccgcggcaccttcgccacgaatgtggacttcacggagctggcggacgtctcggaaatccgggagctcctggaaccgctggccgcgcgccgggctgccaaaagggccagtgaaggcatgcgccgcgaactgctgcaggtggccgatgccatcgcggagctggggccgggccagggggagtcacgcgacctcatgcgctatgacctgatggtgcaccggctgatctacaaggcggctgcgaacccgcatctggaaagcaccctgatccgctacgacaacctggccacccgcatctggtgcgttgtcctggacaaggtgccgtcagtcagcggccacatcaccgagcacgtggacctgctcaaggcggtggccgccggtgatgcggataaagccgccgagcttgccctgaaccacgtcaccagcttcgaggaaaccatccgcaaggtgctgtagcccgccccgggaccctctctcacttaacgccgcatgaaccgggaccctctcgcacttaacgccgcataaaccgggaccctctcgcacttaacgccgcccaaaccgggaccctctctcactcctgaaaggatggaagaacgcaacgatgcccgctgtcacccggaacgcacaggaccgcactgtcaggttcggcttcgccttcatcggcgtcctgctcattgcggtcaaccttcgggtgtcctttgtcagcgtgggaccggtcctcgcgaacatcagctccgaccttggcctgtccagcgctgcagcagggttcctaacgggccttccgctcattgctttcgcagtcttttcacccgtggcgcccggcttcgcgacccgcctgggcctcgaccgtgcgctgtggatgtcactgctgttcctggccttgggcattgcactccgctccttgcctgttcccggattcatctgggtgggcacagcactcataggcctcgcgatcgctttcctcaatgtcctggtcccttcgctggtgaagcgggactttcccacgagggtcagccagctcaccggaagctacaccgccacccaggccgcctttgccgccatgggggcggccgtcgtcgtacccgttgcccagacgtcccctgctggatggcggcttgccctcggcatctgggtaggacttgccctcatcgccatggcggtgctcctgccgtggctgcgccggcacagctccggcgccatgaatgccgccacgccggaagtctcccaccaatcgccttggacctcggccctgggctggcaggtgaccattttcatggggctgcagtcgatcgccttctacgtcctgatggcgtggctgcctaccatcgaacaaagccgcggggtcccggcgactaccgccggcatccacctgtccgttttcctgctggtcagcgttttcgccagcctgctggcagggggcatccttcaccgggggccggaccagcggctcgtttccttcgccagcggcgcggtgatgattgtgacgttcctgggcctggcgctcgcaccggacctcatcctgctgtgggtcctcctgggggcgatcgggtgcggaagcctcattgtcattgccctgtcgctgttcagcctccggaccgtgaactatccgcaggcggcatcattgtccggtatggcgcagtcgatgggctacggcctggctgctgcggggccggtgatgttcggcgggcttcgcgatctgagcggagactggacgcttccgctcctggtcaccgcgggcatcatggcggtcctcgccgtgacaggcgtgctcgcggggcggaaccgggtgatcagcgcaccggcatgaccacccgccgtcgtacttttacccaggtcaggcccgcgcctgggccttcaccgaggtccgttccaccgctgggcagtggattttcgcaaccccgcccgagccggttccgggcgccccgtcaagcccgagcagcatccgcacacccgcggcgcccagctcgtaatgggggagggacaccgtggacagcggggggcgcaggtgggcggcgatgacttcctggttgtcgaaccccaccacggccatgtcgtcggggatggacaggccgtgctcgcgcagaccgtcgtagaggcccatggccatccggtcgttgtagcagtaaacagcagtcacgccgcgtttgaggagttcctccgtggcacggtagccgccttcctggtccggataggcctccagcaccagggcggggtcgaaggggatccctgccttctcaagtgcctcacggtacccttggagccgcccgtccttcgccggtgccggaatggtggcgttgatgaaggcgatcttccggtgcgcgtgccccagaaggatctccgtggctgagcggccgccctgtacctcgtcgggtaccacggcccgggttcccggctcgttggagaagcagttgacaaggacgaagtcggcttcccggagcggcgccggaatgtccgtctggcggtggaaccacgtggagtagaggatgccgcggaccttgtattcgagcatcatctggatggcgtcctgctcgagctcgttgttgccctccgtgttggcgatgaggagggcgtacccatgcttccacgcctcgtcctgggctccgtggatgatctggccggcgaagggcgtggtggcaacgccgtccgccaccagcccgatgaaccgggacgtgccgctgaccagggtcttagccatcgcgttgggccggtaacccagcgtccggatggcgtcctgcacccgccggcgtgtttcctcggcgatccgggcggcctttttcttgttgaccaccagcgacactgttgctgtggaaacaccggccgcttctgccacgtcgcggagggtgacggggtgcgcgcgctccggggttttcggcgcccgggcgccagggaccggcgcctccgcaccattctccattgaactcatctgccctccttgaggagtatatccatccgccgttgccgtcatcccttggtcgccccgctttcaagtccctggatcatggccttgttgagtaccaggaacaccagcagcaggggggtgatggtcacgcatacggcggcgaacgttgccgtccagtccaccttgcccatggcgccgatgtagttctgcaggcccagcggaatggtcttcaggtcctcggacaggacgaacgtgttggcgaagatgaagtcgttccagatgaagatgctgttgaccaggaccacggtcaccacggtgttcagggacagcggcatggtgatcagcccgaagatccggtaggggccggcgccgtccagggacgctgcctcgtacgtttccttggggatgtactcgtagaacgagcagaacaggtagatggccatgggcagcgagaacccggcaagcgggatgatcatcgagaggtaggtgtccagcaggttgatcgccgaatagtcgatgaacagcgggaccagggcgatctggaccggaacgatgatgccgatcaggaacagcccgcggaccagcttgctgagccggaaccccagcacctggatggcgtacgcggccatcatgcccagcagcacgatcaggatgttcgcccccatggtcacgatgaagctgttcaggatgttccgccccaggtcccccgtttcgaaggccctggcatagttctcccacgtcagggagctgggcagggcaaagggatcaccggtggcgaagtcctgttccgtgcggaggctggtcaggaacagccacgccagcgggtacacctgcacgatcacgatgagcatgatcagcacgcgggacagcgtccggaacaggtcgggcctgcgccggcggcgctttccggacggccgggcaggtacgacggcggcgggcggggtgggcggggctgtttgggtgatcatgcgtctgccttccgcttcagcaggaaaaggatgaggccgacggcgaccaggcactccaccacgatgaacaccgagatggtgctggcgtagccgaagtccgtgctggtgaacgccgtcttgtacatgtaggtggtgagcagttccgaggactgccccggaccgccgttggtcatcaggtaggggatgtcgaagccgcgcagcccgtaggtggtggccatgatggtggtggtgatccacaccgggcggatgtacgggaagcggatcttggtgaacagcgtccaccgggaagcgccatccaggacggcggcctcctcaagctccttgggcaccgcgagcagggccgcataaatgatgagcatgtacagcccggtgaagcgccagccctccggtgcggacaccgccgccaggaccgtgttgacgtccgagagccagggccgctcgaggctgccgaggccaacccagtggaacagctggttgagcaggcccacgggctccaaggagtagatccgcacgaagaggaaggcgatggccaccgtggagatgacggctggcagcaggtagagcgtcttgatgagctcacgtccgcggcggagcgacgtgaggaggctggccaccaccagggcgccgccgagctgcaggaccaggcagatggccaggtagacaagggcgttcaggaacgcccgccagaagatatcatcggcgacgaacatccggacgtagttgtccacgcccacgaactccatgtcgctgatgccgttccaggagaagaagctcaggaacagggactggaggatgggaaagaggactgctgcgccgtaaaggagcagcggaggaagcaggaagaccaggaccgaggtccgtgacctgttgggcagcatcctgttgggttgcatggcggggcctttcggggccttgcgcgcgggggatcgctgggatcccccgtcgcgttggctacttgaagaacttcggggcgttctgcgcgatggtcttgtccatggtttcggtgaactgctcaggcgtgatgttgccctgcaccagcagcaccagctcctgctgcagccggccgttggtggtcggatccagctgcgtgtcccacggcatggcctgcttggaaccgaggccgtcggcctggtccagggccttctggtacagcggcgtggcattggccggaacaacggtttcgacgtcggtggtgggggacagtgccccggtggcggcatattcagcggggtacttttccagggcgaacttgaggaagtcgctcaccaggggatcgtaggtcttggcattcactgccatgccgatgccggacggggacacgaactcgttggccgccgtcgcggaccctgcggtggtgggaagggtgaagaagtcgatgtcgttgcggacggccgggtccagcttgtccgtggccaggctgggcagttcccacgtgccgatgttgtacatggcggcctgccccgaggtgaactggttttgcgcgtccgagtagccctgggcggagaagccgtcctggaagcacttggccttgcccagttccgccatccagttcacggtcttctggccggcgggatcgctgaacttcgcttcgcccttcttcagttcctggacgaactcggggcctgcttcgcggaacggctggtacgcaatgtagcgctccagcggccactggtcctggccgtcgatggcaatgggggtgatgcctgcgctgcgcagggcggtgcacatggcggggatgtcatcgagcgatgctggtactgccacgccggccttctccagcagggccttgttgtaccagatgaattccagctcgaactggaaggggatcatgtacagggacccgtcgtcgaagcgctggtagtccagcgctcccgggcggtaggtgtcgtagatatccagtgacttcagcagctgctcggcgtccatcatcttgccctgcttggccagctgctgggcgaagggcgtggcatctgtgtcgaacagttcgggcagcttgttggctgccgccagggtttcgagcttctggatgtaggagggccggtccggggtggtgatcaggttgagctcaaagcccgggtggtccttggcatagtcctcggcgagcttcttcatgatgttgatgaccgcgccatcggcaggccgggagagcagccacgagatctcgcgggccttgatctcgccggtggggctgacgttggacgggtcggtggagcttgcgcccccgcaggctgtcagtgccagggcggtaacggctgcggcggcggcagcgcggaaaatcttcttcattgggtcaatctcccttgattggaacggaggatgggggtggggtattcagttgtcggttcgcttgcgtacttcgaaatcggtgaccgtcacggtgccctcgccggcgaatacgcctattccgccggcgggaaggtcatagatgcgggtgctgagagccacctggcggtccacgacggcgacgcacaggtcgccgtccaccaccacttccagcgtgtggctgccgggggagaggtcgcaggggcgttccagctcgatggcgtagggcacgtcgcccgagacatgccattgggcctccccggtgatggcccggggccaccggtcgaaaaccaagcgtccgcgcttcggttcgaggcggaggacgtaggagtggtcaccgtccgggctggaccggagcaggatcccgcattccgtggtgcccggctggatgtccagcaccgctttggcgtagaactgcgtgggcagatcgttcgctgcgacggcggcgctgtaggagtccggtacgtccagccggatgggcagcgggctctccagttccagcgggattccgtcccaaaagctgtccacaagctcgtccgcgaggccgaatgccaacgtcccgtcggggttctgccgtgcctccaggacggacatggtgcctgcccactgccaggcgccgtcgtcgcaattgccttccttgctggcaatccagccgaagaagaaccgccggccgtcccgctccgccgtcttggaagcgtagaacgcacgtccgtcgatgctgtccaggtccggaactgtccacggccccgtggggctcttggccatccggtaccgggtggtgaatgtttcggaaaactcggagtagaccatgtaccaccagccgccccactcgaacacatcagggcattcatgcgtgatgtacctgcggggatcccagaacgggtccgtgtgctcccacgtcatcaggtccgtggagacgcactgggcgatgacgccgcggcggcgttcggggccgtcggagtgccgggccgccaggagcatccgccacaggccggccgcctcgtcacggaagacgaaagggtcccgccagtccgctgactcgtagccgtccggtgcaccgaacgtaagctccgggtgcttgacccacatgttcatgccgtcggtgctggtggcgtgcatgaccagctgcaggggcaggccgtccgtcccgaggttgcccgggttctgccccgtgtagaacaggtggtggatgcccgactcgtcagcaacgatgctgcccgtgtaacagttgaagtccaggtcctccatggtcccgtgggggagggcaacgccatggtcctggaactgggtgaggtccttggtagtcaccaggttccaggccgttccgggcttcgggtcggtgcggacctcctgaaggtagaagagccagaactccccgtccttctggaaagggataaggtccccaacccatgcattggcgggctggaagaagactgggtagctcatcggcgttgatgtccatttctgctaaagcgtttgatcaccatgaagctagcctgaaatggaaggctgatcaagcgttttagcaaaaattgtccggaacgttcttttcgccgatttgaggcgaggggcatttttgctgaaacgcttgaccaacaagttgtggctgggtatgttcttctgctaaagcgcttaagcagccggtgatccgatcagcgaactaccgaaggttccgtcaccccgagcgcccggcggagcagccgccccctgagaggaagtcaacgatgacacatgccttttcccgtcgccacgtcctgcaaggcaccggagcaggagcactcgccctgttcacgtccggtgtcggcgccggcgccgcattggcctcaccggcgcgcgcggcgcagggctcacagcgggccgtttaccacatgacgccgccgtccggctggctgtgcgacccccagcgcccggtgttccttggcagcaaataccacctctactacctgcactccacgcagaacaacggccagggcggctgggaccacgccaccacggaggacggcgtggcctttacccaccacggtgatgcgctgccgctgcagcccgatttccccgtgtggtccggatccgcagtggtggacacggcaaacacggcgggcttcggcgcgggggccgtcgtggtccttgccacccagcccaccggcggcatccgcaaataccaggaccagtacctctattggtcaaccgacggcggctacacgttcaccgcgctgcctgaccctgtcatcgtgaacacggacggcagggctgcggtcacgcaggcggagatcgacaacgccgaatggttccgggaccctaaagtccactgggacgcggcgcgcagcgagtgggtctgcgtgatcggccgggcacggtatgcggccttctatacctccccgaacctgcgcgactggcagcttaagcgcaacttcgacttccccaaccccgcgctgggtggcatcgagtgccccgacctgttcgagatgacggccgacgacggcaccagccattgggtgctcggcgccagcatggacgcctacagcatcgggttgcccatgacctacgcttactggacgggcacgtgggacggggagcagttcctggccgacgacgtcaccaacccgcaatggctggactggggctgggactggtatggcgcggtgacgtggccggctgcagaggcgcccgcgacgcggcggtacgcgatcggctggatgaacaactggaagtatgccgcccgtgacgttcccaccgacgcctccgacgggtacaacgggcagaactcggtcgtgcgggagctgcggctggaacggcagggcggcggctggtacagcctgctcagcagccccgtcacagcgctctcgaactacgccggctccaccaccgcgttcccggaccggaccgtgaacgggagctacgtcctgccctggtgcggccgcgcctacgagctggaactcgacatctcctgggatgccgccgtgaacattggggtctctgtgggccgctccgccgacggtgcccggcacaccaacatcggcaagtacggcgatgagctgtacgtggaccgtgcgccctcggaccttgccggcttctcgttgctgccgttcacgcgtgcggcagcgcccatcgacgccgccgcgcggtccgtccacctgcgcatcttcgtggacacccaaagcgtcgaggtgttcgtcaactccggccacacggtgctctcgcagcaggtgcacttcgccgacggcgacaccgggatctccttctacaccgacggcgggcctgcaaccttctccggcatcaccatccggtccttccagtagccggccacgcgaagcggcggcccccacgcatcggtgggggccgccgtcggcattgcagcatgttcagcagccgggggaaaaccggcagccggcaggaagaatcagatgatggcagccttcagttccttggccgccacggcgggatcatcggcgctgtagatggaaccgcccacaacggccacgtccgcgccggcgcgctgcacggccccgatagtggagatgttcacgccgccggccacggagaagggcacgcgtgcttcttctccagcgcccagcaggacgtccaggttgtagccgggcagcgcctgctcgtccaggccggcatggaactcgatgaactcggcgccgagtgcccgggcttccttggcgcgggacaccttgtccgcaacgccgatcaggtccaccaccacgcccttgttgtgggccttggcggccttgaccgcgccggtgatggtggagtcgtcggcgctgcccaggacggacaccaggtccgcgccggcgttgaaggcgatttcggcctcgagttcgccggcgtccatggtcttcatgtccgcgaagacaatcttgtccggatgggcggtcttgatggcggttacggcggagagccctgcgttcttgatcagcggggtgccgagctcgatgatgtccacggactcggcaaccttgccggccaggtccagtgcggcctcgacggtgaggacatccatggctacttgcagtttcatgtgggggtcgctttctgttgtttcctgcgttttatggtggggaaagggagcgggaaacctactcgaggtttgcgtgccgcagccagaggtcctcggccgcggatgtgtcctcgtcccacaggctttggaacaccgcctcggtggcggcgaacagcacttgctcaaagaggctgcccgagtactgccgcgtgagcgccgagccgtgatccgtcttccgggcggcagggatgatcacgacggcggcagcagcggccgccagcagggaaccttgggcggtagtgtaggcagccacgcgggcaccgtgggcggctgcggtttctgcggccttgacgacgccggcggtactgccggagccggaggctgcgaggagcaagtcgccggcgcggatggccggtgccgttgtctcgccgaccacatgcaccgtcagtcccaggtgcatgagccgcatggccgccatcttcaggaccaggccgctgcggccggcgccggccacgaagatcctgtccgccagccgaagctcggtcaccagcgcggccacctccagggggtcaacctgctccaatgctgagccgatctcgcccaggaccaggccccggttgtggtggaaggcccgtgctgttcccgtcagggcggccgggttcgcttctgtggtggcgttcatgcgcgtacctccttggatattggtgcccttccatgctcgcccgcccggggggtgggtgaaacggcatgatgggacggccccgcccacccgaaggggtaggtgcaccctgtggggcgcacctacactggatgggtggaacaccaagacgcagccctcctccagtcaatagctgccctggcaacggcgcccctgttggacatagcgcaccggctgcgcgaggctgccgccccgtacatcacgtccagcgcactggtgattttcacggaggactgcaccggccggccgcagaagaaggccggtgacgaggccatcatcagccgggtgtccatagcggagctggatgccatccgggcagcgctcgtggaagcgggcgacgccggcccctggcccggggacgccacgttcggcggcgccgtgcgccccgtcctcgcggtgtcctcaccgagcaacgcgctgctggtcctctcggacccgcagcccgtccccgccactgccgccgggccggactcgcagtggatcctgcactacctctggaccctcgcagctgaacggatccgcgaaagggtggctgatgcgccgccgtcgtacctcatcgaatcacgcgccgcctcggcggagcgcctgcgggtgaccgctgagctggtggaccagcactccaccaccctcgaaacgatgctcgcagcgctgaggtcgccttcgttgggggacgccgcggcccggacggcggcgacggacgtcgcggccagggccttggtgggcctccgcacccttagcgaccgcaccaccgacctcgtggaggaaccggtcgcttccgccttccagcgcctccgcgaggacctccggccgctgatgggcttcagcggcatcgacgtccagttcatcgaaccgccggtgaacggccgcgcgcttcccggcgaggtggcgcatgccgccagggcgattgtccgcggactggtcctcgccatggtggaccagcagggggtccgccggatccgcacgcaatgggactgtgacggcgtgaacctcctcatcaacgtgcgcgacgacggcccgggcgagctttccgcgtcggcgcctgccatggcgcgcctggtccagcgtgttgaagcgctctacgggagcatgggcgtggacgtgatgcccggctggggcgccgacgtggccgtggcaattccgctggacccgcccgcccggccgctggccgacgtcgcccagtggaacctgggggagcgcgaggtggaggtcctccagctgctggccgccggccagcggaaccgggggattgccgcgaaactccacatcagcgagaacaccgtgaagttccacctgcgcaacctctaccggaagatcggcgcatcctcgcgcactgaggcgatggcgctcgcccacagcaacggcctgcgctgatttcatcagccggtgatttcgggcgacgctgatttcacgcggcgcttgctacttgagagtattagtcatggcttcgaacaatgagcgcgaacccgacgtcgatggtgaagcgggccacggcggcgtccagtccgtggaccgtgccctcgcggtccttgagatcctggcacgggacggccacgccggcgtgagcgacattgccgaggaaatgggcatccacaaatccactgtttcgcggctgctcggctcactggtgagccgggaaatggtccaccagaacagtgagcgcggcaagtaccagctgggcttcggcatcctccggctggcaagctcgatccccgggcgcctgagcctggtgcgggaggcccgtccggtcatggaggccctggcggaccagttcaaggagacggtgaaccttgccgtgctgcgctccaattacgcggtgaatgtagaccaggcgatggggccctcaacgctggccacgtatgactgggtgggcagcctgaccccgctgcacgccacgtccagcggcaaagtcctgttggcggcactttccgcggatgaccgggaccggatcctgaaggagacggggctgccggctcggaccccccgcaccatcaccaaccgcaaagagcttgaaaccgagctgatcaccgtatcccgggacggctatgccgtgacccgggaggaattcgaaatcggaatcaactcgatgtccgtgccggtgtacagccacctgggaacggtcattggcgccatcagcatctccggcccggccttccgcttcgatccggagatggagccggggctggcagcgggcctcaaggaggcaggcctgcaggtgagcgccaagatgggctacacccgacgataatccgccggggtctccgccttggtccgtagggaggataaggacgctgccgaaagccacgacaccgcgcgccggcagcgctcagagatcctcttcgaggcgggcggtaaggatccggttggcgttaacctgcaggatgcggagcgactcctggatcagcggtgaggcgatgctgcccctgcgcaccgcggcgacaatacggcgcgtgggtttcgccctgccggtgatgcgtagccggaccacgttttcggcaccatgcaaaggtgccagccggggcagcaggccgacgcccagccccgcacccacgaatgcgatgtgggtttcccattcaacggcttcatgggcaatccgaggcgtcaccccgaccgccgtgaacgccgcggtgaagagggaatggtaggcggaaccggcggcctccgtgatccagggttccgatgccagctcttcaagagtcgctgtttcccgtgatgccagcggatggtcaccgggaatgatcacgtccagtggatcgtcgagcagcactttctgctcgaaccgcgggtcgtcctcaccataactgtcggactgcatggcaacaatgaccgccaggtcgattcgttccgcaatcaacaagtcgaagcagcgggccggttcggcctcaagaacctgcacctccagcgaagggtgtgttgagcgcagggtggcggccagcggcgcgagcaagtgggcagctgcagaggagaatccgccgaggccaaaatgggcctgcatctgatcgccggcctccatggccgcggcgcgcaggctctcccactgggcaatgaggggatcagagcccgccacgagaaaacgtcccgtggcggtaagccggataccccggccatctttcgtcagcagctgcattccaagcacgcgctggagctcccgcaactgcgcggagacggcggagggggaatagcccgtgagctccgcagtcgcgcctatggtgccacaccgggcgaatacgcggagcgtgatgagtcgcgcatcgatcatgcacctattctgcacggtaatcttcaaaattttgcgcttttcttgcagtgcttgtgaccctaatctcatcacaacaagttcttcgaccactactgctaccaaccgcgcacccgtggtcaccacgcaacaccctctacccatgcctcccgggaggaaacccatgactgcttcagtgaacgtgcccctcaattcacgcggaaaaatcgctgcatcattgcctgccgagcagctggccgaaatcaccgcgttgtttgagttccggcgcaccggctactccctcgatgctcccttctacaccgatgcttcgatcttcaaggtcgacatggaggccattttcggccaacactggatctttgcagccagcaccgccgagctgccggagccgggcgactacgtcaccgtcgactacggtccctactccctgattgtgctgcgcaacgacgacggcggcgtgaacgtcctgcacaacgtatgccgccaccgcggcgcccgcgtcctgaccgaagctgccgggtcaaccggaaacctggtctgcggctaccactcctggacctactcgccagagggcaatttgatccatgcctccgcgccgggggaaacgaagttcgacaagagctgcttcggcctcaagcgcgcccacggccgcgaggtcgccggactcatcttcgtctgcattgcggatgaaccgccagcggacttcgacgaaaccgcgaagatcttcgagccctacctggcgccccacgatctctcgaagacaaaaatcgcctaccagcagaacatcatcgaagagggcaactggaagctcgtcatggagaacaaccgtgagtgctaccactgtgacggccaccccgaactcgcctgctccctctttcccacctggggcctgacggagggtctgatccccacccaccttgaggaagtgtgggaccggaacaaggaagcccagtcctccctcgaggagcggtgccgccgctatggccttccctatgaggtggtcgagcagcttgacacgcgcattgcgggaatccgcatctcacgggaatcactcgatggagagggcgaatcgttctccgccgacgggcgcaggctttccaagaagctgctcggcgacttgcccgacttccgccttggccgctgctccatgcacctgcagcccaacagctggttccattttttgggcgaccacgtcatcacgttcggtgtgttccccatcaacgaacaccagagcctcgtacgcaccacctggctggtggctgacgacgccgtggaaggcgtcgactacgacctggagaagctcacctacacctggaagcaaacgaacctgcaggacaaggcgttcgtagagctctgccagcagggtgccggcagccccgcctacgagcccggtccctacatgaagagcgaataccaggtcgaggcattcatcaactggtacgtgcagcgcgtgcaggagcacttggcatgattgaactcctgactgaaacggcaatccaggaaccacagcgcattcggggtctagagatgccgtggaacagggtgatgggaagcaccgagacgcccgcccgggcagcccgtgcattgggcccatggcatccgcaggagttcatggccgaatgcgtcgagacggttcccgaggccggcggcatgatgaccttcgtgttccgccgctgtgacggtgcgcccctggcgttccgtgcgggccagtacgtgaacgtcgcatttcccgtgaatggcgaggaccaggaaccggcggaccgcagctactcgctgtccagttcgcccacccagccgtggaccttcagcatcaccgtcaagtgtgaccccacagggctggtctcgccatgggtgcacgagaacgtcaaacccggcacaattcttgaaatgctgggaccggtgggagcattccacctgcccgatgccgaccggcgggcacgctatctcttgcttgccgccggcgcaggcatcactcccatcatgtccatggtgcggacaatccactccctgcccggacacgccgatgttgtggtgctctaccacggctcggatgccggcggctttgccttccaccgggaattggcttacatcgcctccgtggactcacgcgtcaaggtttactactccctgggcgaccgcaggttaccggaggggtgggaaggactcagcggaaggctgacggcggccatgctcgaggaggtggccccggacgccaacggccgccaggtgtacgcgtgtggtcctgagggttacctgaacaccgccaccgagctcctcaaaaaagtcggtgtcgacgacacttccatctacatggagttcttctcgggagaccgccagatgctccttgaataccaggcggaggtggcacttgcagccgacgtcgcggaggagatcgcggaggaaatcgccgaatccgccgaggactactttgaaagccagccagccgcgttcggcctctacgagcctggttacgacgccgacggaaccctgcaggcctcggggctgacgctggaaatcgtcgaaccggaggggcccggttccgacccctccgccgacagccccggcggggagccggaagccggttcccctgatgcctcgagcttcgacacggtgggaacaggcagcctcaccatgtccttcatgcgtaccggcatcaatgtgcggatcgaccccaccgagcgcatcctcgaggtggcccagcgtgccggcgtcaggattggcgcgaactgcaaggaaggcatgtgcggctcctgtaaggtcgtcaagctttcaggggatgtcgagatgaaccaccagggcgggatccgggcacgggaaatctctgcaggcaagttcctgccctgctgctccaccgcgcagacggacctggtgatcgatgcctgaccccgttccgggaccactgtcaaggtgcagccgaaaaccctgaaatagggcttaagaaatcgaaaagaccttgacacgcggttgtggcccgcgccacgctgttgcttattacgagacgcgttgatccttgcggaacaaccgacccgctaagaaccaaattctgctcactgaatgccaagaagctcgaccttccgaccggcctggggacgccggagtacaacgcccaatgaattcaaaccaaaggacctgccatggctttgaacagcgacatccgcccggatgcccaaacccctcttgagcttaaggatccccaacccattcctgcaccggagaactctccgtccgcccatgattcacacgtcgcggaggacacccagcagatcatgcaggaactccgccagaccaaggccgagcaggctgtcgcggagcggcggaaccgtaagctcaccctcgacaaggcgaccttcggcatcaccggcatcctggccctggcgtttgtggcctggggcttcctgggccgggacagcctggccgcaacctccacgctggcccttgactgggtgatggaatacaccggctggctctttatggtcctagcctcgctgttcgtcgtttttgtcctctggctggccctcggaaaatggggcaacatcccgctgggcaaggacggggaacggcccgagttccggacggtctcatggatcgccatgatgttcgccgccggcatgggcatcggcctgatgttctacggcgtggccgagccgctgtaccactacatcgcaccaccgccgggcaccgtggacggtcggacgcccgctgccatccagacggccatggccacctccatcttccactggaccctgcatccctgggcgatgtacgccgtcgtcggaatcgctatggcctacggcacgtaccgcctggggcgccggcaactgatctccgcggcctttacgtccctgttcggcatcaggacggtggaagggccggtaggaaagttcatcaacatcctggcaatctttgccacgctgttcggtacggcggcctccctgggactcggcgccctgcagatcggcagcgggctgagctcaaacggctggatgggcgaggtgggtacgcccgtgctcgtggccattgtcgccgtcctgaccgcctgctttgtggcctcagcagtgtccggcatcagccgcggcatccagtggctgtccaatatcaacatggtcctggccgtggtcctggcgctcatcgtcttcatcgccggccccacgctcttcatcctcaacctcatcccggccgcggtgggcgactacgccagggacctggccgagatggcgtcccgaaccgaggccgtgggggacgaggccctgcgcacctggatgtccggctggaccatcttctactgggcatggtgggtgtcctggacgcctttcgtaggcatgttcatcgcccggatcagccgcggccgcaccatacgccagttcgtcaccggcgtcctgctggtccccagcgttgtcagtgtcatctggttcggcatcttcggcggtgccgcgttcaaggtccaggagaaagcggaccaggcgaaccagcctgggctggtggccatgactgacggagcaccgtccatcgacttcgacggagcactgttcgacctcgtcaacaacctggccatgccgggctggctgaccggagcagtcattgtcctggccatggttttggtgggaatcttctttgtcaccggcgccgactcggcgtccctggtgatgtcctccctgagctccaacggttctgccgaaccaaaacgtgggctggtcatattctggggcctgctcaccggcgccgtggcggcagtgatgctgctcgccggaggcgacaagccctcggaggcgctgtccggcctccagcgcatcaccatcgtggcagccctgccgttcgtgctggtcatgctgctgctctgcttcgccctggtgaaggacctgcgccgggatccgctgtccctgcggcggcggctggctgactcagtggtggagcgcgccatccggaccggcgtggaccagcacggcggcgtccagttcgatctcgttaccaagcatcaatgtgatcagcactgttcggacgacggcgcctgcgccgcttccccggctgacacccaagttcccgcaaagaaccaggagtagaccatgaccacagtcctcgagggccgccccactgctaacgcgacggcggaagccggcgccgtccccagcgtccgcagcaccggcaccgcacagtacgtcctcacgctggcgtgcccggagcgccccggaatcgtccgggcgatcaccgcattcctcgctgatcgcggcttcgacatcgttgaacaccagcagttcgatgaccatatgagcggcaagctctacctgcgcacggccttcaccccgggagacgaggaagtttccgcggaaggcctcagcgcggagttcgccgcggttgctgatgagttcggcatggagttcgccatccacgacggcagcccccagcgcgtgctggtgatggtctcgaagttcggccactgcctcaacgacctcatcttccggtggcgcgccggaagcctgggggcggagatcgccgtcgtggtgtccaaccatgaggacctccgccccatggcggaagccgccggcctgccgttcatccacgtcccggtcaccgcggacaccaagccgcaggccgaggcgcgcctgctggaactggttgaggagtaccaggcagacctggtggtcctggcccgctacatgcaggtactctcggacggcctcagtaagaccctccgcggacgcgccatcaacatccaccattccttcctgcccgggttcaagggggccaagccttaccaccaggcctacgaccgcggcgtgaagctcatcggagccaccgcgcactacgtcaccgcagacctggacgagggcccgatcatcgagcaggaagtgttccgcgtggaccacagcctggacccgaatgcactggtcactgtcggcagggatgccgaatcgcaggccctatcccgtgcagttaagtggcactgccagcacagggtcctgctcaacaacacccgcaccgtcgtcttccgctaacgcgaacaccaggagaactacttatgagcgcatcaccacgcgttgtcatcatcggcgccggcatcgtcggaaccaaccttgccgacgaactcgccacccggggctggaccaacatcacggtggtggaacagggcccgctggaacttgccggcggctccacctcgcacgcgcccggcctggtgttccagaacaacccgtcacggaccatgaccgaattcgccacctacacggtgaacaagctgctcgccctgagcaaggacggcgagtcctgcttcaaccaggtgggcggccttgagctggcaaccacccccgagcgactggccgacctcaagcgcaaaatgggcgtgatgacctcctggggcgtcgaaagcaggatcgtcgacgccgacgaatgcgagaagatctaccccctcctgaacaccggcaagctcactggcggccgcgaggtcctgggcggcctgctcatccccaccgacggcgtggccctggccgcccgtgcggtgcagctgctgatggagcgctccagcgaacatggcgtgaccttcgtcggctccaccacggtgaccggcatcgcccaggagggcggcaaggtgaccggcgtcgaaaccgacaacggactgatcccggcggacatcgtggtgtcatgtgcaggtttctggggccgggagctcggcaaaatggtgggcctggaagtcccgctgctgccgctggcccaccagtacgccatcagcaccccgctgcccgaactcgagggcgtcaacgagctccccaagggcgccagcaagcccatcctgcgctaccaggacaaggacctgtactaccgcgaatggggcgaccgcattggcatcggcagctacgcccaccgccccatgccggtggacatgtccgccctgccgaaggtctccgcagaggaaatgtcggaccaccgcatgccctcccgcctcgatttcaccctggaagacttcctgcccgcgtgggaggacagccaggacctgctgccggcgctgcgcaactccgagatccaggacggcttcaacggcatcttctccttcactccggacggcggcccgctcatgggcgaggctcccgacctcgaaggcctgttcgttgccgaagccgtctgggtcacgcactccgccggtgttgccaaggcaatggcggagctcctgatcgacggccggtcccacacagacctgcacggctgcgagctcacccgcttcgaaaaggtgcagacctccgacgcgtacgtcagcgaaacctcccagcagaacttcgtggaaatctacgacatcatgcacccgctgcagcccagggaatccccgcgggacctgcgcgtcagcccgttcaacgtccggcagaaggagctcggcgccttcttcctggagtccgccggctgggagcgcccgcactggttcgaggccaaccgcggcctgcttgaggagctgccggcagaatggcaggcgcccgagcgggacgagtggtccgccatgttctcttcccccatctccgccgccgaagcgtggaagacgcgcaccgccgtcggactttatgacatgacgccgctgaagcggctgtccgtggtgggtcccggcgcccaggcgctgctgcaccggctcagcacgggcaacatcgccaagaagccgggtgccgtgacgtactgcctgctcctcgagcacgacggcggcatccgcagtgacgtgacggtcgcgcggctggcggaggaagacttccagctgggcgtcaacagcaacgtggacttcgactaccttcgggtggaggcccggaagcagtctgctgaagatccggcccagtgggtgcacgtttccgacatcaccggcagcacctgctgcatcggcctgtgggggccgctggcccgcgaagtgatcggcaaggtcagctccgacgacctgaccaacgacgggctcaagtacttccgcaccaaggaaatctccgttgggggcatcccggtcacggccatgcggctctcctacgtgggcgagctcggctgggagctgtacaccaccgccgaatacgggctgaagctttgggacctgctggtcgaggcgggccgggaacacggcatcatcgcggctggccgcggcgcattcaacagcatgcggctcgagaagggctaccggctgtggggcacggacatgacgtccgagcaccacccgtacgagtcgggtctaggcttctccgtggccaaggacaagaccggcttcgttggcgccgaggcgctggctgagcgcaaggagcagcaggcaacgcgcgccctgcggtgcctgacggtcgacgacggcacgtcgatcgtgctgggcaaggaacctgtgtacgtggacggttccgcggctggttacgtcacgagcgccgcttacggctactccgtgcggaagccgatcgcctacgcgtggctgccggcttccgtgtccgagggcgacccggtggagatcgagtacttcgggaagcgcatcgccgccacagtctcggccgagccgctgttcgatccgggcatggagcgcctccgcgggtagtccggaacctgtcgtcaaaaccgggggtcgccgaacaggcggcccccggtttccgtgtgccggctcggttcccgcctcaatgtcacacccccttgccatgatgggtttatgggcggtgaagcggtggtgaaggcgtttgcggagatcaaggccgcccttgtcgtgctcaacgctgaggtggacgggtgtggttcagcgccgttctcggctgctgatccgttggccgggctagcagatgggagcctggacattctcgccggcgcggcggctgtcgaggccggcgtggcggggttgaaggcccgtgctgccatgaagtacgccggcgccgcccaagccctggccccggacatgccggtgcaggcgcaggagatggccgtcgccgcggaaatcgggtgcgtgctggccatcgggccgcgggccgcaagcgcgttcctcgccgcttcccacgccctgaccaccaccttgccgctgacactttccgccctgcaggccggaacaatctcctggcagcacgccctggccctggcggacgagacatccaccctcgaccccgccggcgccgccgccctggaagcccacttcctcgaccccgacacaccaagaccggccaccgccgccaggatcggggaaatacccgcccaccggctccggcacaaggcccgaacctggcgggaacgccaccacacagaatcgatagagaagcgccatgccaagggcgtggcggaccggcgcgtcgagtacaggccggaccaggacgctatggcctggctctccgcctacctcccagccgatcaggcaatggcaggctggaaccgcctcaacgccctcgcccgggccgcacaaggaccccaggaaccccgcaccctcacccagatccgggccgacacattcgccccagccatcctcaccagcggcaccaatccaaacttcaatgcagccaacagcgaaggggcgggcgcaggaacggatcccaccccttcatcgccgatccgggcccaggtgctcgtcaccgtgccggtattcgccctcatgggcctgaccgacgagcccgccatgctcgacggcttcggccccatcccgccgtccatggcccggaaacttgtcgctgacggcgcggattcgttccaccgcgtcctcgtcgacccgagggacggagcaccgctggagatcgggcggaccagctaccgcgtcaccaaagccatgcggaactggctaaggatgcgggacggcacctgccccttccccggctgcagcaacagttctttagataacgaggcagaccacctcctcgcctggaataggggtggcaccaccggaatcagcaacctcggacaaccctgccccaaacaccacaaactcagacacaccaccgggtgggaaccaacgccggccactaaagacgaacaacccggctggatctcaccgtccgggcgacattacaaaagcgaacaccaggactgggaaccaccccactggccggacgaactgatgccggaactgatgcgcctcagcggatcaaccgttgggtttacagacttcgcctacattggattgtccccgggagaagagggcttggcacggttccttcatgcaccacccgcctgatcggacgaagggatagtgccggaatattcaaagcaggacccggccgggccaactcccgcggccctgggtgtcacctggtccagtgccagccttgctggcaccggactgcccttgcccccttgccctcggtggccgctggcgcttggctgaaggaatggctgatgaagaagtttcgaagaacgttccttcagacgagcacctgcggcaggacgtcgcaccggaatccgagggagagccccaggaggcaccggacagcggctttacgcccggacagactaacgccagtcagcaggtgggtgggctcgcctcggccagcggctatggcaagggcctggatcccgaggacctgcctggcgaaaacaacccggtgtagcacggagatctaaagggaagatacagcgacggcggcattcggcacacatgccggatgccgccgtcgtcattctgcctgacaggggccaagcgggattggggcgataccgcagcgcgggtctatcccgccgcggcaggctccagttcttgggaagaagcctggccagtggtttccgcgaggtgcggcacgaaccggacgaacatggctttgaagcctggcgtgttggactcccgggccacgttttccttgtggaccagggcgttggcttcggggaagtacgcggccgcgcagcccttggcggtggggtaggccaccaggcggaacttgtccgcctgccggtcgtggccgcggaaggtgctgaccacgtccaccaggtcgcggtccttgaagcccagttcaaccaggtcctccgggtggatcaagatgacccggcggccgccggagatgccgcggtaccggtcatccaggccgtagaaggtggtgttgtactggtcgtggctgcggatggtctggagcaccaggtgcccgtcgggcggggtgaggtattccagcgggctgacggtgaagcggccccggccgatgtccgttttgaaggaccgggtgtcgcgcggcgggttgggcagaacgaacccgttcttggtccggatcctggcgttgaagtcctcgaagccgggcagcacgcgggaaatgtggtcccggatcacgtcgtagtcctcggccatggacttccagtccaccgcatggtccgggccgaacgccgcttcggccatccgcgccacgatgacgggttcggcgagcagatgctcggagaccggcgtgagcctgccctgggtggagtgcacaacggacatcgaatcctcaaccgagaggaactgggcgcccttggggtgcttgtcatccttgtccgtccggcccagggtgggcaggatcagcgacgtgcgcccgtgcaccacgtgggagcggttgggtttggtggagatgtgcaccgtcaggccgatccgctgcatcccggcttccagggtctcggtgtcggagcaggccagcgagaagttgccgcccatggacacaaaaacgtccacgtcgtcgcgttcgaacgcctccatcgcttccacggcgtcgtacccgtggtgccgcggcgacgtgatcccgaactcggtgtccagcgcttccaggagccattccttgggcttttcccagatgcccatggtccggtcgccctggacgttggagtgcccgcggaccggacaggcgcctgcgcccggcttgccgaagttgccctgcagcagcaggacgttgaccatttccttgatagtgtccaccgagtgcggctgctgcgtcacgcccaaagcccagcagaagatggtggccttcgaggccaccagcatggaggcaaccttttcgatctgttcccgggacagcccggtggccttctcggtttccgcccagtccagatcgccgcgggcctcgcggtaggcgtcgaacccgtccgtctgcgcctcgatgaaggaatggtcgacgacggtgccggggttccgctcttcctccgccaggagcaggtggccgagggcctggaacagtgccaggtcaccgcccaccttgatctgcaggtattcgtccgccaaaggcgtgccgccgcccaccacgccggagacggtctggggatccttgaaattgaacagcccggcctcgggcagcggattgaccgccaccaccttgccgcccttgtccttgcactccttcagcgcagacagcatccgaggatggttggtccccgggttctgccccaccacgaagatcagctcggaatcatggatgtcgtccagcgacactgtgcccttgccgatcccgatagtcgggttcagcgccgaccccgaggactcgtggcacatgttggagcagtccggcaggttgttggtgcccagagcccgcgcgaacagctggtacataaacgctgtctcgttcgcggtgcgtccggaggtgtagaagacgcagcgatcggccgtggtggcccgcacgtgctcgccgatcagttcgaaggcgtcaccccaggagatcggtgaatagtgcgtctcgcctgcccggatcaccatgggttcactgagccggccctggttgccgagccagtactcggtcttcgtggagagttcggcgatcgagtgctccgcccagaactcggcgccgaccgtccggagggtgttctcttccgccacggccttggcgccgttctcgcagaactccgcggtcttgcgcttcttgtccgattccggccacgcgcagccggggcagtcgaaacctccccgctggttcaaccgcagcagcgagtgcgccgtgcgggccaccccggcctgcgccaccgcgcgttccagcgccaccatcacggccttcacgcccgctgcctcggccttgggtttatggacttcgaggttgtcctcgtcgatgtccgcaacgggggcgggctgcttaccgaacttcattgttccaacttccttaccggcatgcgtggtgtttgtagtgtgttgcctgggcgccatgaaggcgcggatgcctgcggcgccgcgaaggcgcggatgcctgcggcgccgcgaaggcgcgccaggcattcccggcgcgccccgcgcgagttccttgtgccgccggctactgcgaaaccttcgccagcgtttccgtttccgccgcgatggtggtgttgtccccgtggccggtacggaccacagtctcgggcgggagggtgagcaggcgttcccggatggaggccaggatggtggggtagtcgctgtaggaccggccggtggcacccgggccgccgttgaacagcgtgtccccggtgaagaccgttccttcgctttccaggtagaagcaggtcgagccgggggagtggccgggggtgtggatggcccgcaggacagtcccgcccacctcgaagacgtccccgtcgttcagttcccggtccggacgcgcgtccgggtaaacctgctgccagaggaccaggtcctcggggttcaggtagatcggggcgcctacggcgtcggcaacctcacgcgcagcgccgatgtggtcgttgtgcgcgtgggtctgaaggatggcaaggaccttccggccccggacctggttgatgatcgcggcggcgtcgtgcggggagtcgataatcacgcactcctcgtcattgcctacgatccagacgttgttgtccacgtcccaggtgccgccgtcgagcgaaaatgtgcccgaggtgaccaggttctcgatggtgactgccattagagctccaccaccgaacgcaggaccttgccctcgtgcatcctgtcgaaggcttcctccacctcgtcgatggtgatgcgctccgagacgaaggcgtccaggtccaggttgccctgcttgtagtggctcacgagcatggggaagtcgcgggagggcaggcagtcgccgtaccaggacgacttgagcgagccgccgcggccgaagacgtccagcagcggcagttccagcgtcatctccggcgtcgggacgcccaccaggaccacgcggccggcgaggtcgcgggcgtagaacgcctgcttgtaggtttcgggacgtccgacggcgtcaatcaccacgtccgctccgttgcctccggtgagggcgcggatggcctcgatgggatcttctttgctggagtcgatgccgtgggtggcgccaagggacttggccatgtccaccttgttggcgtcgatgtccacggcgatgatcgtggtggccccggcgagcttggcgccggcgatcgcggcgatgcccacgccgccgcaaccaatcaccgcgacggactctccgcgcttgacctcgccggtgttgatggcggcgccgatgccggccatgatgccgcagcccagcaggccgacggcggccgcatcagcctcggggtccaccttggtgcactgccctgcagccacgagggttttctcggcgaaggccccgatgcccagggcgggggagagctctgtgccgtcctccagggtcatcttctgggtggcgttggcggtgttgaaacagtactggggctgtcccttggcgcacgcgcggcattcaccgcacacggcacgccagttcaggatcacgcggtcgccgggggcaacggaggtaacaccgtcaccgacggcgctgacaacacccgtggcttcatggcccagcaggaaggggaagtcatcgttgatggcgccctgcttgtagtgcaggtccgtgtggcatacaccgcacgtcaaaatgtccacaagggcctcgcccgggcccggatccggcaccaggatggtctccactgacaccggagcgttcttctccttggcgatgactgccttgactttgtgaaccatgattccagtgttcctttcgttggccggacaaagatcccggcccggctatcaagtctagaagctgcagcgcctccgggcggctacccaaaggggcgggtgtcgggcacccaaaagggtggtcgggccactgaaggtcctcctgcccacgcccgccaattgcgtaatgcacaacacggtgcgcatagcgcttactcgcaatatgtcagccgccctagggggtgtcaataggccgttcacctgcgacgtgccgtaaacgcgaggaggtcctggtcagtgcgctcttcttccgcaaccttattgcatctcgaacaactgaatcgactgaggtctccgcactggctcatgcggctcaagcgcgtgtgtgttgtccgcatcctacccagttcctagtcgcagcggaataactctctgcctcacaaccattgaccgtggcggccatcacaccttagtctgttgcaacagcgttgcgttgaatgcaaccacaaacactttggtggatacatgagtaacgaaacttcctccccatcccgccgcagctccccgggcggcaccctcagtgatccgcgccccgcacctgccgacaacgccgtcagcaaggaaaccaggcgccgggtcatcgctgccagcttcatcggcaacttcgttgaatggttcgactacgccgtctatggctacctggccgtcaccatcgcaacggtcttcttcccggaatccgatccgcagaccgggctgctgctgaccttcgccctttttgccatctcattcctggtacgcccgctcggcggatttatctggggccacatcggcgacagggtgggccggcggacagccctctccctgtcaatcctcatcatgtccggagcgacgttctgcatagccctgatcccgggctacgacacgatcggcatctgggcgcccgtcctgctcctgatcatcagggtggtccagggcttctctgcctccggtgaatacgcgggagcctcggccttcctggtggagtacgcccccgccaaccggcgtggcctgtacgccgccgtcgtccccgccagcaccgctgccggcctgctccttggttccctcatggccggcctgctgaccaccctgctctccaccgacgcgatgcagagctggggctggcggctgccgttcctcctggccgccccgatgggcctgatcggccggtacatccggacaaagctcgaagacactccggtgttccgcgaactggccgccgaggaccacgccgtcaaggcccctgtctccagcctcttccgcaaccactggcggcagctgctgcaggccgtcggcgccgtgctgctcaacgccgtcggcttctacgtgatcctcagctacatgcccacctacctgtcctcggaactgggcctgggcgaaaccgaatcattccttgccaccaccatcgcgttgatcacctacatcggcttcatcttccttaccggcatgctctcggaccggtacgggcgcaagaaggtgctgatcagcgcatcggttgccttcattgtcctgaccgtccctgccttcgcgctgctcggcaccggcaacttcctggtcatcgtcctggtccagatcctgctgggcgccatgctcaccctcaacgacggcacgctccccagcttcctggcggaaatgttccccacccgggtgcgctacagcggctttgcggtcagcttcaacctctccaacgccctgttcggcggaaccgccccgttcatggcaacactcctcatcgccgcaaccgcaagcgacctggcgccggcctggtacctggtggctgccgccgtcgtctccctcattgccgtgtcgctctccagggaaacctgcaaagagcccctgcggcacgaatagcttccctcccacaccaaaccaactgcacctcaacaaatgcacgagagaaaggcatcgtcacgatgaccatcaccaccgaaaacgccaccactgtcgccgaactcgagcgcaccaagatccttaagaacggcgagaaggtaagcctcacgttctccgacaccgagttcgagcgccgcctggccggcctgcgccgcatcatggcggagaaggacctggacgccgtggtcctcaccagctaccactccatcaagtactactccgacttcctcttcaccaccttcggccgctcctacggcatggtggtcaccaaggatgacaccgtcaccgtcacggccaatatcgacgccgggatgccttggcgccgcagctacggcgacaacatcgtgtacacggactggcgccgcgacaactacatcttcgccatccaggaagtcctgcggacccgcggcatcaacccgcgccgcctcggcgtcgaggatgactcgctgccgctggacaaccgcaacaagatccaggcagccttcccgtccgccaccctggtggacgtggcccaggcagccatgcgccagcgcatgatcaagtccgccgaggaaatcgaggtcatcaagcacggcgcccgcatcggcgacctgggcggcgaagccatccgcaacgccatcaccgccgggatcaccgagtacgaggttgcgctgatcggcaccgaggccatggtccacgaaatcgcccggaccttccccgactcagaaatccgcgacacctgggtgtggttccagtccggcatcaacaccgacggcgcccacaactgggccaccacccgcaagatccaggaacacgacatcctgtccctgaactgcttccccatgacctcgggctactacacggcgctggagcgcaccctgttctacggcgaaccggatgcccgctccctcgaactgtggaacatcaacgtggaagtccacaagcgcggcctggaactcatcaagcccggcgccgtctgcaaggacatcgccgccgagctcaacgagatctacgtgggctacgggctcctggccaaccgcaccttcggctacggccactcgttcggcgtcctgagccactactacggccgcgaagccggactcgagctccgcgaggacatcgacacggtgctggagccgggcatggtggtctccatggaaccgatgatcaccgtccttgacggccagccgggcgccggcggctaccgcgaacacgacatcctggtggtgggcgaggacggcgcggagaacatcaccaagttcccgttcgggcccgagtacaacatcatcggcgcctaacgtccccaacgggctcccgggcccaaagaacacccggaagcggcggcatccccatggcgccgcttccggccctcccttagggaatgatgggtaacaccatgagtgcaacagaacccgagaccacaggcaacggcgacaacaagggcgcttccgtcatcgtcaacgcgatcgcggtcctccggactttcacggcggacgagcccctcctcggcgtcaccgagatcgccaaccgggtggggctgcacaagagcacggtctcaaggatcctggccaccttcgagcaggagcacctggtggagcgggacgccgaaacgcggcggttccggcttgggctgggactgattgccgtggccggaccgctccttgccgagctggaggaacgccgggttgcctaccctgtactgcgcgaactgtcggaacagaccggcgaaacaagcgccctcatggtgtggagcggtgatgaatccatctgcgtggagcagatcgccagccaccaccagatcaagcacaccaccccgctgggggcacggtacaacgacgccctcagcgcctccgtccaggtcttcctggcccgcgaacccgaaccccgggtccgctccctcctcagcagcggggccatcagctatccgggcctggacgactccagccttgacgcctacctggtccggctgaaggatgacatccggcgcggctgggccgtcaactacggggaaacctccatcgatgaagtaggactggcagcacccgtcttcgaccaccggggcgaggtggttgccgccgtcctgatcccggccccgcggttccgggtgtcccaggaccggctgcaggcattgggggaggcctgcgccgccgccgcagcgaaggtcaccgcccggctgggtggaagggtacgcaggcccgcaacgtagactggcaggatgcgcctggtagcaagcgatatagacggaacgatcctcggccacgatggcaaaatcagcgaccgcaccatccgggccttccacgcctgccgtgatgccggcgtcgaactcgttttcgtcaccggacgcccgccgcgctggctgcaccccctgcaggaccagctgggccactccggcaccgtcatctgctccaacggagccgtggtctgggaccttgaggccgaaaagctggtctccgcccgcacgctgaccctcgacgctgtcctggaagtccgccgcgtcatcaaacggctgcgtcccgccgcgctgttcgccgccgaaacgctcggggggttccaccttgaacccggcttcatcgaaaacggctccagtgaactgctctccgaattcacgccggcgccgctggccgaaacgctggtaacggacgacgccgtggtgaagttcctggccatcgtccgcgaaggcaccgccgatgatttcctcgccgaggtggcgcccgccgtcgaacacctcgcctccgccacccattcctcgcccggggtgtcgatgctcgagctcgccctgcccggggtcaacaaggccgtcaccctggccgaatacgccgccgccctgggcatcggcgccgaggacgtggtggcgttcggggacatgcccaacgacatcgagatgctccgctgggccgggcacggctacgccatggccagcgggcacccggaagcgatccgcgcggccgggcagcaggcaccccactttgacgacgacggcgtggcccaggttttggagtcccggctggcctcgctgggcgtgcagatttcctgattcccggcgtcgggctttctcccgccggacatagcgccgttttcacagctggcgctcacctcgcgttcaccttcgctccctaacgttggcgatggagggcccatcccctccatcccggttcaaggggtaacaggctcaaggggtaacaatggcaagaaaagtgaagcttggaaccgccgacgcaccgccgcgccaggcaacgcccgcaccgcactggaaaaagctcacgccgggcagccgtgtccgcgtactcctcgccccggggttcgaggccggcggcctggtcgacgcggtcactgcggaccactccgcggtgtggatcgatttcgacggcggacgcggccggacgctgctgcactgcagcgacggcgtggacatcgttcttcaggaagacgcacttgcgcacgagggctgacgctgcctgaccaggggctgacgctcctggagtacgctcgcagtgtgacactcccgttcttcgaccatgccgccgcggacgggtccccgatacccatcgcgatggcccatcgcggcttttcccgggacggcctggaaaactccatggccgcgttccgcgccgccgtcgacctcggctaccgctacctcgaaaccgacgtccacaccacagcggacggtgtggtgctcctcttccacgatgaaacgctggaccgggtgaccgacggcagcggccgggtgtccgagctccccgcacatgcggtggccaaggcgcggatcggggggcgcgagcctatcccgcggtgggacgagctgctcgcggagttgcccgaggtgcggctcaacgtggatgtcaaggactggaactcggtgcgcagcatcgcagccgggatcgaagagcaccaggtgcaccacagggtgctgctgaccagtttctcggaccgccggcggcgggcggtgctgaaattgctgagccagcccgtggcggcgtcggccggtgttgtgtccgtgggtctgttcactgtgctgggccgcctgctccccgggccggtcttcaggtggagcatgcgctggaaccttcgcggagtccacgccctgcaggttccggtgcgctatggcagggtgcacgtggtgacgccgggctttgtccggcgcgcgcactccctgggcctcgtggtgcatgtctggaccattaacgacccggacgagatgcgccgtctcctggaactgggcgtggatgggctggtcaccgaccgcgcggacctgctccgagaagtgctgcgcgaacgcggggaatggccgcacggctgactgcgccggcggcactgactactccccggatcccccgcggctgctagccgcggcctgtgctggtggacgggtcctggtcgccttcggaagggtcggcccgcaactcgtccgggttggactccggaaggccgcctgagcccgggacaccgcgctgggacgcaggcgatccgcccgccggagcggacgcgctgccggcgaggccgccatcgccgtccgcctcatccgactccaggtcgccgccaaagggggattccgaggcggggcccggcgctgcatcggtttcgatccctggtgcctttcgcttctccgcctccatggcgttggatccttcgctgagggaggagtggacctccacgtcatcgttcgggtccgtgggctcaggaacatgcgctgactctgtgggctttgatgtccccgccagatcctccatggcgttttctgctgccttgccgatgctgtcgccgatacccatgtgactgctccttctgacgtcgcgtgccgggcaccccagcggatgcccggagcattacccttccagaattatcagcatgcttacaattagtccagagccggggcaaggaaccgcggccgggcaggaaggacgcaagcactatgagcagctaccatcccgaaaatgatcccgcgaacccggaccaaccgggcaagaccccgccggacgacgccatgaagggcgttggccagccaactggtggccagccgggcggcgccgggcaaggcgcgaaagactctgccggctcgtcgaatccggaccccgccgaaggcaacatcacggggctggaaccgggcgggggagtgcctccgggcgagacgccgcctgcagaggaccagatgagcggcgaccagggccacggcgaatagcacccgcgggcgggcggccctccggatgtcgtctggagagcccggccgggtcagtgctgttcgctggcgaccgaagactccccggcatgctcgcgtccagcaagctggcggttgagcccgtccacgtccaggcggccgttccagctggcccagtccttgggccggacagagggccggcccagcaggtagccttgcccggcgctgattccgagttcggtgaggactttgagttcccccacggtctccacaccctcagccacgagggtggtgccgatctggtccgcaaagtccaccaggcaggcggccagggcgcgctggatgccgtccttgtccacatcgccgatcacgttccggcccagcttcaggaagtccggccgcaggtgcaccatccggctcagcgcccccgcccctgaatgggtgtcgtccacggcgatcctcagtccccggtcccgcagcggattgatggcggaaatgaactgcgggtattcctcgtccttgaccgtctccgttatttcgagcactacccggtcaatgggcagatcgatgtgatcgaacaattcaggcagccgggggtccaggcaggaggcgggcgaaatgttaagggacacgaacaggttcccgggaagcgacttcgccgcagcggccgcagatcccagcgcggcgaattccaggttcgcacccaggccgacggcggcggcctcggcaaaccacagttccgcggcagctccgtcatcgctgacgaaccgggacaatgcctcgactcccaccacgcttttttcttccagcccatagattggctggaaggcggtcatgagcatctggctttcgagcagcgcgctgatgcgtgacatgctgcggatcgcatcgatttgctccgccactttcggcgggactgcgggggtaagccgcatttcccgggcgctctgcagcgtttccacggtattggcgtcactgcgccgtgtatccaggagatattcgagcagcgcccgttccggcactcccggattttcatccaggctgttgctcagccgctgccggacagcctctccggacggatcagtatccgccagcacagcggcaataattccccatgcctgtattcgaaccgacattagctacgcccccagttgacgaagtaatgacccagtggccccgatgttgttcaatttccaaacgcctttaaattccggtgtccatgctgaaacctgattttcgcggcgacgaaaaccagacaccgcacgatgatcgtatatcgcgggaatcaaaagcgcagtactttacccttaccgggttgcgctttccgcctggcccgccaacaattccggaatttgttcaggcgggaccggcctgctgaagaagtagccttgtgcgctgaggcagcccaagccgcgcagcagctcggcctgctccgccgtttccacgccctcccacacggcttccagcccacaggccctgatcagctgcaggactgctgccaccagtgccggctgcgtggggtcggttcccagtccggtgatgagggaccggtccaccttgacccggtccacgggcagccggcgcaaatagctgatggacgagtaaccggtgccgaagtcgtcgatctcgatccccacgcccaggccccgcagcccgcccagcgagtagcggtccagttcgttccctttgacgattgccacttccgtcagctccaggaccacctgttcgggcctcacgcccgtttccttcaggacgttcctgacgtcctcgatgaactgcaggctctgcaggtctgtggctgagatattgatccggaccgagaaccggctgtccaccagggatgcattgatccattcgcggagctggtgcaccgcggcccggagcacccacacccccagctcggagatcagcccggcctcttcggcgaggggaatgaactcgtcgggcatgatgaagccgcgcgtcgggtggttccagcggaccagggcctccacgccctcgatccgtccggtggccagctccaccacgggctggtagtagagcgtaaggccgccgtccttgagtgtggcacgcagatcctccaccagctggctccggagcctgcggaccagcaggagcccgggttcgaagcggtgcagccggttctggccttccgccttcgaggcatacatggcgacgtcggcttccatcagcatgtcctcgggagtcttgccggcgccgccggtgctgagcccgatgctcgcgccgcagcgcacgctgcggccgggcagctccacgggctggcccagggctgccaggatgcggtgccccacgatgcctgcctggtccggggacgccgcaggcaggacgatggcgaactcgtcaccgcccaggcgggcaacgacgtcggactcgcggacggcgctgcggatcctttcgcccacagtgaccaggacatggtcgccggcggtgtggcccaggctgtcgttgatggacttgaaggcatccaggtccatcagcaggagggccgggccctccccggaaggggacgcggcgtccgtctccagcgcgcccttcagtgcgtcgatcagggcggagcggtttgccaggcccgtgagcgggtcctgcatggccatcttctgcatttccaggtgggcttcatgcaggagctgggtccgcacctgcacgcgctgctcaagctcctcgtaaatgatctgcaggtcctcggccagcaggttggtgcccatgatgatcgcgtcgagctcgtcgcgcgcgggggacacctcgatccgggaggtgaggtcgccggacgccaggcgcacaatgccttccaggagctgggagagccgcgggtcgttatccgcaaacatcgtgttcctgcattgtgctcagttttcctggctgtgggtatcaaggggcaggctgacggtgacggtggtgccgctgcccagggtggaggacacgtcgatccggccgccgtggcgggacacgatgtccttggtgatcgccagcccaaggccggtcccgggaatggcgccggtcatggcgttggaggcccggtagaaacgggtgaagacgtggtcgatctcgtcgctcgaaatgccgatgccggtgtccgcgacgctgacggtggcccagcgggagccgtccgaggccgcgtgtgactcgctgcccacctcgatccgcccaccgctcggggtgaacttgatggcgttggacaccaggttggtgaagacctgctgcagctgcacctcgtcggcaagaatctccgggtcctccggaaccggctccacggcgatggtgacgttttgctgcgtggccaggggcctgagcgctgccgcgaccaggtccagggtttgtcccagccgcacgggggtgaggtgcatcaggctgtcatcaaggccattgcgggagacgctcagcatgtcctcgatcaggatccggagccgctccgtgttccggaccacgatgtccagcatctggtggacctcgggggagacgggctgctcggtgctctcctggatcatgtccaggtacgccatgatggacgtcagcggcgtccgcagctcatggttcaccgtggccaggaagtcggttttggccttatcgagctgctgcagctgcttcaccacctgctgctggctgctgatcaggtggctctgtatgagtccgtgcgccgcattgccggccacgtgctgcatgagcccgagctcggtgccggaccatgtccgcggtccgtcaagcatcgcgatccagatgatgcccagcgatgagcttccctcgcccatgggcactgccagcgaggagaccgcgttggcgattttcggtgcaggggcatctcccgccgccggctcttccgtccctgcggtggacattgtctcggcgccggcccacagccggtccgcggtctgccgcgagtactgttcatccggaagcgcctgttcggggaggggttccagccccggcctgctccatgcggcgttgatgcggggaacccggctgtcctcgaaggtggccagccagacatggtcggccttgaacgtccggccgaagccagccaccacgtggcgggctatttcctccggatcgtttgttgcccgaacagcggcggatacctcccggagctgttcgcggagggcttcggtttcctgccgcacggccttgcggcgggccacctggtcgatcagtgcggtggcgcggtggaccagttccttggttggcggcggcttggcgatgcagtcatggatgccggagggattcatggctgcgagttctgccgggttgtccaggtccaccaccaccagcaccggcgcggccgtttccacggcggagagcgaagcatcgacaaccacaaccgagggctggcaggaatccactgaagcagcgagttcgtcagcgtccccggcacacaggacgctgtagccggcgtcccgcaacgtcctggcgtaaaattccagccgcccgccatcgggatctgccacgacggcggtgcgcggcgcgcgcaggtcactcggcgattcagtcgccacagtgcccccttccctcccagttgactacattgtatggcgacgccgggcgggcggctcggtgaaaccggcacgttaaggggacggtaggctttcctgcccctgcgggggcgcgggaagtgccgggattgcaggcgttcagcctgcaacaatccggcaggtcacgtccgggagtggcggggcacctatatttgttccgtgtcctccccagcgaagtcccccgccgcaaagtctgtgcgttccgccctgcagaagtacctgatgctccccaagctcatcaggctgtcccgctctgcccccaaggatcggccggtggcatgggacacctactgggcgggcatccgggggaggggagccggcagcgaaattctctgggatccgggtacggacgatgaattcctcggctacagggctgtcctgctccgatacctggaccgggaacttcccgtcatcgacgtgggctgcgggcacggacgtttcaccagggcattggctggtgttttcaccgaggctgtcggcgtggacgtgtccggacacgccgtcgcccatgccgatgcgcagacccaggccgacggccgtgcagccagggtccgctaccaggccctggacatgaccggggccggagcggccggcgccctcgctgtccagggcgacgcgaacgtcttcctccggggcgtcctccacgtcctggacacggcggaccaggcggcgatgatccgcaatctgcggcaattggccggcaaccgcggcaccgtattcctggcggaaaccaatttccagggcaacccggtggaatatgtctcccacctcggcgccacaacccgcaacatcccggctccgctggaacgggccatccgcgggctgcccatgccaggccacttcggcccggacgagcgcgcgcgggcctttccgccggaagcctgggaactcctggctgacggtgaagtggccatcgaaacgaacccggtgactggagtggacgggcaaagccgggttccgggctatttcgcggtgctgcgcccgcggggctaaccggggtcctcttcccggagccgttggtgatcctggttggtgatccccacagttgttccacaacagagatccaaagcccttgacacaagggaggatcgggaggctacatggtaagtagtcttactagttatagcttccgggggaaaggctggctaccgtggcacagggcaagggcaacatgatcagcgtcccaggattgcgccggaacggggatggcccggatgccggccacagcgatggcagggcccgcagcggtccgctctttcgcccgaaaaacgccggccgcgaccacgcctaagccaccaccctcccgccgcgcactgcccggcaccggctgtccaaatcggcgtcgcttcgccaacggcggccccagaacctacaggaaccacgatgcgcaaattcattccctccggcggccttcgggggatgctgctgccgccaacctacggccagcacgtcacccaccgcacggagttcaccatcctttcggtcgagatctgggccaccgggctggtggtcaacatccagttggcctccgccgacggccccgagccgcgccttatcctgcaggaccacttcggcaccgagtactccttccgggactcggccacgctggagtcccggaacctgcagacattcaccccttccgtgcccccgggtaccaggagcctgaccatccggtcggccgatgatccggagggccgcccggtggtgacgttcgctgtcccgctgatggccgtgccggaagagccggactctccgcagaacggcgagtacccgccgtcgccggagctccgccgcccggcctgacctgctgagggcctcgcccaccgaatggcccgccactgaatgctccacgcgttgaatgtgtgaccgactgaaaggctcccgccatgcatgacaccgcaggattcactccaagcaccgccatcgtgacgggatcggactccggcatagggaaggctgccgccgtcgcccttgcccgggcagggatggacatcggcgtcacctggcactcggataaggccggggccgaggacacggcggacgagatccgccgcctgggccgcaaagccgtggtgcggcagctggataccactgacctgcgtgccgccgcggccgtcgtcggcgaactggcggacgggctgggcggagtggacgtcttcgtcaacaacgcgggaaccggcgacgggaccaagttcctggacctcgacgtcgacacctggatgcgcacccttgacaccaacctcaacggcgcgtttgtgtgcctccaggcggctgcccgccggatggtgaaggcaggcaggggcgggcgcctcattgccgtcaccagcgtccatgaattccagccgagggtgggggcatccgcctacgacgcgtccaagcacggcctcggcggactcatgaagacgctcgcccttgagcttgccgagcacggcatcaccgccaacagcgtggcgccgggggagatcgcaacgccgatgaccggacaggaggatgacgaccccactgcgaaggaccggccgggcgtccccctgggcaggcccggtgatgcgcgggaagtcgctgccgttatcgctttcctcgcctcacccgcttccagctacgtcaacggcgcctcctgggcagtggatggagggatgctgcagatggggccgcaggccggatcccacatcaccagcccggagtggcgcgaagggtaggccgggcggcggtggtgtgaagcagcagggggtgtccgaataacggatttggcaagcgctttcccaagcactgctggcatgatggagcgcatgcgcattcttattgctccggacaagttcaagggttccctgacggcggctgaagccgctgctgccatcgcggaaggcgcgctgcgcgtgtacccggaggcagttgccacccagttccccatcgccgacggcggggaaggaaccttggaggcagccgtggccgccggcttcgaggagcggctcaacgccgtcgtgggacccatcctggcgcccctgggtgccgcgtgggccatccacacgtccgacgacggcaaggtcaccgccgtcatcgaaacggcccaggcctccggccttgcagacatggaacccaccccggccaacgcgctccgggcccacagctacggctgcggccagctcatcgcggcggccctggacgccggcgccaccgagatcgtgctggggctgggcggatcggcaatgaccgacggcggcagcggcgccctgcgcgccctgggcctcaagccgctcgactcggccgggaacgtggtgcccctcggtggcgggtcgcttgccgacgtcgcggcactggacaccagcgggctggacccccggctcgccgccaccaccttcaggatcgccgtggacgtcaggaatccgctctatggaacgtcgggcgccgcgcacgtcttcgcgccgcagaaaggcgcggacgcggacaccgtggaactgctcgacgccggcctccgcaactgggcatccatcctccgggaggccaccggccgggacgtgaacatccccggcgccggcgctgccggcggctttccggcgtcgttccttgccttcaccggggccacgctggaaggcggcttcgcgctggtggcagggctcaccggcctggccgggcaactgggtgaagcggacctggtgattaccggagaagggtccatggactcgcagtccctgaccggaaaagctcccatcgcgctcgcggacgcggcacgggagcgcggaattcccgtgatcgtcgtggccggccgcatcctggtgacgcccgaggagctcgctgaacacggcgtggtggctgccgcgcaactgctggacgtggctcccagctcgcaggacgccgtcgcacacgccgccaagtacctggcgtgggcaacaagccaggtccttgaaggcgcatagcggcgcggagggaactagacgattgtggtgttgcggcgacgccgccagatcaacaccacaatcagggttaccagtgcgatcccgccgatgacccacggcgcgaaattgaccctggtggactcgctctgggtcgactcgccggtccccgggttcgcagggccggtggaggccgtagccccgggagagggcgtgggcgatgtgcccgtcaccgcccacaacgctgccgcgcctgcgtgcgctgccgcgctggcttccgctgctgcaggcgccggacctgcggaggtcgaggcctgggccgctcccagcgggagtgccggcgtcgcgatgatcaaaagtgccaggagcgcagatctcaggatcgttcgcatgctcttttcctttcgggaagaatcggctcaggtgcccccaccaagacggcgacggccaggaattcgctttgccagttgtggaaggaatcgaaccagaaccggctggtgctcatgtactggagggcggtgctggccatggctattccccatcagggccgggcgatccctgccctgcagcggcgcgcctgttcaggtggatagggacgtagaccagcaggaccaccatcacggccatgagcgctccgccggccgtgaggcctgccgtacgtcccgcggtcacgtcgaagaccagcgccgcggtacctgcgctcaacagcgcgattccggcgagggtgatttttgcgatggtgtccccgctggataccagggtttccttgagccgcttccggaagagcctccggtgcacgctgaccggcaggaggatgagggcggtggtgagcgccgcaatcaccacgttggtgaggtagaggccaacctggaaatcgtcaagggtctcaaagcgttcctggaagggaagcgtcagcaggaagccggccaggatctggacgcccatctgcagcacccgcatctcctgcagcagttcggcccagttgcggtccagctgctcctcacgggtctcgttcctgcccgacctgcccgtgtaatcctccacctcggacattgcctctcctccctccgcctgcctgctctccttctgctcttccggcacccggaaagacggcaggcgttgcaccgcgacctacatttgataagtttactgattattcgctccgatcggtggactttgttcctccggccgggatagcttcgaagagccggcgtatggcggagctcttcgaaaaccgacacagtgagcaggcggactatgagcgacacagacaagcagagggaccagccaaaggatccccggggcggctaccactccggcccgttcccggagcaggaacagaagcagcccgggctcacggcgccaatggaaccgaagcctgaccacggggaactgagctacgaggggcacggcaagctccagggcaaggccgccctcatcacgggcggcgattccggaattggcaaggccgccgctatcgcctttgcgcgtgagggcgcagacgtggccatttcctacctgccggaagaggaggcggacgcgcaggacaccgcggactggatccgcaaagccggccagcgcgtcctgctgtttgcgggagacggcagggaagaggacttcagcacccgcatcgttgaggaaaccgcgtccggtttcggccggctcgatgtggtggtcctgaacgccgcgtaccagaagaaccgcgaaagcctggagtcgctgcccaccgaggaattcgaccgggttttcaagaccaacctttactcgctgctgtggacggcgcgggccgcggtgccccatttgaagccgggcgcgtccatcatcaccacagcctcgatccaggccttcaacccgtccccggcgctgatcgactacgccatgaccaaagccgcccaggtggcgttcaccaaagcattggcacaggaactcgggccgaacggcatcagggtcaacgccgtggcccccgggcccatctggaccccgctgatcccggcgacggaatggccggacaaactccccacgttcggccaggacacaccattggaacgggcgggccagccggccgagctcgcggccgcctatgtgctgctggcctccgaggacggctcctacatttccggggcggtgctgccggttaccggcggcaagggcctctagcgctttacccacgccagcagagcagcttcatccgaaccgacaacaggaggaaaccatgacgcaggacaaccagcacgcccagcccgaatcggacccgggcggctacggcactcccaccgctgagcaggaaatgggcggatcccaggcctcagcgaatgggtccgggtccggcacgggcagcgctgacaccaacgagccgcagtccgatccgcaggcggatccggtgccccgcgacgttgacctaccctccagcgccgccgagattgatgagtccaacgacgactcgcaggggtcggcgccggtctcgtccgaggccggacaggaagccgccggacttccggacggcagcggcaacgacctgcccgaggagaagtcaccgaacgacgacggcggcgagagcttcgacgccggataacgggccgggtgccgctccctgggggtgcccgtattcctttggaggcctccgctccgtggttccctgcgaacccggggcggaggccttcggcatgtccggaggcggcgtacttggtcgcgtccgccgcgtgagtccgtcaggctgaagcgcactgcccctcccttgaaacgcgcgggggacgtattcttagaaagaggttttgcagtaggccggagcgcttcaaccaaggcgtaaatcatggcggctgaacccgcagcgcagctcggctggggaccccttccagtacccccggaacaggtcttcgacagcaaggacgtcgaaacgtacctctgggaagtcacccgtgacttcatggcggacatcaagggcgagccgcgcggcatcagctgggcggccacgctcttccgcctggggcaggcacgcaccgtcgccgccagcaccgaggaagcactcaaagcaaaccaggaacagtgctccttcgctgacgggccggccatggaagccctccgaaccggcgaattcgtgctgctgtccgacgtcagccgggaccggcgctggcccgggtacgccagcgcagccgccggccacggcgtccagtcgctcctgtccatgcccatcgcctccgagggcgggacgagcgccgccatcaacctctatgccgcgctcccgcacgccttcagcagcgacgaccttctccgaagccgcagctacgcgcagcaggtggctcgggccctgcgtgttgtggtgcggacggccgagcgcgccgaagccaaggcggggatcgccgtcgtccaaagctcccttgtcctggtggacctggcggtgcgcagcctcatggacgagtacggcctcaaccgcgagggggcacttcggttcctgcagacacaggcgctgcaccacgaactcgacctgcgcgatgccgcgctgaacgtggttgcgccggggcccgggagggagaaccccagggccggggagccgggcagggagcctgccgggctgaggcagggaacgcccgacggcgtcgcggacttccgcctgctgcccccagccgagctggagcaggaggaacagccccgccggcgtaaagccggccggggcaaggacccctcacacaccgcggaagggaggacggcatgacaacgccgaagcaggagcagtcgcccggccggccagttggcctggatgtggtacgtccggtggaacaggctcctggagcagggcagcacccctggcaccgctttgtggcactcggcgactccttcacggagggtatgggggatcccgagcccaagaaccagggcgggctgcggggctgggctgaccgggtggccgaagagctcagcgcgggacagcctgattttgcctatgccaacctcgcgatccggggcttgcggctgcagcagatcctggatcagcaggtcggcccggcgctggccgcacagcctgacctggtgacgctgtccgccggcggcaacgacatcgtgttccgccgcggcgatccggacaagctggccgagaagatcgacgccggcgtggagcagctcacccgctccggggccactgtggtcctcttcgccggccccgactggggcgccaccccggtcttcggccagatacgcggcaaggtggccatcctgaacgaaaacctccacgtggttgccgcccggcataacgctgtgatggtggacttgtggtgcctgcgcgacctcaccaggcctggcatgtgggaccctgaccggctgcatttctcgcccctgggtcaccacaccatagccttgggggtgctgcaggccctggccgttccccacaaccttgaaccgttgcagcccaaggcgcttccggcgcgcaactggaagaaagcccgggccaacgacctcgcctgggcccgggagtacctcgtaccctgggcgatccgccaggtcaggcaccccgcggaggctccgctggttcccaaacgaccccgccccgggcccgtcttcgggcacctgccaatcgtccatccgcagggactgcccgccgagcccttgtccctggccgagcccttgtccctgaaggaggcctagcgctttttcggggcgcgcctggcggcagcgttccccgacgccttggcctggggaggcagccccgcctgctcggtttcgggctcggctacagtgccccgcgccttcgcgatggccttcatgccgtggtagatcaccagggccgcggctgatcccagtgcgatgccggtgaacttcaggtcaccgatggtccaggtgtagtccgcgatgccgatgatcagggccaccgcggcggtagtcaggttcaccgggttcgagaagttcaccttgttctgcacccagatcttcacgccgaggataccgatcatgccgtacagcatggtggccgcgccgcccagcaccccggccgggacggtggctatgagctcgccgaacttgggggagaagctcaagacgatggcgaagacgccggccacccagtaggccgccgtcgaatagaccttggtggcggccatgacgccgatgttttcggcgtaggtggtggtgccggacccgccgccgaagccggccaggacggtggcggcgccgtcagccatcagcgcccggcctgagacgccgtcgaggttctggcctatcatggcggctacggacttcacgtggccgatgttctccgccaccaggaccagcaccacgggcacgaacaggcccaggacgcccacatggaactcaggggtctggaactgtggcaggcccacccaggctgcggcctccatcttttcgtagctcacctcgccgcgcagcatcgccacaaggtagcccaccaccacgcccaccaggatgctgaggcggcccaggatcccccggaacagcacactgaccaggatgatggtggccagcgtgaccacggcggtgacgggggcgtcgtcgaaattgttctttgctgcgggggcaaggttgagcccgatcagcgctacgatggcgccggtgacgatcggcggcatcagccggttgatccagcccgcgccgaacttctggacgatggcgcccaccagggccagggccgcgccggccaggaccacgccgcccagtgctcccggcacgccgaactgctgctgggacgccatgatgggtgcgatgaacgcgaagcttgagccaaggtagctgggaacccggcctttggtgatcaccaggaacagcagcgttccgatgccggagaagaacagcgtggtggcaggcggcatgccggtgatgatgggtaccaggaacgtggcgccgaacatggccaccacgtgctgcatgcccacgccgatggtcagcggccaggccagacgctcatcgggggctaccacgtgccccggcttgatggacttgcctgtgccgtgcagcttccatttgattccgagcatgctcatgggcggaggcctttcgggggctttcgggggtgccgcggagggcggagattaactgggacaaggataccgcccgcgccctgcccgccgactgctgtgtccgatgtcacgggcggtcacgggaagaggacatggctggttgaagttgcaaccattgaaagcatcgaggccggccccaagcaaacggggaggcacagcgaaaggtacgccaatgaccattgcccacgaagaagcggttatcgattcggccgccgtcgacgctattttcgcgcaggcccgcaccgccaactcgtttaccggagaggtgaccgacgagcaggcgcaggccatctacgagctcaccaagttcggccccacggctttcaactcccagccgctgcgcgtcacctatgtccgctcggacgaagcccgcgccaagctggttgacgccctcatggcaggcaaccgcgccaagaccgcgtccgccccgctggtggccatcctcagctacgacaccaactgggcgggccagtgggacaccttcctccccggctacaacgcccccaaggccatgtacgacgccaacccggaactcgccgccgccacgggcaacaataacgcgcacctgcaggccggctacttcatcctggccgtccgctcgctcgggttctccgcgggccccatgaccggcgccgacttcggtgccatcgatgaggcgttcttccccgcgggcggccagaagagcttcctggtggtcaacatcggccagcccgcagaaggtgcctggggcgaagccaagcccaagttctcctacgaggacgtcgtccgcaccgtctaggacgctctcccacttaatgcacccttttggccatcgctctctcctgcgtgagagagcgatggcggttaaggcgcattaagtgagagagcgtcgggccgcgcgggcgggcataggggagtggcacactgggcggatgcggaacttcgtcctcgtcgcgttcgtggagccggccgctgaaggccaggtctttccgcggacgcagtggcccctgcacatcacgctggtgaggttcgacgtcgacgacgccgctgccgaacaggttgcggcgctcgccgggccgcctgcggagaaggcactgggcgccgcactgacggtgggggaggacgcgggtttcggccggaacggctccgtgcccgtcagccttgtccagccgcagccggacctgcaggccctgcacgagcagttggccacggcagtcgaaagcgccggcggcaggatcctcacgccggcccacaccaggtccggctaccggccgcacatctcccacctgcacggccgccgcctgagcccgggcggcaccttggtgcttgaccgggtggcgctggtggacatggcgccggacggtgaccgcaccgtccggcgcatcctgcagctctggagcctgccggaaaccggggcagctaggcgataacgctgtccaccagggccttggcttcagcctggacctgcttgaggtgctcctcgcccttgaaggactcggcgtagatcttgtagacgtcctcggtaccggacgggcgggcggcgaaccaggcgttctccgtgacaaccttgagcccgccgatggacgcgccgttgccgggtgcctcggtcagcttggccaggatgggttccccggccaggctcgttgcggtgacatccgacggcgacagcttgccgagtgccgacttctgctcccgcgtggctgctgcgtcaatgcgcgcgtagacgggggcgccgaactggtccgtcaggcccttgtagagctgggacggtgacttgccggtgacggcagtgatttccgaggcgagcagggccagcaggatgccgtccttgtccgtggtccatacgctgccgtccagcttgttgaaggaagcgccggccgattcctcgccgccgaaggcgccctcaccggagagcaggcccggcacgaaccacttgaagccgaccggaacctccacgagcttgcggcccaggctctgggccacgcggtcgatgatggaggacgacaccagggtcttgcccaccacggaggccgggttccagccgttgcggttgcggtagaggtagtcgatggcgacggcgaggtagtggttggggttcatcaaaccgccgtctggggtaacgatgccgtgccggtcggcgtcggcatcgttaccggtggcgacgtcgtaggctgcggtcccgtccgcaccggcagccatccgctggatcagcgaggccatggcggccggggaggagcagtccatccggatcttctcgtcccagtccaaggtcatgaaggcccactgcggatccacggtggggttcaccacggtgaggtccaggtggtggcgctcgccgatctcgccccagtagtccacggatgcaccgcccatggggtcggcgccgatgcgcacgccggcgttgcggatggcatccaggttcaggacggagggaaggtcgtccacatagctgctgaggaagtcgaacttgccggtggtgtccgcagcctgggcgtcggccagcggaatccgcttcaccccgcgcaggccgttctccagaagctcgttggcgcggttggcgatccagccggtggcatcggaatcggcaggcccgccgtgcggcgggttgtacttgaagccgccgtctgccggcgggttgtggctcggcgtgaccacgatgccgtctgcctgcggggcgccggcgccggccttccggttgtaggtgaggattgcgtggctgagcgccggggtgggggtgtagccgtggcgggcgtcaacgaggacctggacgccgttggctgccaggacctcaagcgcggagttctgcgcgggctcactgagggcatgcgtgtccttggccaggaacagcggcccggtgatgccctgccccgcccggtactccacgattgcctgggtgatggcaacgatgtgttgctcgttgaacgacgctttcaggctggagccgcggtgtccggacgtgccgaacgccacgcgctggccgggatcacccagatcgggcgtgatgtcgtaatacgcgtcaaggagcgcagtgatgtcaacaaggtcctggggttgggcaactgtgcccgcgcggctagccatgccaccagcatgccagacagggacctgagtcaaaacgatccgtccggaatccggccactgtgtccggcctgtgacggaagatcgtcatcaaacgagtagtcaccctgagtacaggccccaccaaagtacttatataccggccgccccacgccctgttactttcaaaaaagtcggggaattcatccgaaagcaaggcacgacggcggccccccggcgtcgtccttccggcagggaagcaggggcggccatgggggcaggagacgggaaagccgagcagtccaggctggccgctgaaagggtggccaggctcaagcgccggctcgacgaggccgaaggcgctacaaagccctgggacgcggatgccttgagcgagaaattggtggcggacaagctgggcgagctgatcccgcgcggctggtacgtgctccatgacgtgcactggcccggccggccgaaagccaacctggaccacgtccttgtggggcccggcggagtggtggtggtcgactgcaagaactggaccggcgaagtccgggtgttgtccggggtgctctggcaggggcgttacgccaggacgcaggctgtggaaggcgcccttgcccaatgtgccgcggtgtcgtccgtggtgtccccgccataccggcggctggtgcgtcccatgatctgtatggccgcccagccggacctgtttggggtgactgcctcggacgtggccgtggccggtacacagcgtgtggtgggtgctatcgaggcgctgccccaggtgctggaccagaggaccgtggcgggactttacgcgcagctcggccaggacctcacccatgaacaggaaccgggcatcatggccttccggcacgtccgcccgggcacggtggttccgcccgcggcgccacccgcgaatgccggagctccagccgccagatcgggttcgtcagtgcgtccggtggtgcggggaaactcttcggctgccggggccggggatggctaccgttcggcgggtcaccgtgccgctccaaaggcccggctgcacggtactggcggcgccggacggttggccctgcttgcggcgttcgtcatctttgcggtgtacatattgccctattgggggcaatagatccgtccccgggccgggggtaggctggaaccaagaatgcctagggggaaccatgtctgaccagcccagccagcggcctgaatccggccaacccgactccagcgcgccgtccggtcttgaaccgccccggttcgcgccgccctacggcagccagtcgccgaccgcggcgccctacgggcagggcagctatgggcaggacagccgagggggcggctacgggcagggcgcgtacggcgaaccgggccagtatggcggggcctatggccagccgccgagcccgtataaccaacaaccctccccctatggccagcctgccggcccgtacgcccaacaggggtactacggcatgcaggcggagccgaagacgctgagcattgccagcatggtgtgcggcatcgcctcggtgatcatgggctggctcctgctcccgcagattgcagcaatcatcaccggccatatggcgctcaaacgagaaccggcgggcaggggcatgtccattgccgggctggttctgggctacctgtgcctcctgggctacggcgcgttctggctgctggccatcatcggcctggcgattgccagttccacgagcggtccgacgtacacgttctaagcggcctgacgctcatccacctgaacgctgggacggcggcccgcgcctgcggacgtgccgccgtcgtgcattccacccaggctcctcaccccatcagatgggtgcctgcgttggcgggatgttgtggttgaggcggaagacgttgtggggatcgtagcggtccttgagggccgccaggcgctggaacttctccggcccgtacgctgcgcgggcagcgtcctgggccctcggccccacctcagcgccgaggaagttgacgtactccccgtgctccgcgaacggccgcatgagcccgtaggctttccgggcgaacgcggtcagccgctcgtcctcagaggggtcgcgccagaagccgtagacattgagccagtagcgggcagaacggttggggaacgccgttgcatcatccgttacccgtccgaaagccccctccatgtggtggatgtctatgccggtaccctcccacgccagctcggaggcgaaactcagcaggacatccactgactccccatcgagacgcgaaaaggagacgttcttccagtagccgcgcgaacctttgggaaacacgctgtccatggcgctctgccagtcaagccaggaggtagggcctacttcctcttcgtcaggcggggcggcggcccggagctggtcaaccagggcgagccctgcttgctggtcctccgccacccacacgaatccgatgatcatccacgggtcgccgcccatcccgaattccgccgggaagaccaggaacgaggtgatcgggttcatctcgtccggcaggtcccgggtccaggcggcaaaggccaggagggcgttgcgccagtgttccggccggtagaacaggttgcctcccagcggctccggcggcagggggcgggcacggaaggtgaaggaggacgccaccccgaagtttccgccgccgccgcgcagcccccagaacagctccgggttctcctgcccgctggcgcgcaggtgttcgccggtggcggtgactacgtccacggcttcgaggttgtccagggtcaggccgttggagcgtgtcagccaacccacgcctccgccgagggtaagccccgccacgcctgttccgctgatcactcccagcgggacggcaaggttgtgggcagcagttgcgtggtcgacgtcggcaagggtggctccgggttccacggtcaccagcctgctcccggcgtccacctggacgtgcttcagcggccccaggtccagtaccagcccgccttcaacactgccgtgtccggcgatgttgtgcccgccgccacggacggccagcgccaggccgctgctacggaccgcgtccagcacggcgtcgatgtcggcgatcgccccggcacggacgacggcgcgtggccggagatcgaccatgccgttccatactggccgggcttcttcgtacaacggatcatccggctcgatcaggattcccgacagcctggcgcgcagcccgtgcagcgcctgctgtatttccagttcccggttggtgtggtgggctgtggacatcatcagtgcttccgctatgggcctaaaccctttggaatatgagggggaagtaaaaggcgccggaggagcctcgacagaagaaatacctgcgaacaccagtgggcaggctcatgcgatgtccagagtttaagattcgcgaaaggcccggtcaacagctttttggcggcctggcttttcggcggcttgacctattggacgcgcggccgcctgctggctgagtgcagctagcggagcagctccacgtccgagaccagctcgatgtgggccagcatggcctccgctgccccctcggcgtcctggctccggatggcttcggcgatcttgcggtgcgaggcgagtgactgctcgggccggccgggctggcccagggattccatccgcgtctccaggatcatctccgcgatgaaagccatcagctgcgccagcacggaggagtgcgctgcggccgtgatggcctcgtggaagagctcatcaccgtggacgccgcggtccccgtccttgatctcccgcgccatgacgtcgagggcgttgtcgatggcagccaggtcctcatcggtgcgccgtgccgcggcaagcgcggcaagcttcacctccagggtgctgcgcgcctcgacaatttcaggcagcctgctgcggtgctcgcgcaggcccttgatgacggaggcgacgctgggccgccgcgccaggactgccccggtcccgtgctggacgtcgatgacccccagtacttcgagggccaccagggcctgggcgagggttgcgcgggaaacgcccaagcgctccgcgaggtcacgttctgccggcagcaggtcgccaggtttcagctgcgcagattcgatgtaggacaggatctgctccaccagctgttcatacagccgggggcgggaaacgcgttcaagtcccagccgtgatgccttctccacaaagccctcgctacgtcgtcggtccctccagaatacaggccgcactattgacagaatgactcggtgtctaggaggctagtccagtgagccagttactcacgtcacacttttcattccccactggaggaccaacgatgtccgctcctgttttatcgatcatcatcctggcggcgatgttcctgctcgccaccgtcctgcccctgaacatgggcgcgctcgccttcgttggcgccttcctcctgggcgccgtggtgctgggcatgtccaccaatgacatcctggccaacttccccggcgggctgttcctgaccatcgtcggcgttacgtacctcttcgccatcgcccagaacaacggcaccatcgatctcctggtccggggggccgtcaggatggtgggaagccgtgttgcactgattccctgggtcatgttcgctgtcactgccgtcattacctcggtgggcgcactgtctcccgccgccgtcgccatcatcgcccccatcgccctcagcttcgcgggcaagtacaaaatcaacccactgctgatgggcatgatggtgatccacggtgcgcaggccggcgggttctctcccatcgccgtctacggcgtcacggtaaacggcatcctggccaagaccgacctcgacttcagccccaccgcgctgttcctgtccagcctcgtgttcaacctcatcatcgccgtggtcctctttgttgtccttggcgggcggaagctgctgtcctcccgcgtaagccacttcgtggagcaggccgcggaggcgcggatgtcagtcagcgtcggcgccaaggccggctccgatgttcccttcaaggggttcggctccggcatgtacggcccccgggatccggcaggcgacggcgtggcggccaccaaggagcgctccgaccgcgtcccgcagctggtcaccattgccggcctcatcgccctggctgtcatcgccctcggcttcaaggtcgacgtcggatttgtctccatcaccatcgcgatcgtgctggcgctggtttcaccggccgcccagaagggtgccatcaacaagatcagctggtccaccgtgctgctcatttgcggcatgctgacattcgtcggggtgctggaggaggccggaaccatcgagttcgtctccaacggcgtggccgggctgggaatgccgctgctggcggctctgctgatctgctacatcggtgccgtggtgtccgcctttgcttcgtccacagccatcctcgcagccctcatcccgctcgccgtcccgttcctttccaccggcgaaatcggcgctgtcggcgtgatctgcgccctggccgtggcctccaccatcgtggatgtttcgcctttctccaccaacggtgccctggtccttgccaacgctcccgaaagcgtggacaaggaccggttctacaaacagatcctgggctacagcggcgtggtgattgtggccgggcctgtgctggcctggctcgcactggtggtccccggctggctctagcccgcatccgcatccgaaccttcccgctgtcatgagaaaaggaaccagcgcatgagcagaaccgatagtacgcaaggccccctctccggccacctcgttgtcgacctgagccgggcccttgccggaccgcatgccgccatgatgctggcggacctgggagcgcgcgtcatcaaggtggagaacccgggcgccggcgacgacacccgcggctggggcccgccgtttgttggccccgaggatgacctccagtccacctatttcatgtcctgcaaccgcaacaaggaatccatcagcctggacctgaagagcggcgacggccaggccgtgctgcggcggctgctggagcgcgcggatgtggtgatcgagaatttccgccccggcgtcatggaccggctgggcttctccacggccgccatgcacgggatcaacccccggctggtggtcctctccatcaccggcttcggccacgacggtcccgagtcccagcgcagcggctacgaccagatcctccagggcgaggcggggctgatgtccctcaccggttccgggcccacggatccccagcgcgttggcgtccccatcgcggacctcctcgccggcatgaacggcgcctccggggtgctggcggccctggttgaacggggccggacgggccacgggcaggtggtgcggacgtcgttgctggcgtcactgatcggggtgcacgccttccaggggacccgcaccacggtggcgggcgaagttccgcaggcccagggcaaccaccatccgtccattgccccctacgggctgttcgcctgccggagcgggagcgtgcagatcagcgtcggcagcgaaaggctctgggcctccttcgcggccgccttcggcctggacccggcggcgccgggctttgccagcaatgctgaaagggtgcggaaccgcgccggggtgattgccgccgtcgagcgcgtctttgctgactatgaggcagcggaactgctgcagaaactgaacgacgccgggatcccggcaggcaaggtgcgctcgcttgacgaggtgtacgcgtgggagcaggtggcgtcccagggcctcgtggtggacgtggaacacccgctgctcggcaaggtcagcctccccggcccgccactgaggttctttgccccgggagacgccgctgaaaccacgcttaccgaacacgacgcgccgcccctcctggacgaggacggtcaggacatccgccagtggctgggcatggcagccaccgtgacggccggggcgcaatagcatgccgacggcggaaaaggtgcggcacctgagcgcggctgaactgctggacaacgtggtggacgggggctccttcgtctcctgggatgtgccggcacaggaacccgaggtctccgcagagtactgccgcgacctggcaaaggcccgggagcgcagcgggactgacgaatccgtgatcacgggcgcggggctcatcaggggccgccgggtggcggtgatcgtcagcgaattctcgttcctggccggttccatcggccacgcggcggcagagcggatcgtagccgccgtcgagcgggccaccgcagaggggctgccgctgctcgccggcccggcctcgggcggcacgcgcatgcaggaagggacactggccttcctgtccatggtgaagatcaccggggccgtgcgggcacaccgccaggccgggcttccgtacctcgtctacctgcggcaccccaccaccggcggcgtcatggcctcctgggggtccctgggccacatcaacgtggccgagcccggggcattgctggggttcctcggcccccgggtttacgaggcgctgtacggggaggctttccctgcagacgtgcaaaccgccgagaacctgttcaacaagggactgatcgacggcgtggtggagccggaccagcttgccgaccttgtggcccgggccctggacatcctttgcggggagaaggccgccgttcctccggcgcccgcgacgctcgcggtgaggcccgctgctgcggacgcctggacctccatcggcatttcccgccatcccaagcgtcccgacctgcggcagctcctgaaatatggtgccgttgatgcgctgccgctcaacgggacgggccagggggagaaggaccccgggctgctgctggccctggcgcgcttcggcgggcagtcctgcatcgtcctggggcacgcccgcccgctgcgcaaggacgccgccggcatgggtcccggttccctgcgggaagcccggcgcggcatgaaacttgcggaggagctgcggctgccgctgctcaccgtcatcgataccgcgggtgccgcgctctcgcaggaggcggaagaaggcgggctggcgggagagatagcgcggtccctgcacgaacttatcgggctggcggctccgtcagtctcggtgctgctgggccagggatccgggggaggggcgctggcgctgctgcccgctgacaggaccatcgcggcgcagcacggctggctgtccccgctgccccccgagggggccagcgccatcgtgcaccgcacggtggagcatgctccagcgatggcccaggcgcagggagtgaatgtggcgtccctttacgcccacggcctggtggaccacattgtggacgagcgcgatgatgcctcgctggaaccacgtgagttctgccggcggatggcccaggccatcgaatatgagctggcatcgatcgccggtcttcccgtgcaggggctcattgccgcgcggtccgcgaagtaccgcaccctcggcgcacggtgagctgaccgcgccgcgtgcgggccgccgtcggactccagcccggcttcgttttcgggactgggctgcgcggcaccgcactgcttccggcggtgccgcgctacttccgttgccgcagccgggcgcggtgggcattcctgcggagctggaggatacgggcgccgcctgccatggcaaccaggacccctccggtcacgctggcaataaacagggccatgcccagcggcacaaggccttccaggccgaagtaccgcactgccacctggtcctggttctggaggatgaagatgatcagcaggatcaggagcaccagtgccgctacaactgccgcccagacaacacctgcccgggtcacccctggctggtccgcagcggaggacggctgcggtacgggcgtgccggtgcctgccggcaggggcgcgtccggacgggtcagtgcggagtccgcagttgaatccgcgggtgagggtgtgcgggccggcgccggggggacgccggcatggtttccggttcccggttccggctgtcctgcggatgggtagtttccggtactcatgctggttcccttcgtcacgtgcagataataagcatgcttatggttcaaccatagtgggagggtttgccgctgcacaatgcgggacgcgccctgctccgccccgccgccggcctggaaacaacggaagggccttcagtgaagaccctccccgtgtccttggcgcggcctcagaccctctccttgctccgttcagctgaaggggtgcccggcgcccgcgtcttccgccagcccgggaatgcccagaacgtgaagtcctgcgccttgaccggcttctccgtggtctcctgctttgcctcgggcttgctgtcggcttctttcctgatgccccacccgaagtccttgctggatgaatagcacatcacagacctcctcacagtgactgccctttaatcgtcctccagatccgctgcggagtcgacacctttgcgcaaggccctggccaggcttccggcgctcgttccctccagcgcggtcacccgccagcgacgacgctgtcggcttcctgcgggcggtggaactcgcacggtccatggtgccggagcggcaggaggcaggtccgtccggtggggagatggaccagggcgcagcggccccgcccggccaggtcctccctgacagtggcgttgctgagatccggcctggctccgtccggttggggacgcacctcgccggcagccgtactggaattttcagctttcataagggaactcctcgtcgagcagtggctggcagaagggtgccgcggcctggcactgccacaagtctgctccgcccgggttacaggcgcattaagccggcgttaggaggaggtcaacagcggcaccgcgggcagccagttcagagccccaactggcgcgccacctgcagcaggagggattctgatcccatgggtcccacaagctgtattcccatcggcagcccctgccctggcgcgccgccggtccagtgcacagggagcgtgatggccggcagtccgcagacgttcaccatggaggaccagggcgcgtattcgcactgtttgcggtagtcgccgtcggcatcgcccggccactgcgccgcgggccagcggtcagtgccgtgcatggcaccggtaaaccagcccacagggcgaggtgcctgggcgagggtcggcatgagcatcaggtcccactgcgcgtactgcgccacagtgtcatgctggaactgccgcaggaacgccagggactcggcgagtttcgccgggctccgctgctgggcgcggcgccggaacgtgcgggtcaggggcgccagcagcgcttcacggtggggactgatcctggccgctcctactgcggcggtccacgcggtagtgaacgcgtcgggataccggttgtcgtaccggatggaagcttcgctgagggcgtgtccggcatgctccagcaggtccccgcccacccgaagggcgtccagagcaacctgctccgggacgaaggggaaagtgccggaccacgggctgtccaggctgatgccgatccgcagccgcgggggctcctgtccaaccgctgcaaggtagccgccctccggccggcccgcagcgtcaggcggcaccagggcatccatcatgagcgccgcatcaagggaatccctggcgatggggccagccaccaccagccgcgcgggatcaccagcaccctctccggccgggaccacgccgcggcccggcttgagccctaccagcccgcaggcggctgcggggatccggaccgagccaccgccgtcggtgcccggtgcgaaaggcaggagtcccgcggccacggcggcagcgctgccgccggacgagccccctgagctccggctcagggcatggggattgcgcgacggcggcgcgatccggttttcgctgtaagccgtcagcccgaattcgggaacctgggtcttgcccagcggggtcacgcccgcttccttgagcagggccaccaaagggccgtccccgggcgccggcttgtggtccaaggccgcgctgccgtgggtggtcaccacgcccgccacatcggtgaggtccttgaacgccaggggcataccgtggagcaggggcaactcgccggcggggatctgggaacgcactgaatcggcggtgcgggcgtcggccatcgcctgttccgccgtcaccgtgatgaaagcacccagcagcgggttctgctgttcgatcctggcgaggaaatgcgccgcggcctccgcagctgacacatggccttggcgcaagaggtcccgaagggcgacggccggcagttcgtggagttcactcaaagccgcacgcatccgcgtaacggcagtgccggggcgggaagcttcggcttcccgcagcggccagggcgggctgctcacggaacaacggttcctcctagggtcactcagaagcttaacgtgggccgggcctgccgccaggtgaaggcgaaagcactaggctttaacccgacaccgatccgcgaaggcaggaccctccatgagcgatttcgacaacgtccccgtcggcgacatccccgatgatgccgtcatccttgacgtccgcgaggactatgagtgggtggcgggccatgcagatggcgcgctccacattcccatggaccagcttccggcgcggctggatgaactcgatccggacgatgatgtctacgtcatctgccgcaccggcggccgctcgttccgggctgcccagtggctcaccggccagggctataccgccatcaacgtttccggcgggatggacatgtggctggaggccggcaagccgctcgtctcggacaacggcctgaagccgatggtgctctagcaagcaggcctggagccgggcatgtcccgggctgcagcttctgccggcgcctcccgtcggcgcttataccgataaaggaatgtgtatgtccgcgtcctcccccacctatgccttcctggggccacagggtaccttcaccgaggcagccctcctgcaggtgccggacgctgcgcattccacccgggtcccggcgtcgaacgtcaacgcggcactggactgggtgcgcgacggatcagtccacgctgcgatggtcccgatcgaaaactccgttgagggcggcgtcaccgccaccctcgacgcgatcgccggcggcggcgagctgcggatcatccgcgaagtcctggtgcccatcagcttcgtgctggccgtaaggcccggagtccgcctggccgatgtgcggcgggtatcaacccacggccatgcctgggcccagtgccgccggtggatggatgcgaacataccggcagccgaatacgtacccggctcatccacggctgcctcagcactggggcttcttgaggaagaccgccattatgatgccgccatctgcgctccgctggtggcccgggagcagcccggattgtcggtactggctgaggacatcggtgacaaccccgaagccgtgacccgctttatcctggtcagccggccgggtgtcctgcccccacgcacaggcgcggacaaaaccacactggtggtcccgctccccgaagaccggcccggtgccctgatggacattctcgaccagttcgccagccgcggcgtgaacctcagccgcattgaatcccggcccaccggacagtacctgggggactacttcttcagcatcgacgccgacgggcacgtgggcgatgaacggttggccgacgccctggctgggatccaccgcatcagtcccgccacccgcttcctgggctcatatccccgggccgacatgcaggcagcaccggtggagccgcacactgctgatcaggccttccaggctgcacgggaatgggtggcgggcattctccggcctgcgcatgagtccgccgaaagcggttcccccgcttcgccgaaagcgtaggtgaatgccgttcgaagtacttccgcgggttgtggacaatgcgtatgcttacttgatccacacgggggagggcccctaacgaagggagcgcgtcatgaccgccagcggcaccgaaaacgacggccaggggatgatcgtcaacccccggcccactgccgacaaccaggactgggacggggacgacgccgaccgtgctgaccgcctccggtttgaagaagagcaagccatgatccgtgagcagtccgaggcccatgcagcggcaaaggcggctgaggagaagaagcgcaaaagcgaatagccgctaatcctggcccttgacccggatcagcaaggaccgcggctccacctggacggtgagcctggtagcttccccggcagtgtctccgtccaactggatggccatcggttcggggcatttgatgaccaccctcccggaccggtagacggtcatgacgggcagtttcccgctgtgcttgaacatgatcttgacgtacatcagcagccagccgagggcactgcgggggctcatcaccaccacgtccagcatcccgtcgtcaatcatggcctgcggaatgaagtcgatgccgccagggatcaggccgcagttcgcgaacaagacgctgcggatgttccggacctgctccgggctgccgtccagggaaatcgagaccttcttccggcgtcccggcaaatgccgcatgcctgcctcggtatatgccagccagcccaccgctttttttaggccgtcgttggtgtcggcgaggatttcggcgtccatgcctatgccggctatcaccaggaacacgtgctcggaggagctgccggtgcgtgagttttcgatgcccatccgggcagtgtcgatatggcgctgccggccgaacagggcggtgttgacgttggcatgcaggtcgttgaggtccaggtccacgttgcgcgccaggaggttgccggtgcccagcgggatcagccccatggcaacgttggtgtgcacgagggactcggccaccacgcggacggtcccgtcaccgccgcccaccaggacgacgtcgggcttgtacgcgagggccgccgccacctgtgagtagccggggtccgctgctgtcgtctcgaaaaagaccgggtcctcccagcctgccgccaggcagccgcgctggatgaggcgtttcgcttcgtccgactgtgccttgatggggttgaggatcaccgcgacacgctgttccgtgaggcccggatcctgggcatcgccccccacggtactgcggatgtggagggccttcagcctgcgcacgccccaccagcttgagatggcaaacgcaagggccaccccggtcagcaggtacaggatccagtcgctcatggtgcctcaacagtagcccggcggaagcctggcaggacccgcacgtcagctgccgcccgccgtcgtgcgcgggattggatacccttgtgtggtgatcgacgtaaaagacctcagcgaaaacccggacaaataccgtgccagccagcgtgcccgccgcgcggacgagtcagtggtggacgcgatcatctccgcggattccgcccgccgggcggcgctgatccgcttcgagaacctccgggccgagcagaacgcgttcggcaagaaggtggcccaggcgaagggcgacgagaagaaggccctgctggccgaggtcaaggagctggccaacgcggtcaaggcagcctccgccgaggccgacgccgcgcagagcaaacaggatgagctgctgcgcaccatccccaacgtcattgaggacggcgttcccgagggcggcgaggacgactacgtggtggtcaagacggtgggcacgccgcgtgaattccccgacttcgagccccgggaccacctggaaatcggtgaactgatcggcgccattgatatggagcgcggcgccaaggtttccggtgcccgcttctacttcctccgcggtgttggcgcccggctggagatggcgctgctgcagatggccatggaccaggccatcgaaaacggttttgtcccgatgatcacgcccacgctggtgcgcccggagaccatgcagggcacgggcttcgatgtaaagcacgacgccgagatctaccggcttgccgaagacgacctttacctggtgggcacctcggaagttgcgctggccgggtaccacgcggacgagatcctggacttctccgccggccccatccgctacgcgggccagagctcctgctaccgccgagaagccggctcgcacggcaaggacacccgcggcatcatccgggtccaccagttcaacaaggtggaaatgttcatctacaccacggtggaagaggccgccgccgagcaccagaggctgctggcgtgggaagaggaaatgctggccaagtgcgagctgccctaccgggtgatcgacactgctgccggcgaccttggcacctccgccgcccggaaatacgactgcgaggcctgggtccccacccagggcgcgtaccgtgagctgacctccacctccaactgcaccaccttccaggcccgccgcctgaacatccgcgaacgcgcggtgaatccggagggggtagccaagggcacccgcgctgtggccaccctgaacggcacgctggccaccacccggtggattgtggcgctgctggagcaccaccagaacgcggacggctccgtcaacgtgcccaaggcgctgcagaagtacctgggcggccttgaggtcctcccggtcctgtagctcccgctcctcctgcactcgggttgcaccctcgcatggacaggacacccgcgaacccgcgggtgtcaggtctagtggcgggtgcttcttgtattcccggggttgttcgataagcccgcctggcgcaggcacgcttcaagcagcagcggatcagaggcagtcgcccagtcccatcggactacccgaaaccccgccgcccggagtttgtcctcgcgtttcttctccgccaggacggcctggcgcgccgtttgaaccccgaggtactcgtcgcgcagatacttggcgtcgccgtcgaactccccaatcaaccggtggcggggccagaagaaatcagttcgagcgatgaggacccctcccacatgcactcttgcctgcagcaggggagccgggaacccgagaacatgcatgtgtgccctgctcaatgactcgcccggggactccgcgtctgtccccgcaaaatcgaggacctgcgtgacccatctgcgccttgcctccgaggtgagcagggaggcctgcttgagcagatccgctttgcccagaccggggccggaagaagaccgccggctgatggcgtggtctgccagcaccaccccggcagcgaagctttcccttgcaatgacgcccaccactgtctccggtaagggcgtcaccagaaggtttttgtggcgtaccgccgctgctggtcgtggatgccggcggacgccgtacgaggtgatccgttcaagtccggtctctcccgaggatcttcgggcagcagaagtcgttggcgcgctgcggccgacgtgccctctcgatgctcctgacaggtgaacgaagcccggcacttccaggagattcaggtcccacacaacagcagccgtatgcaggcagaacgttgacagcggcagtttcagggtccacagccaggactgtctggcggtacctttcccacggcggcagcgaagtccactcttctttcgatgcatagatgcccttcctgacgcggaccagctcgccgcgggcatagcggcggctgagcgagcggacgtctccagtgctgcggcggacgttgccggcatgaatcaactgcatgcggctatcctcgggctgcgtgtaggacggttgaagcgtggaaccggttcatgtggataactgcaaagagcggggtgcaccccggaacagtccaagcaccagcgaactccggggtgcgctgtcctcaaagcggtgtccccagtgctgcgcccacatggccgcagcaaaccaacaagtgttaatgcggagttcaacatatctgtggcctgcgtcctagcgccgccgggggtcgtctggttcactatgtgaatgacaacgctgactgaaacctcagtcgccggcaacgatgaccggcgagacaacgaaaacaacaacgggcacaagctcatggtcgccctggacgtggacggcacgctggtggaccacgacggccacatgtccccgggcgtgcgggaatcggcgcaggccgtggtggctgccgggcacgaggtcatgatcgccacgggccggtccctcaacgccacattgcccatcatcgagaagatcgggatcgagcgcggctacgctgtctgctgcaacggcggtgtgaccctgcgcctccaccccgggctgaacggcggctacgaggtcatccacaaagccactttcgaccccgggcccgccctccgcgcgctccgcgagcggcttccctcggccaagtacgcgctggaggacgctgatgggaacttcctgtccaccgagcgcttccaggaccccagtttcggcgtcgaggctgtcggcgtggatttccacaccatgctcgaggccacggctgtgcgcgtggtggtcttcagcacggagaacaccccggaagagttcaacgaggcgatcgagcacatcggcctcgccggagtcacctactccgtgggctggaccgcctggctggatatcgccgcggccggcgtgaccaaagcgagcgcgctcgagaacctccgtgggaggctcggcattgaacagcacctcacggtggccatcggtgacggccgcaacgacatcgagatgctcacctgggccggacggggtgtggccatgggtcaggcgcccgaggaagtcatcgccgctgcggacgaggttacccactccgtgttcgacgacggcgccgcccacgtgctgcgcagcctgctctaacgcagtacaaggcacaatggacagcatgaccctcacgactttcgccctcattcgccacggccagacagactggaacgcgcagcgccggctgcagggatccacggacattcccctgaacgacgtcggccgggcccaggcgcgcgacgccgtcgctgtgttgtccgcttacgaatgggacgcgattgtgtcctcgcccctgagcagggctgccgaaaccgcggacctgatcgcggccgggctgggcctcagcgatgtgcgccgagtcccggaactgacggagcgcagctttggccccgccgagggcatgcaggcgggtcccgagctggaagcgttgcgcattcccggcggtttccagggcggcgaaagcgaggacaaggcagcggaccggggactcgcagccctggaggcactggccgaggaattccgcggcagccggctcctcgtcgtcgcacacgggacgctcctgcgggtcagcctcagccgcgccgtggggagtaccctgaccagcatcgacaacgcggtgctgaacctggcgcaccaccatgccatcgacggctggcagctggaatacttcaacggcgaaccggtgatggccgcaacgcagcgctaagccaggccgccgctagcgcacctcaaggatcagggccagcagccttgccgccgcaggccgggccgcgtgctcctcattccactgcgcccgtgccactgccttactgacggcctgtgtggtgatgcccagttcctgggccaccgccttctgctggccgcggacgccgggggtcatcaggtccagcacccgccactcggccccggaccggtcccgcacgatatgccccagcagccgcagcacggcttcggcgtcgtgggctatgtccgccagcggcccctccactgcaacgggcacccgctccttgctgttgcggagccggtccacggcacgccgcgcgtacaccagcccgtggcccgaggcgtccttgatctggttgggcagcggctcgttgacaggcccgacgccgatccccacgtaccaggaaccgcaccgcagcgcgatcatcgctgcctccaccgcctggtgagggcagtccacgatgccctggacctcgtcctccaccgaccggtcgaagtcgaggcgcgcaggaatatgccgcaggtccttgaggagctgcggcacccggtcgccatcgcgccggctatccgtctggttgattgtcagcgtgaacatctgaatccaaagactaccggttggtagcagtccctgggcaagcggggttgcctcgggctggcccatctggtgcgatgggggaacggccgcacctgcctgatggcgacagcgggggaacacgctacctgaggacggttatgaccagcagcatggggcacgacgaacttgaacttgtggaccgctggtggcgcgccgccaactacctttccgtcgggcagatctacctccgctccaacccgctgctgcgcgaaccgctgaaggccgagcacacgaagtcccggctgctgggccactggggcaccacccccggcctgaacttcgtctatgcccacctgaaccgcgtcatccgccgcgactccgcggaaatgctcttcgtggcaggtcccggccatggcggccccgccgtcgtcgccaacgcctggctggaaggcacctactccgagatctacgggcacgtgggcaacgacgccgacggcatggccgagcttttccggcagttttcctacccgggcggcattcccagccatgccgctcccgaaacccccggctccatcagtgagggcggtgaactcgggtactcccttgcccacgcctacggctcggtgctggacaatccccagctggtcaccgccgtcgtcattggcgatggagaagccgaaaccggcccgctcgccgccagctggcactcccacaacttcctggacccggccgctgacggtgccgtgctgcccatcctgcacctgaacggctacaagatcgccaaccccaccatcctggcccggatgccggaagagcaactggaacagctcctgcgcggctacggccatgaaccgtatttcgtcactgtgaaggacccggacaacaccgagcaggcgcaccgggacttcgccgaggccctggaccgcagccttgccggcatccgcgccatccaggaatcccgccggaggccagaatccggaaccgacggggcagagggtgtggaaggtgccccgcgctggcccatgatcgtcctgcgctcgccgaagggctggacggggccgcgtgtggtggacgggctgcaggttgaggggacgtggcggagccaccaggtgccgctctcggaggtccgcaccaacggggagcatctgaagcagctggaagagtggctgcagtcctaccggcctgaggaattgttcgacggcgacggccggctccggcccgatgtcgccggggccgcgcccgccggctccttgaggatgagcgccacgccgcatgccaacggcgggctgctccgcaaggcgctgaagctgcccgcgtaccgggaccacgccgtcgaagtcccggagcccgggacggaacgcgtcagcccgatgatcacgctcggctcgtggatgcgggacgtcatctcgctgaacatggaaaccttccggcttttcggtccggacgagaccgcgtccaaccgcctgcagaacgtctacgaggtcactgacaaggtgtggcagtaccggattgacgacgtcgacgagcacctcgcgcggtccggccgggtgatggaggtgctcagcgaacacctgtgccagggctggctggagggctacctcctgaccggccggcacggcgtcttcagctgctatgaggccttcatccacattgtcgactccatgttcaaccagcacgccaagtggctgaaggtgcaccggcagctgccgtggcgccagcccgtgccctcgctgaactacctgttgtcctcccacgtgtggcagcaggaccacaacgggttctcgcaccaggacccaggctttattgaccatgccgtgaacaagaaggcggaggtcatccgggtgtacctgccggccgacgccaacaccctgctgtgcgtcatggcccattgcttggcctccacggactacgtgaacatcgtggtcagcggcaagcagccctcgcccacgtggttgggcccggccgacgccgccaaccactgccggcggggcctgggcatctgggacttcgcggggtcagaggtgcccggcgaggagcccgacgtcgtgatggcctgcgcgggcgacgtccccaccgtggagaccgtggccgcggcggaactgctgaaggagggcgcgcccgggctgaaggtccgagtggtgaacgtggtggacctgatgcggctgcaggacgagagcgagcacccgcacgggcttccggcgcgggactttgacgggatcttcacggcggacaagcccatcatcttcgcctaccatggctatcccgcgctgatccacaggcttgcctaccgccgcagcaaccaggacgggctgcacgtgcggggctacaaggaagaggggaccaccaccacaccgttcgacatggcgatgctgaacggtatagacaggttccagctggccatcgacgccatcgaccgggtgcccgggctggccgagcggcattcatccctccgccagagcctccaggaccggcggatgcgggcgcgcgaacacacccgcacgcacggtgaggacccggaggagatccggaactggaccctcggctaacccctctagacgaccagtccgtcgaggccgcaggacggcaggtggatccagccctcggtgcgggcggctgcggcgtgcgcgtcgtcaggcccttccgtcagtccgagggcaacggcgcgggccgtgagcgaggcgatgacggcgtcgaacatgtcgtccgagccggccagcctgtcctcctggccgtccaggtccagccagggcgcttgctccctcaggttgaggaggagcgcggcaagccgttccgcctcggagctgccgcgtcccttgtagccccgggcattcaggccccagattttcagtgacgcggccggatagacctccgcaaagcgtccggaaccgtcccggagctgcggcccgtggagcgctgcgatctttgcctggatcacggcgcaccgcatggccggatgcgccagccggtcagcggaaacactgagcggaatcaggcccgtccggcccgtgacgaagcggtccgtgtcgcggtaggccagcagccgccgtccttctatcccgtcgaaggccagcacgggtccggcgtcgaaggccaggtgcccggcaaggaagggaatgagggcgtccggccagccaaccgggcagtccacgccggtcatgtcgctggcgccgaaccagtccacgatttcctggtcctgcacgtccgggccgaggtgcaccagccgggctgagccgcggctccactcgatgacggccacggccgtcttttttgccgccgcggccaggtccactccgagcgtcttcacgtgaccagactctaccgccggcggccgggcgccaactgacccctactgatccgtactggactgtggatgacgccccgccgtggttctgcaaggctggtgcgtggtgggccgcccggctgaccaggcccgaaaggaacatccttatgccctggctcgatgtgctcggcaacgacatccactacacggactccggccgcggccagccggtggttatgctgcatggccatgcctcggcagcggcgtgctgggaaccgatcatccgggacctcgagcgggacttcagggtgttggcgtacgacacctatgaccacggctggtcatcgaactctccgcggcagggaccgctggctgaccgggctgcggagctggagcacttcataggttccctgggcctggaagacccggtcattgtggggcagtccatgggcggcatgaccacgcttcgctgggcagtccgccaccccggcagcgcagcggccctagtggtctgcgggatgggctggcccctcgtgtcgccgcctccggggcaggcaggccagccggaaaagttcgaggtgttcagctccctcgaccaggacgagcggatctggctcggcgtgggaaactccttcacagagcagtggattgcggacaacccgaaggactttgcccgctatatcagggtccgttcaaccgccaccgccattgaagcggccaggtacccgcgcagcctggaacaaagccagggggagttcctcagcgctgacccacgggacgtcgaagctttccagcagggactggaatcagtaaccagcccgctggtggtgctgatcggggaggaagaaaggccgcggatccgccgcggggcggagcacgttgccgccacggtgcccggcgcccgtctcctggttgtcggggacgccggccataatgcctacttccagcgccaggacatcctggtggacgctgtccgcagcacggtttccaccacccggggacgccggcggggctgatcgggctgacgctccgaggtgtaatccagggcgcccgcaatgccgccctcgtcgccaaggctgtcaccgcgcgcaaaacgtgaccacagtgcccgcagttcccgccccacggcgtccacgtcctcccagccggcaccggcaaccagtcctgctccctcccacgtgttccggtttccgaagagcagcggaaggtcgatggtgtgcgcggcgccgaggacattcccaggggcatgccagtgcagcacgtaacggtgggcgctgccgccggcccggacgtgccggcgtgcgaacttacgggctgcccggccataaacggtctccgtgaccgcccagttgatggccctgaggagggtggggccggcaaccggaataccgtccagccggctgaggtaggggctgcgtgggaggaacagcctcgcttcctcggaggtgtggccgatcaggatctcgacgccgggcgcggagcggttccaggcggcctcgatcccggtttcctccggtaggggcgcgtgcccgtattgggtgccgaaaggcatggcagccagcatcccgaacttccgcgccacctgcgccacgtggtcctcccgttccaccacttccatggcgggagtctcctcgttgacggcctcggcggcgatgcccatggcatggttcatttttgcccgaccccgggagatgcccaagggtgcgctctggataatggcgcgctggaacaaagccggcgcttcggccgtcgccatcaagtgggcgatcgcgtcaccgcctgcggactggccgaaggccgtcaccctgcgcggatcgccgccgaacgcggcgatgttgcgctgcacccagcggaaggcctcgagctggtccagcaggcccaggttggcaggccggcccgagcgggttgccaggaagccgaaaagccccagccggtaggtcaccgagaccaccaccacgcggttctcggccaccagcaccgccgggtcgaagatggctaggtcaccggaaccggtggtgtaggaaccgccgtggatccacaccatcacgggcagccgcgcgctttccgggctggacaggtccacgtccccgggcatggtgatggacaggttctggcagtcctcgctccctggcagctcgccgtaccgggtgcccaggatgtcgtccaggaagggcaccggcccttgcgggcaggcgggggcgggggaggttgcggcatacggttcggcccagtcgggggccggagctggcggctggaaacgtccggcggtggcgtacggtatcccggtggcgcggaggacgccgccgtcgcgccagcctgtgacgggaccgcaggggggataaaacaggggctcggaactcacagggcaacgattccacagattcctgggagtcttcgtccacttgtgcaggctttgagggcggcgaagcctgcaaatctggacaaaactccggggatgacgacggcgggtggtgcggttcctgacgaaccgcaccacccgccgtcgagcgttgaatggggactagtggcccgtgggcacgtagcgtttgatggaggcttccagctctgcctcggcggcggcgcggtcgccccagccctcggccttgacccacttgcccggctccaggtccttgtaacgggtgaagaagtgctcgatttccttgatcaggaactcactgacgtcgctgacttcctggatgtggtcaaaacgggcgtcaacgggaacgcacaggaccttggcgtctccgccgccgtcgtcggtcatgttgaacacgccgatgggccgggattcgacgatgacgccggggtgcaggtcgaagtcctgcaggagcaccagtgcgtccagcgggtcgccgtcctcgcccagggtgttttcgaagaacccgtaatgcgtggggtactgcatggaggtgaagaggacgcggtccaggcggacgcggccggtctcgtggtcgacttcgtacttgacgcgtgatcccttggggatctcgatggtcacgtcatgcttcatggaatgctcctcggcaattcggggggttcgcggcacttctgacaggcaatcaaaggactgtcagtgccgccgactattatcgaggatatagcgagaggccctggaatcaggaacttgtggggaaatttcaggacttggggattggcaccggcatgaccacatcgggcagtacggatcagtggcttggccgtgcccggcaggcggtgtggagcggcgccaacggcgtgcggacgtcctggccgttggtcctgctgtcggcacttctggtggccctcgccgttccggcagcactgctggtggcgccgggcttcctcggtccggaaccaccggcccccgctccacctgcgcctgcctggcagcaggttccaaccgcactttctcccgtgccgggacttgccccgccggatggctccgctcccgttccgctcgcgtccaccgtcagcgcccagttggagccgctgctgaaggccgacggcggcggtaccttcaccgccctggtccaggatgcgctcaccggccaggtcctgtttgaccgtggcggttcggaagcccgggtgccggcgtccaacatgaagctgctggcggcggtcgccgccctgcgggccctcggcccggagcaccggttcgccacccaggctgtcgccgggccagcgccgggtcaggtggtgctggttggcggcggcgacgtccttcttgggcccggcgggtccgccccggaacaggtgatgggccacgcaggcctggcaacgctggcggcccaggccgtggaggcgctgcaggaaggcggcgcggccggggagatcaaagtcctggtggacgattccctcttctccggccccgccctgaacccggcgtgggcatcaggggacgtggccgccggtgaagtcgctcccgtatatcccctggcattgaactccgcccgctacgatcccgccgtcaccaccggcccccgcccgcaggacgcggccatgacggcggcggaggaattcgcagcccggctgcgcacggaaggcgccgccgcgggactcaccgtggcagccgccgtcgaacgccggccccaagcgggcaccacggcgccagccggcccggagggggaggggaccagccagccggtggtgctgggcgaagtgcagtccgccaccgtcgcggagcaggtgaacctgatgctccaggactcggacaactacctggcggaggcattgggccggctgacagcgctggctgacgggcttcccggcagtagcgacggcgccacggcagcggtgggtgcgcaactggccgctgccggtttggcggcggaggggatgaagctggtggacgtgtgcggcctggccatgggcaacctggtcccggcccggcagttttccgaggtggtgcgggccatcacgtccggcacggacacccggctccgggctgcgctggacggcttcccggtggccggcctctccggaaccctggacacccggtacggtgatgccgccaccgcccggggcgcgggactggtgcgcgccaagaccggcaccctcaacaccgtgctggcactgagcggctacgtggtggacgcggacggccggctcctggtcttttcctttattgggaacggactgacccccggtgccgcggggaacaaggaggcgctggaccgcgccgccaccgcgctcgccggctgcggctgccgctaagggagcggaagggcggtcctgccccgcatgggcggtcctgccccgcatgggcggccctgacacacagggggccagcaccgcccatgcggcgccgggccgttcatggtgggcagatggttcgccggtgagcgaacttaaggactatccccagcctgctgtgttctgatgggaaccatggagcccactgcacgcgagtcgtcagcccagacgttgtccgccacggcacagtccctgatcaactgggacctcgccgcctccaccgccgcgcgcctggccccggccgggccggggctggaccagcccgccatcagcgaggccgtggacagcctgcggcgcctggcggatgtgtccgtggaccatgtccacgagatcaccgggctcgaggccgcgcgcgacctccgcgactcctccgtgctggtggtggaccgggcatcctgggccaaagccaacacgcagagcttcgccgtgatgcttaaacccgccatggaaaagatgctggaaaacaggcagggcaccctgagcccgggcgccgccagcgtcagcggggccatcaccggaagccagctcggtgccgtcctggcgttcctttccagcaaggtccttggccagtacgatcccttcgccgccctcgccgaaggctccaccgcgcctccggccggcaggctcctgctggtggccccgaacattgtggccgtggagcgcgaactcaacgtcaccccggaggatttccggctctgggtgtgcctgcacgaacagacccaccgcgtgcagtttgccgcggccccgtggctccggcaccacatgctggagcagatcgacgaactcagcgtgcacctgctgggcaacgtcgattccctgatggagcgtgccaccgctgctgcccgctcgctgaaggaccgtaccgtcactgggaacactcccggccgtggcgccatcctggacctcctccaggacccggaggagaaggctgccatctcgcacctcaccgctgtgatgagcctccttgaaggccacgccaacgtggtgatggacgccgtggacgccagcatcatcccgtccgtgaagaccatccggcagcggttcagcgaccggggcaaggaccgcggcgtgatcgaaaagttcatccgcagcctcctgggcctggacgcgaagatgcgccagtattctgacggcgccaggtttgtgcgggccgtggtggacgcggccggcatggaaggcttcaacagggtctgggagtccgcggatcacctgcccaccgaacccgagatccacgacgccaagctgtggcttgagcggatggggctctgattgccgcgcagccagccacctgaggccgtttccgccgccgaagccaccgccggggccgccactgcgggtgccgccacgggtgccgcgaacggcggtttcagcagcggacgacgacggcccggcagactggcgcccgtcgtcggcaaagcgcgcaaagcgctgggggacaccctggcccaggccggctatccgcgccacgtcctggttgcctgcagcggcggcccggactccctggccctggcagccgtggccgcgtactttgcccggcgcgggcatgtggacggccacccggtgacggtcggggcggccgtggttgaccaccagttgcaggaagggtccgcccaggtcgccgccaggaccgcggagatgctggaggagctgggcctgtccccggtggacatccggaccgcaacggtggatggcaccggcatgggacccgaggcggcagcccgcgaggcccggcacgccgcattggaagcggcagcggcaagccagggggcggcggcaatcctgctgggccacaccctggacgaccaggccgagcaggtgctcctgggcctggcgcgcggctcaggcacgcgctcgctggcaggcatgaggcctgcgaggggtgccctgctgcggccgttcctggggcttcgccgggcggataccgaagcgatctgcgaggtggaggagctccagccctggcatgaccccaccaactcggacccgtcctatgcccggtcccggacgcgcgtggaagtactcccgcacctggaggaaaaactcggtcccggcgtcgcggaatcccttgcccgcacagcctccatcctgcagctcgacgccgactacctcgaggatgtggcggaagccaccttcgcgtcgctcgtggagcggaacggcttggaactgagccttccggaggaagcgttgcgcggcctgccccctgccatcaggtaccgcgtgatcgccaaggccgcggccgacgtcggcgggcagcagcccagctaccagcgccttttggcggcggaggcgctgctgcggcggcacggctcggcggggccggtggaactccccggcggagtgagcgcctaccgcctgtccctcgcgcagctggccggtgcggaagccgcggacagcccggcggccggcggcaaagccaaacccgttccccgcggagccgcacgctgtgggaagctagtactccggcttcaaaagccgcccgaaaaatagtcgcaccccgcatctacacaggagccattggtggattcaaacgacgtccaggcagacctcaagcacgttctctacaccaaggaacagatccagcagcggatcaccgaactcgctgcccagatcgacaaggactacgagggccgcgaaatcctcatcgtgggcgtgctcaagggtgcggtgatggtcatggctgacctggcccgggcgctgcacagccacatttccatggactggatggctgtgtcctcctacggttccggcacccagtcctccggggttgtccgcatcctgaaggacctggacacggacctcatgggcaaggacgtgctgatcgtcgaggacatcatcgactccggcctcaccctgtcctggctgaagaccaacctggaatcgcgcggcacggcatcggtggagatctgcaccgccttccgcaagcccaccgccgccaaggtggagatcgacgtcaagtacgttggctacgacatccccaacgaattcgtggtcggctacggcctggactacgccgagaagtaccgcaacctggacttcgtgggcaccctggccccgcacgtttacgagtaggctgcccctcccgaacctccgccgcgccgccgtcggcatcgccctgcagaaccccgcccttggggcaggccctccgccgtcctggcagcgctacgcccacagggaacttttgccgtccatcatgcgtgatctactccggacggtgtatagctagaagctgacgcagcaccatcacgcgcgcagactactcgccgtgcagcactaccagaagggacggggttagcccccgaacagatgaaagctaagaatttcttcaaaggcccgggcatctggatcgtcgttgtggtcggtctgctcctggtggcctttgcaacgcttgcccccggtggtgcggcacggattgacacggacaagggccttgagctgctctccggggaccaggtggagcaggccaagatcttcgacggcgaaaaccgcgttgacctgactttgaaggacaacctgcagctggacgggcaggacaagggcaagagcgtccagttcttcttcgtggacgcccgtgccgaggacgtagtcaaggccgtcacggactccaagccggcccagggctacacggaccagccgattgagagcaactggttctccggcctgctctccctcctgattcccgtcatcctcctgggcgcccttttctggttccttatgacccgcatgcagggcggcggctccaagatcatgcagttcggcaagtccaaggccaagatggtcagcaaggacatgccgcaggtgacctttgctgacgtcgccggatccgacgaagccgtggaagagctccaggagatcaaggaattcctccaggagcccgccaagttccaggccgtgggcgccaagatccccaagggcgtgctgctgtacggccctccgggtaccggtaaaaccctcctggcccgcgccgtcgcaggcgaggcaggcgtcccgttcttctccatctccggctccgacttcgtggaaatgttcgtcggtgtgggtgcctcacgcgtccgcgacctgttcgagcaggccaaggccaactccccggccatcatcttcgtggacgagatcgacgccgttggccgccaccgcggtgccggcatcggcggcggcaacgacgaacgcgagcagaccctcaaccagctcctggtggagatggacggcttcgacgtcaagaccaacgtcatcctcatcgccgccaccaaccgcccggacgtgctggaccccgcactgctccgccccggacgtttcgaccggcagatcggcgtggaagcaccggacctgatcgggcgcgaccagatcctgcaggtccattcaaagggcaagccgatggcacccggagtggacctcaaggccgtggccaagaagactcccggttacaccggcgcagacctggccaacgtcctcaacgaggcagcgctgctcaccgcgcgctccaacgcgaacctcatcgacgaccgtgcactggacgaggccattgaccgtgtcatggccggaccccagaagcgcagccgcgtgatgaaggagcacgaacgcaagatcaccgcctaccacgaaggcggccacgccctggtggcggcagcgctgcggaactccagcccggtcaccaagatcaccatcctgccccgcggccgtgccctgggctacaccatggtggtcccggacaacgacaagtactccgtgacccgcaacgaactgctggaccagatggcctacgccatgggcggccgcgttgcagaagaaatcgtgttccacgacccgtccaccggcgcgtccaacgacatcgaaaaggccaccggcaccgcacgcaagatggtcaccgagtacggtatgagcgagcgcgtcggtgcggtccggctgggccagggcggcggagagcccttcctgggccgcgacgccgggcacgagcgcaactactctgaccagatcgcctacgtggtggacgaggaagtgcgccggctcatcgaccaggcccacgacgaggcctacgccatcctcaccgaaaaccgcgacgtcctggaccggctggccctcgagcttctggaacgcgaaaccctgaaccaggccgagatcgccgacatcttccgcgacatccgcaaacgcgatttccgcgaagtgtggctgtccaaggagtcccgtccggtccagatggcgggccccgtggagtcgcgccaggagagggcggagcgcgaggcccaggaggaggcaaagcaggcgcgcctggatgagccgctcgacgcccagccgccgcacccgcagggtgttccggaggatgctccgttccagggcggcgtcaccgacgcgggcccggacacccttcgcggctaagctttctacgtgacccacttcgacgacgacgacgttcccgcctccgccggatacccggcggagggcggatcccaccactcaaagcaccacaaggtggaccggccccggattgaggcggccgtccgtgagattctccttgccatcggagaggacccggaccgcggcggcctcatcgacacccccaagcgcgtggccaaggcctacgccgaggtgtttgccgggctgcaccacgaccccgcggacgtcctgtccaccacctttgaccttgaccatgaggaactcgtcctggtcaaggacatccccttctattccacctgcgagcaccacctggtgccgttccacggggtggcccacgtgggttacatcccgtctcacgagggcaaggtgacgggcttgagcaagctggcccggctcgtggacatttatgcccgccgcccgcaggtgcaggagcggctcaccactgagatcgtcgaggcgatggtccgctacctcaaaccccgtggcgccatcgtcgttgttgaatgcgaacacatgtgcatgtcaatgcgcggtatccgcaagcccggagcgaagaccgtcaccagcgcggtccgcgggcagcttcatgacccggccacccgtgccgaagccatgagcctcatcctcggaaggtaaaccccagaccatggactcactagctgcagcgccgggaaccggccccgcaacatcccccttgcccatccttcgcaaaccgcgaccggcggctcggttcgaagacctccccacggaccgcacgctggtcatgggtatcctgaacgtcaccccggattcgttcagcgacggcggccggcatgccacggcggacactgccatcgcggcggggctgcggatgttctacgccggtgcggacatcattgacgttggcggcgaatccacccggcccggtgccgaggacgtcagcccggaagaagaacagcagcgcgtggtccccgtcatccgggcactggtgaaggccggggcgctcgtcagcatcgacaccacgcacgcctccacggccgccgctgcggtggaagccggtgctgccattgtcaatgacatctcaggcctcagcatcgaaccggaaatggcggagttcgtggcggccgccaaggttccgtacatccttacccaccgccgcggggacgcgcgcaccatgaattcgctcgccgactacaaggatgtggcgggggaagtggtggccgaactcgcaggcgtgcgggacaagctgtacgccgccggtgtcaccgcggaaaagatcatcgtggacccgggcctggggttcgccaagaacgacgcccagaactgggagctcctgcagaacctggaccagctggacagcttgggccaccgcgtcctggtgggcgcctcacgcaagcgtttcctcggcaccctgctcacggtggccggcaaggccgccgccccggaggagcgcgacggcgccaccgctgccatcaccgccatcagcgcctaccgcggcgcctgggctgtccgcgtgcacgacgtcggccccagccttgacgccgttaaggttgccgcgcgcatggccgcgccccgcgccggcagctaagccgcaccccatggacaggattacgctgagcggagtgaccgccgtcgggcatcacggcgtgtttgattttgaacgccgcgagggccagccttttgttgtggacgcagtgctgtacctggatttcgccaaggcggcaaagtccgacgacgtccgggacaccgcacactacggcgaggtggcgcagcgtattaccgagtggatctccggcgagccgctgaacctgatcgaagccctggctgttcggatcgcggacggcctgctggatgagttcgggctggtggccgtggacatcaccgtccacaagccgcaggcgcccatcgaggttcccttcggagacgtggcggtcagcgtccaccgcgcccggcgcgatggggaaaagcgcgatggggacaagcaagcccagggggaggggccatgaacagcggctataccaaggcggtcctggcgctcggcagcaacctgggcgagcgcaacgacaccctgtccgaggctgtggcggacctcgttgatccgccggaggtgcggctgctcgccgtgtcgccggttgtgcagacgaaggccgtgggcggtcctcccaaccagccggacttcctcaacatgatcatcaccgtggaaaccagcctggccccgcacgagctgctggcacactgccaggctgtggagaacaagcaccaccgcgtgcgggaggtgcgctgggggccgcggacgctcgacgtcgacatcatcacctacggcgacctccgcagcgacgaccctgccctgacactgccccacccccgcgccgccgtccgtgcctttgtcctctacccgtggtcgctcatcgagccggctgccaccctggacggggaacggatcagtgccctggccgcacgggctgacgattttggcgacctcgccccgttcgacggcttcggtgacttcgacggcgtacccaccgccggagcggtggaagagcgatgaaacccatcaatccgctgcgcctcctgctgatcggtttcatccttgccgtggcgggctggtccgccaccgtggtgaccagccggttcggcatgtccacccccgtcctcccggccaccgccctggccaccatgggcgtgatcgtggccatcaccctgatcctgggcatccgggtcctgaagtggcgcaacagcctcgacgccaacggcgccaggacgggcaccaaagcaggacccaggaaaaggcccgtgcttgatccgctcctcgctgcccggaccctggtcctggcccaggcctgcgcctatgccggaacggtgctgttgggctggcacgtaggcatcttcctggaccagctccgcatctggagcctgcgcagcaaccagggcatcacctggctggcacttgccatggccggcgggggactggtgatgatcgtggtgggcctgctggtggagcggttctgcaagatcccgccggaggacggcgacaccaagggcatcgaggggaaacccggccggaccgtgcacggtgaagcctccggggaaggcgaatatgcgtaccgaggcgattgacccttccggcatcacctggcagcgcgtctcgccgaaatatgtcacggtcagggtggtgcagtgggccttgggcaacctcgccaccgtgctggtcctgtcccttccgctggtgcttgtcctcgcgggcgtgtgggcctggccgccgctgtggctggcagctacagtgcccgcggtggctttggtggcggccctttggcggcttgccctcatcccacggcaggtccgtgccatcggttatgccgaacgggacgacgacctcctgatcaggaccggcatcttcttccagcgcaccatggccgtcccctacgggcgcatgcagtatgtggacatcggcgtgggcccggtggagcgcgcactggggctgtgcacgcttaagctccacaccgcatcacccggaaccaacgcccagatcccgggcctgcccgccgcagaaggcgcacggctgcgggagcagctggcggcgcggggcgaagccaggctggcagggctgtgactgcggaggaaccgcgtcccgggcccgccgccttccctgacgcaggcgctgcagcggctgctgcccagccagtcaatgcatcccagccaaccaatgcatcccagccaggcagcgcgtccgacggcgagtggctgcgcgtgcacccggcgtcgccctttatccgcggctgggtggccctggccgccatagccttcttcttcggccgtgacttcttcgaacgctcgctgcagggccggccggtcttcgaggaagagctcgccgggagggcttcctggctgctggcgggcggcggaacggtgctgctggtctcggtgctgggcttcctcctcacctggtacttcaccaaataccaggtgtccggcggctacgtcagggttaataccgggttccttttccggcagcagcgccaggcgaggctggaccgggtccaggccatcgacatcgtgcagcccctgctggcccggatcttcggcctggccgaactcaagttcgaggtagccgacgcaggagagtcggcggtgcggctggcctacctgaagatcgacgacgcccggcagctgcgcgccaccatcctggcccgtgccgcaggggtggccgttgaccccgcccacccggaggagccctcgcccgaggcgccagaattccaggtcctgtcagtaccgccgcagcgcctcgtcggttccctgctgctcagcgagcagagcttcttcgtggtggtgggcggtattgcctccgtggttctggcggccgccacggacagccaggcgttctacttctacctcattcccgcggccctgggcctggccgccagctattgggggctgttcaacaagggctacaacttcaccgcggccatctccccggacggcatccggctgcgctacggcctgctggacacccaggcgcagaccctcccgccggggcggatccaggccctgaaggtcacccagccgccgctgtggcgtccgctgggctggtaccggatgcaggtcaacgtggccggctacggggttgtggagaacgcaggggaaggctccgcccggaccacgctcctgcccgtcggcacgctggcaaacgtgatgggcatgctcgccctggtgctgccggaccctggaaccccgcagcccgccgtcgtcttcggtgcggggctgaccggcctggattccgacggcggattcgtcaccaccccgcggagggtccgctggctcgcccccctgggctggcggcggaacgggttcgcggccacggacaccgccctgctgctccgctcggggcgctggtggcggcagcttgtggtggttccgcaccagcgcacgcagtcaatggccctgcaccagggcccggtggcgcgccggttcggcgttgccgacctggtgctccacaccaccccgggccccgttgtgccgcgcctggcccaggccgctacggaggtggcactggccctgttcgacgaacaggccgcgcgcgcccggctggccaggaagcggcaaacaaccgaacaatggctccggcaggtggtacctggtgcaccggcggccgccaccgaaccagtggccgggcccctggaaactccaactcctcaacaacaggaaggcgggcagtatgggtaagccgggacgcctcggcgtcggaatcatcggcgcgggcaaagtgggggcggtccttggcgccgccctgcgcgccgcggaacacgccgtcgtgggcgtttcggcggtgtccgaagcgagccgtgagcgcgcagaaacgctgctccccggcgtgcccgtcctgcaagtgcaggagatcgttgatcgggcggaactggtcctgctggcagtccccgacgacgccctcccgggcctggtggacgggctcgcgaagctgggcgcgtggcagccgggacagctggttgcgcacacttccggccgctttggcgtgggcgtcctgcacccggtccgcgccgccggagccgtcccgttggcgctgcaccccgccatgacgttcacggggatgagcctggacctcacccggctgctggactgcaccttcggtgtcacggccgatgccgccatgcttcccatcgcccaggcgctggtggtggagatgggcgcggaacccgtggccattgccgaggcggaccggacgctgtaccacgcagcactggcgcacggctccaaccacctggtcaccctcgttgcgcaggcgtccgagctgctgcgctcggtgggggtggaactgcccgaacgcatgctgggcccgctcctgcgggccacgctggagaatgcactggcgtcaggggagtccgccctgaccggaccggtagcgcgcggtgacgttggcacagtcgcggcgcacgcggaggcgctgcgggagttcgacggcggcgggcacggcgatgtgctggccgcctaccttgccatggcccgcgccaccgccctgcgggcagaagggcgcggactgctgaaaccggaccagcttgaggggctgcgccacgccctcgatccgaaggaggactgacgatgcccatcacacttgccaccacggtggctgagcttagaaccgaaggcgcccggctgctgggctccgggcaggggacatcccaagggctcgttcccaccatgggcgcgctccacgagggccacgccgccctggcgcgtgccgccgtcgaacagaacgacgtggtggttgccagcatcttcgtcaacccgctgcagttcggcgacgccgtggacctggaccgctacccgcgcacgctggacgccgaccttgcactgctggaagaccagggcgtggacctggttttcgcgccgccggtggaggaggtctaccccggcggcgaaccgctggtgcgcatcacctcgggccggcttggggaaaagtgggagggcgcctcccggccgggccactttgacggtgccctgacggtggtggccaagctcctccactacggcctgcccgccgcgggggtgcctgccgcggggctgccggccgccggggcggcccaggggggcctgcccgcctaccgggcgtacttcggccagaaggacgcgcagcagctggccctggtccggcggatggtggcggacctcaatttcccggtggagatcgtgggcgtacccacggtgcgtgcggtcgacgggctggcgctgtccagccgcaaccgctttttgtcggacgaagagcgggaggcggccctggtgctgtcccgggcccttcggctgctggaggaacgggcaaacgcccgcgaaccgctggaccttgactcagcccgggccctggtggaatcccagccgctggtggcgctggactatttcgacgtggtggatccggagaccctggaaccgctcgcggagaactgccgggagacgccgttcaggggtgaagccctggcgctcatcgccgccaaagtggggccggtccggctgatcgataacgcaccgctgagttcctgacccaggctgctacatgcacggctcttcccggttagccatcagttgttcgagcaatgcgcgctccggcctgtccgggtacttggcgacgcagcggcgcagccgggcccttgccagctcctcaccgggttcgcggctgcagagaacttcatcgatgatttcctgcgcctgccaccggagggactcaatagcgaactgccggatctcggacggggtgtcatccgccatccagggatcagggtccgagggaacgctctggaacatccgctctgctgacatcggggcctccttgcacctgtccgaagcggcctgcgtgggggcagccacggcgtcgaagcactgcgctacgggaaacattacagggggaaagaccggtctgtcttcccccggagtagactgaaattgcgatgaatccagaggctaaagtcccggcgttcccccaagttgctgcggtggcgcagtccggtcctgcccactcggtggacaggatcatggccgttgcctacgagctgttctccacgcgcggcgtgcgggacgttggcgtcaacgagctcattgagcggtccggggttgccaaagccaccttctaccggcattttccgtccaaggattccctggttttcgcattcctggagcagcgggacaagcagtggaccatggacgggatcttgttggaggcacgccgcaggggcagcactccccaggagcagctgctggccatcttcgacgtattcggtgattggttcctgcgggaggacttcgaggcctgttcgtttgtgcgggtcatgctggagatggggccggcccatccgctgggacaggccagcatcgaatacctggcaaagatccgcggccatgtccaggccgtagcggaagaggccgggctggtgaaccccgaagagtttgcccgatcgctgctgatcctgatgaagggctccgtcatccaggctgtggagggtgacacgctggccgccgaacgtgcccggcagatggcggtctggctgatggagcaccaccgcggctgaccgcaggccgccctcaagcaacagctgttctggagccagccgcgccgtcaggagccggactgcctggccgggatacggggtgcggaggtgctggaccggaccaccagccgggtctccatcagctcgtccgccggcccggcggcggtgtcgccgtcgtcctgcaccagcgccagcaggcgctccacggcccgcgtaccctggtttcgcggaaactggtcgatggtggtcagccccaggatttcgcccatttcgtggccgtccaccccaatgacggacagctcttctgggatccgcaacccgaggtcgcgggccgccagtattgcgccgaaggccatctcgtccgacgcgcagaagatggcggtgggccgttcttctgcgtccgccagcagctgcttcgtctccttgtacgcatcgttcgccgaatagtcggaaatgagggaccacgcctcgcgcaggggcaggcccgcctccgccatcgcttcctcatatccggcgcggcggccgctggagatctcgaagttccgtccaagctcgtgttcgccgccgaggtgcgccacgcgtgtatgccccaggctgatcaggtggttggtggcgcggcggcccacctccacatcgtcaatccggagggtggggatctccggcagcggaccgcccactccgaccaccggaattccggccgcgaggatctgttcggtctcgtgggcgttgagctggagcgagactgcaaggacgccgtcgagccgcttgcgcaggaggaagtcccccagcactgattcccggtaccggtcgccctggaagtcatagagggtgaggtcgtagccggcgtccatcagggctgaattggcgccctcgagcagcgtggcgaagtaccacctgttgacgaaggggaggaccactccgatgttgtggctgcgcccgctcgccaggctggaggcgtggtaggacatgacgaagccgagttcgctggcggcggcggtcacggcctcccttgcccgggcggacacactgcccttcccgctcaaagcccgcgacgccgtcgcctgcgaaacacccgccaaacgggctacatccctgattcctgccactgaccctctgatgttccgcttggccccgtgcgcagccagatgcactgcgcaggacccagtttacgctgggcggcagcgtccccgtccgtgctgagcaggatctccagggcgggcaggccaaccggcgcctcacccatgttcatcatcaccaggactccgttgttcacgaatgtcacgcagtccgaggccgaggacccttcaagccagtcgagggaaccggctccgagcttcatggaccgccggagccccaaggcccggcggtacagggacaggacggaggacccgtcccggtcctgcacgtcccgggacagcgcggcccattcctccggctgcggcagccaggactcaccagtgctgttgaaaccgaaagccggtgccttcgcctcccagggcagtggcacccggcagccgtcccggccgatgcgttctcccgcggtgcgcttgaacgacggatcctggcggaaggtgtggtccatggtggtgtgatcgggcaggcccagttcttcaccctggtacaggtacacgccgcccggcagggcgagcatgagcatggaggccgcggcggcccgttgcaggccgagctccgcgtcaggctggacatcctcggcgcccaggccgtcgccggggcgggcggctggctccacgatgccgaagcgcgttgcgtgccggacgacgtcgtggtttgaaagaacccacgtggtgggcgccccgaccgaatcgaacatccgcagcgagctttcgatcaccgcacgcaaccgggcggggtcccatggggtgcccaggtacgcgaagttgaacgcctggtgcatctggtccgacaggacccagttggtcagccgggacaggggatcgatgctcgcctcggcacaaaggatgcggtcgccgtcgaactcggccaggacctcgcgccacctgcggtagatgtcatggatttcgggctgcccgaacatcggcgcaaggttgccggggaagtcgtcggtgctgataccgtcgggccggccatgccagtccggcaggccatcggccttgaccagggcatgggccacgtccacccggaaaccggcaacaccacgctggagccagaagcgcaggatgcgttcgaactcggcgtgcactgcagggttgtcccagttgaagtccggttgggaggaatcgaaaaggtgtacgtaccactggccgggctcgccggagggctcggtaatgcgcgtccaggcggggccgccgaagtgcgactgccagttgttgggcgggagctccccggattccccgcggccgtcccggaagatgaacatttcccgttcagggctgcccggccccgcctggagtgcggcctggaacagggcgtggtcggaggagcagtggttcggcacgaggtcgatgatcacccggatgttcagcgaatctgcccgggccaccagcgcgtcgaagtcgtccagggtgccgaacacgggatcgacgtcgcagtagtcggcgacgtcgtatccgccgtcccgctgtggggatacatagaagggtgagagccagacggcatcgacgtccagcgccgccagctggtgcagctcggccgtgatgccgggcaggtcgccctggccgtcgccgttgaggtcccggaaagagcggggatagatctggtaaatcaccgaggaccgccaccattccgtgccgtggtcggccgggtggaccggcaccagttggagggcggagatgtcggactcgtcgagggtgagtgtgttggtcatccggttatgctagcggcatttccgccagaaatggaacagcttccatccagtaagtacgcggaaatctttaattcgctgatcgtgtggacgttctcaatggaatcgcttacagttgtgacttgtctcaccgccggcattggcacctgacagccgatatctcccaggcgggcatttcttacaccgggcagttgcccaattcatgaaggaggcgcatcggtgcgcacagctcttatcaagcccttggcccacaaggccaggctttcattcacgacggcggccgccgtttccctgatgcttctcgcctcaggctgctccggcgggcaggccccggcaggcggcgcatcagccgccgcatccgaaggtgcggcagctgcccccgcctcctccggcgaggcacccgcacgcggggatgcggacctcgtcatctgggccaacggccccgttgtccaggcgctgcagcccatcgcggacaagttcggtgaggagaacggcatcacggtggaagtccagaccgtggccaccgaactgcagaccaacttcgtcacggccaacgcatcaggcaacggcccggacattgtgatgggagcccacgactggatcggcaacctggtgcagaacggcgccatcgatcccgtccagatcacggctgagcagaaggcggacttcctgcctgtcgccacggacgccgtcacctacaacggccagacctacggcatgcccgcttccgtagaatccctggtgctcatccgcaacaaggcccttgcgcccgaggcgccggcttccttcgaggagctgctcaccgccggtaatgccgctgttgccgccgggaccgctgaacgggcgctgaacctgcaggtgggccccaagggtgacgcctacttcatgcagcccctctactcctcagccggcggctacctcttcggcaagaaggctgatggcagcttcgacaccgctgacttgggagttggcaaggaaggctccatcacggctgccgggaagatcgctgagctcggcgaaaagggctccaaggtcctcagcacctccgtcagcgccgacaactccatcgcactgttcaaccagggcaagaccgccttcatggtgaacggcccgtgggcgctcggcgacgtgaagaaagccgggattgactacggcctgagcgccgttccgggcttcgccggcatgcagcccgcacagcccttcaccggcgtgcagtcgttctacgtcgcatccaagggcaagaacaagtccttcgccgaaaccttcgtccagaccgccgcgtcgcagaaggagacccagcgcgcgctgtacgaggcagtccgcatcccgccggcgatcgcatccctggtggaagaagtggcacagactgatcccgacaccaagatcgccgccgatgccgcggctgcaggcatccccatgccctcgctgccccagatggctgccgtgtgggccccgctgggccaggcagaagctgccatcgccggcggagcagacccagcggccaccatggagcaggccggccagacaatcgccggtgcgctgaagtaacaccggcgatgaccacccgaaccaagaactcctcggggaaggcggtggggcccggactttcactgggctccaccgcgtcggtccccgcactgctggccaagatccttgggctcggcgccgtgctcggcgccgccatatccctgacgccgctgctgcttgccggcggcgaatgggcgatgctcatcggactgtgggccggcgctgccgggctcctggccgtctattccaccaagcgcctcgtgccgctgaagtacctgctgccgggcaccctgctcctcaccgtctttgtcctcctgccgattctttccaccgtgcagctgtccttcaccaactcaggcgacggaacccgcggatccaaggacgacgcggtttccaccattgtccggaactcggtgacccagctgcctgagtccaggaccttcaacctcacagtgggtaccagggggtccgttgcggacggtcccttcacgttcttcctggtggagacgccgtcgaacgatgtttttgccggtgacgggcagggcctgcgcccgctggatgaggaggacgtgacggtcgacggcggctacgtccgcggtgccgacggctaccagatcctgacgggcaaggaagtcaacgccgcagggccgaagatcagcggactgactgtccccacggacaagggcgcgatccgcgcccagggtatcaaccgcgccttcgaaggagtccagaccctgacgtacgacgccggaacggacaggatcaccgattcggtttccgggaaggagttcaccgtccagcagttcggcgaccgggaatacttcgcggacgcgaacggcagcaaggggttcgaccagagctgggagcggaacgtcggcttcgccaactatgtccggctcttcaccgacccccaggtccgggaggccctgctcggctccttcgtatggacgctcgtcttcgccgtcggctcggtggccaccaccttcgtcgtcgggctcctcctcgccaccgcccttaatgatccccgcatccgcggactcaagctttaccgggccgtcattatcgttccctacgccatcccggtgttcatctccttcatcgtgtggcaaagcttctacaacaaggacttcgggctcatcaattcaatgctcggcggagccaagatcgactggctgggagacccgttcctcgccaaggtcgccgtgctgctgaccaacctctgggtgggcttcccctacatgttcctgattgccaccggtgcgctgcaggcgctgccgcaggacattgcggaggccgcgaaaatcgacggcgccagctcgtggaccaccttcaccaaggtccagttcccgctgctgctggtggctgttgcgccgctgctggtgtcgtccttcgcgttcaacttcaacaacttcaacgtcatccagctggtcaccggcggcggcccctttccggccagcggcggacagatcggcgccaccgacatcctgatcagcggcgcctaccgcatagcgttcggcggtgcaggcgccgagttcggtttcgcctcggcaatctccgtagtcctgttcattgtcacggcagtgcttgcaggcatccagttccgttacaccaaagccttggaggatgtgcgatgaccaatctgctcacggaagctccggcagaaaaaggcacgctggcccgccggacgaacatgctggtccgcaaggacgggcttgagctgccccgcggcaagcggtggtggcgggaagtgggctggcggcacatggtgggcctggcgggcgtcgccttcgcaggcttccccgtgctctacatcatttccgcagcgttcaatccgctgggaagcgtggccaccaccgagctgattcccaccaccttcagcctggtcaactttgagaccctgctgggcgggtccaggggcccgtttggaacctggtacctgaacaccctggtcctctgcactgtggtctccgtggcgcaggtcctgctgagcacgcttgcagcctacgcgttctcccgcttccgcttctacgggcgccgcggcgggctgctggcgctgctcctggtccagatgttccctcagttcctggccatcgtggcgctgttcctcatgatcgcgaaattcggtgaggttgtgccggccatcgggctgaacaccctggccggttatgcgctggtgctcatgggcggagcgctggggcaggtctggctcatcaagggcttcttcgattccattccgcacgagctggacgaggccgcccggattgacggggcgggacacttccggactttcaccagcgtgatcctcccgctgatccggccggtgctggcagtgaccgggctcctggcattcgtggccgtcattggcgagtacatcctggcgagcatcttcctgacagacaacggcgtcaagaccctggcggtgggcatgttcggcattatcgccggggaccgcagcaacaaccttggcgtcttcgctgctggctcggtgatgatcgcgctgccggtgctcctcctgttcctctacctgcagaaatttattgtgggcgggctgacggccggctccgtcaagtagggggagggcatccggaatagtcagcttgcttatcacttttcttcttcctaggctggaagctgtccggcaagcaaaactctcgggcagcggccggcgccaattaccaggtgccggcccggcccaggccaggaggaaaaaatgtcagaacacagcatcgcaggcaagaaggtcgcattcctgctgacggacggcgtggagcaggttgagctcaccagtccctggcaggcagtgaaggacgccggcgcccagcccaccctggtggcacccaagagcggcaagctgcagggttataacggcacggaaaaaggcgacacgttcgacgtcgacctcaccgtcgcagaggcaaatgcctccgactacgacgccctggtccttcccggcggcgtcgtcaacgcggaccatcttcgcgtggacaaggacgcccagagcttcacccggagcttcttcgagcagcacaagccggtggcttccatttgccacggcccctggctcctcatcgaagccggagtcctgacggggaggagcgtcacgtcctaccactccctggcgaccgacctgaagaacgcgggagccaactggtccgatgaggaagtggtggttgaccaggggctggtgaccagccgcaaccctgacgacctccccgcattcaacagcaagctggtggaggaaatctcggaaggccggcacgccggccagacggcctagaaccgcccgggggggctgccggcagcgcagcccccacgtgttccctcagggtttgagaaatgttccggtgccgggaattagtccaaccggtagagtgttggcatctgcagcggccatgtccgcgcaccactcataacactccctgagggaacacccatgtctaccgaagtctcgccgaacgcaagcggccagtccgtcaacaccgaaggaaccaggcccgccgcgccggagaagatgtcccgcgaatcggtgaccatcatcagcacgctgttggtggccacgttcgtggtgatcctcaacgagaccatcatgaacgttgccctgcagcggctcatggtggacctgcaggtggacgcgcccaccgtccagtggctctccaccggcttcatgctcaccatggccgtggttatccccaccaccggcttcatcctgcaaagcctgtccacccgggccgtctttatgctggccatgggcctcttcgccgggggaacggcccttgccgccgtggcccccgggtttgagctgctcctgctggcccgcatcatccaggcaggcggcaccgcgatcatgctgccgctgctgatgaccaccatcctcacccttgtcccgctggccaagcgcggcgccgtgatgggcaacgtcagcatcgccatctccgtcgcacccgccatgggacccaccgtctccgggctgatccttgagcacttcacctggcgcttcatgttcgtgttcgtccttccggtcgcccttgcggccctggccatcggcgccaagtacctgaccaacatcggccaggcggagaaaaccaggctcgacttcctctcggtcatcctcaccgtccctgccttcggcggactggtctacggcctcagccagatcggcggcggccacggcggccaggcaggccccggaaccacggccatcgcggcactggtgattggcgtggccagcctcgcagtctttgtccttcgccaggtgcggctgcagaaggccgaagctccgctgctggacctccgcgccttcaacttccggatgttcacggtctccgtgctgctgatggtggtagccatgatggcgctgttcggcggcgtcatcctgctcccgctctacctgcaggaggtccgcggcctgggctccctcgaaaccggcctcgcgctgcttccgggcggcctggccatgggcctgctgggcccggtcatcggccggttgtttgacaaggtggggccgctgccgctcacagtgtccgggtccatcctgatggtgctgtccctctggcagttttcaatgctcgacgccggcacgtccgtggcatggatcgtcaccctgcacgtggggctgagttttggcctggcgctgctgttcaccccggcgttcaccacaggcttgaacccgttgccgccgcacctttactcccacggttcggccatcatgagcaccgcccagcaggtggccggcgccgccggcaccgcgctgctggtgtccatcttcgccgtggtatccgcggcgtcgggactcgtggcggggatgagcgccgccttcctgacggcaaccgtgatctcccttgccgccgtcgtactctcagcgatgatgcgcaagaccgaaggtgccgtcccggcccacgctgcccactgacccaactgagtagcgccaagtgtcgttttgaccgctcaaaacgacacttggcgctacctacttgggctagccggcgtagaagtcagccagttccttgatcagcttgtccggggccttgatgacgccgtcgtggccgaagccggggaggatggtgtagctggagccggagaggacgtcgtggatctggccgcaggcaatcccgaagtacgccgggctcttctcgcccaccacaatcagggtctccagcggcagtgccaggaacggctctgccggcatgtccgcggcgatgatcgccttgatctcgcggacgccggtgcgcatcatttcccgctgctgcttgccctctgacgtgccggcggtcagcttgttggcaagggtcagcatggagagcggcatgcgggacgaaaacgcaccacccgcttcgagcccgcgctgcagcacggcgagggcgcggtcgtcgtcgccggcagcggccgcacgctcgtactccgccgtccagtccgccttcacgctgtggttcacggaaacggcgggatcgtacacggccagccgctcaacgggcagcgtccgggccgcgtgcagcgcaacagcaccgccgaagctgtggccgaagacgtccgtgctggacgtatgtttcatgaccgtctgcaggtcgcggatgtctacgtccagcgtgtaatcctcgggctggggcgacgacgaaccgcggccccgcctgttaaacgtgtgcaccggccggcccagggccgcgctgagcttctgcgcgaacttggtgtaatccgcagcggtcaccatggagggcggcacaataacaacgcccgaaccggcggaagcgagttcggtacccgtggagaagagctccagcgtgccgccgttgggggtcctgatgttctcacgcgtcatgttccgagcctagctgagcaacctgattgcaggcaccacgctgcgccgggaaaacagcggctgcagcctgcggcggtggtcagccgaggcgttcgatgagcgccgcgccctgctcccggatggcaggcagttcagcggccaggccgcacaggatgagtcctgcgtccgcagcctgcagcggcgattccggggttgccatgccgtccgcgcgcagattgatcagcgattccaccaggcggaacgccaaatctcccgggctggactgccagctggccgccgtgccggcgggaggcaggtccccgcccagctcacggtacaggttgcgcagttcctgccggtcggccatgaaacgggcaaagcgtccgctgcgcgcctccggcaggtggtagaggattccgaggttccagcgggcgctgcacagttgcgttccgtcgtaaagcgcgacggcgtgaagccggcctgctgcctcccctccggacggcggcagggcagccaccgcccgggcaaactccagccccgccaggacagtgccctccagcaggtcctcaaggatgtcgtccttggtcctgaagtggtggtagagcgacgactgcctgatccccaccgcatccgcaatggaccgggtggacgtggtggcgaacccctgcgtggtgaacagctcggcggctgcatccaggatttcgtcccgcgctgtggcccctggcctggagggttgttggctgcgggggcgccccggtccggctgaagtcaccgcatcattcttgcattgcctcaccatggatgcggcgcgccctcccgctcccggatcagcggtgagtgaatggaaatactgccgaaacaagatgtctatccgccttttacagaggtgaaactccccggggacatcgcgctggaaaactatcaagtgaccggtattccgcagctttcggccgagtgctgcagtaccggcggcccccgccacgctccccagcccccggagaatctgatgaccgcaaccgttcttcccaccgtccatgcggacgatgcggacctgacgtccctgggctaccagcccaccctccaccgcaaactcggccgctacgcctccttcgcggccggcttttccttcgtgtccatcctgaccaccatcttccagctcttcgcgttcggctactcgtttgccggtcccgcgttcttctggacatggccggtggttctcattggccagctgctcgtggccctgaacttcgcggagcttgctgcccgctacccgctgtccggagccgtgtaccagtgggcgcgccgggtcggcggggaaggcgtggggtggttcgcaggctggttcatggcgatcgcccaggtggtcacggccgcagccgccgccatcgccctgcaggtggtgctgccccagctgtgggacggcttccaggtggtgggcggcgatcctgcgctgaacaccgtcaccggagccgccaacgcagtgatcctcggagccgtcctcctggtggccaccaccatcatcaactcgctcggcgtcaagctcatggcccacgtgaactcggtcggcgtcacctgcgagatcgtcggcgtcgtggccgtgatcctcgcccttatcagcgccgcccagcgcggaccggacgtggtggcggacaccacggtgctccagacctccgacctcggcgcggtgggagccttcctggtctcaggcctgatggccgcctacgtgatggtgggcttcaactccgccggcgaactttcggaagaaaccaaggacccgcgccgcaccgccccgcggaccatcctgtccgcgctgctcatttcgggtatcggcggggcgctcatgatcatcacggcgctgatggcagcgccgagcctcgacgacggccgcctcgccaccgaaggcctgccctacgtcctcaccgccgtcctgggaaccttctggggcaaggtcctgctggtggatgttgccatcgccatctttgtctgcaccctggccatccagaccgccggttcccgcctggtgttctccatggcgcgggacggcaagctccccgcatccgcgctgctctcctccgtccaccccacccgtggcacccccatgtggccgtccatcgtcatcggggccctggccgtgggcgtcctcgccatcaatgtgggcaacgcggcgctgttcaccaccctctgcagcgtctgcatcgtgatggtctacctcgcctacctcctggtcaccgtgccccagctcatcaaccgcctccgcggcgactggaaccgggtggggcagaccctgccggcgggcctgttctccctgggccgctggggccttcccgtcaacatcctcgccgtcctctacggtgccgtgatggtggtcaacctcgcctggccgcggcccgaggtctacgacccctccggtgaaaacgggatcctcctctactcggcaccgctgatggtcaccgtggtcctgctcctgggcatctgggtgcggcgccggaacctcgcggccaacgcttgagcacgtcccgcacagtccaacagcccctctccagaaccagcacaggatcgacatgacacaagtaaccgaaagcccggcacccggcaccgccaccaccgcaggcgcccgcgcccacgccagggagcagcacggcaggaccgtggagaccatgcgtttcgtgcccgcttccacggccccggcgcgcctgatgcaaggactgcccgacggcgcgtcccccacctgggccgaatccctcgcctttggccgctacaccaccatgtccctggcccggggcacccggatcaggctcaccgacacctccggtgacgcctgcgtgcacaccctcctctaccgcgccggatccctccacgagcggctcaacgtggctgacactgtcaaggtcccctggcaggcctacccgggcactggccacccgctcctgtccgacgccggccgcctgatggccaccatcgtggcggatacctcctcccggcacgacgccctgaccggtgccaccaccctggaaggcaacacggcccggtacggtgccggaaccgcccacagcgcatcccccgcggcccgcgaactgctcacccttggcgcactcaagagcgggctggggcccgccgacgtggcgccgtcgttgtccttcttcaaaggcatcaccgtggaccctgcaggcagcattaccttcaccggaagcgcaggcccgggagccgccgtcgaaatcctgctccagatggacgcagtcctggtcctggccaacaccgcgcatccgctggacccccgcccggactttaccgggaccgcagtggacatcgctgcctggcacgcgccgcaggaccttgcggcccttggggcgggcaccctcaccggcgccctgccccctgaacacctgcaggcactgcagaacaccgaacacgatctcaccgcaaggaacgcccgatgaacaccgccacctacgccgctcccgccgccgatgcccgtgaggcagccctcgccgccggaaaagtggtccttgaccaatacgtcggggcacgcggtccctggtccgccgtcgtggccgccggggacgtgctgaccatcgttgacctggaaggcaaccaggcagtggattgcctgctttatgcagccggggacaccaccgtgcgctactcggccgccgtcaccatcgcccggcagcagtcgatcgtcctcaccacggggtcggtcctgcgggcagaaacaggtgccccgctgatgaccgtggtggctgacgaggtgggcgtacacgacaccatcggcggcgcctgctcgcaggagtccaacaccctccgctacggccagcacacccgcgaacagcacgcctgcgtggagaacttcctgatcgagggctcacgctggggcctcgggaagcgggacctggtgtccaacatcaactggttcatgaacgtgcccgtggacccggacggcgccctgggcatagtggacggcctctccgctcccgggaagcgcgtggcgctcagggccgaggtggacaccctggtcctggtgtccaactgcccgcagatcaacaacccgtgcaacggcttcaaccccacccctgtccgcatgatcgtcacccggccggaggctgcactgtgaatactctcgataccctcctttttgacacccttttagttgccaaccgcggcgaaatcgcctgccgcatcatcgagtccgcccggaaactgggactgcggaccgtggccgtcttctccgaagcggacaggggagccaagcacgtccggctggccgacgaagccgtgctcctggggccggccccggccaaggagtcctaccttcgggtggacgccctgctggacgcggcccggtccaccggggccggtgccatccaccccggctacggtttcctttccgaggacgccgcgtttgccgaagcggttgaggcagcgggcctggtgttcgtgggacccaccgctgaacagctgcgcatcttcggcaccaagcacacggcgcgcgatgccgccaaagccgccggagtgcccatgatcgccggatccgggctgctggcagacgttgacgacgccgttgctgccggttccgccatcggcttcccgctgatgctcaaagccactggcggcggcgggggcatcggcatgacggtttgccgcgacgagaccgaactcgcggagagctttccccgcgtggcccggctggccggggcaagcttcggcaccgccggtgtgttcgctgagcggtatgtcgagaacgcccggcacatcgaggtgcaggtctttggcgacggcgccggccgggtggtcagcctgggcgaccgggactgctccctccagcgccggcaccagaaggtcctcgaagaggcgcccgcgccggacctgccggacggactgcgcgaagaactgcaccgcagctcccgcgcactgtgcgcctcccttaactaccgttccgccggcaccgtggagttcgtctacgactccgcccgccgcgaagcgtccttccttgaggtcaacgcacgccttcaggtggagcaccccgtcaccgaggcggtcaccggcgtggacctggtggaatggatgctccgcctggcccagggcggcactgaagcggaagcggtcctggcgcaccggccggacagcctgcccgtttcaggccacgccgttgaggcgcgcgtctatgccgaggacccggcccgcggtttccagcccagtgccggcaccgtgaccaacgccgtctatcccgcctccgccgatgtccgcgtggacgcctgggcggaaaccggcaccgaagtttccaccaactacgatcccctcctgggcaaggtcatcacgtccggccgggaccggaccgaggccttcgaccggctggccgcagcgctcgccgacacccggatcgacgggatcgagaccaacctcgggatgctccgcgcggccaccggcctggacgttgtccgcaccgtgcaacactccaccagcacgctggacaacgtgggcgaccccgaaccccgcatcaccgtgggcaggcccggcctgcagaccagcgtgcaggactggcccggccgcaccggcctgtggcagatcggcgtgccgccgagcggccccatggatgacctgtccttcaggctcggaaacaccgcgctgggcaaccccgaaggtgcgcccggcctcgaattcaccatgaccggccccgccctgaccttcacgcaccccaccacggtctgcgtcaccggcgccgaggtaaccgtcaccgtggacgggagagaggtgcccgcgtggacgccagtgaccgtcccggcgggcggaacgctcgacgcaggcacggcctccggcgccgggcttcggggatacatcctgttccagggcggcctggacatcccgcagtacctgggcagtgcctccacgttcaccctgggccagttcggcggccatgccgggcgcgtgctgcgcgccggagacgtcctccgcgcagcagcaccggacgttggcggcaacggcaaccttgcgtcggcggcagtccccgtggacagccggcccgccctggcctcaacctgggagctttccgtgacggaagggccgcacggtgcccccgagttcttccgccgcgaggatatcgacgagctctacgcgtccgagtacgaggtccacttcaactccgcccgcaccggtgtgcggctcatcggccccaagccgcgctgggcacgcaccgacggcggcgaggccggcctgcacccgtccaacatccacgacacggcgtactccgtgggggccctggacttcacgggtgacacgcccatcctgctcggaccggacgggcccagcctcggcgggttcgtctgccctgtgaccgtggtgaccgccgaccgctggaagctgggccagcttcggcctggcgacaaggtccggttcgtacccattcaggtcagccaggcgccgtcggccagggatcttggcccgggccgccagctggtcctgccgggcgacgacgggtggtcaggcaacttcccaacgagccttccagcggccgcaccggcatccgccgccagccgtcccgaacgtacggtgcggggagacggcgacgacggcgtgctgggccgggtgccggaaggccccggaaggcctgcggtcacctaccggcgttccggtgacgacaacctgctggtggaatacggggagatggtcctggacctcggcctccgtgccagggtgcacgccctgcaccagcacattgagcggctccgcgtgcccgggatcgtggacctgaccccgggaatccgctccctgcagatcaaggtggaaccgtcggtcctgtccacaaagaagctgctgggactcgtccaggagatcgaggcagccctgccggcgagctcggagctcgtggttccgagccgcaccgtccggctgccgctgtcctgggacgaccccgccacccgggaagcgattgagcgctacatggcgggtgtccgggacgacgccccgtggtgcccctggaacatcgaattcatccggcggatcaacggcctggattcggtcaacgacgtgttcgacaccgtcttcaatgccgaatacctggtcctcggactcggagatgtgtaccttggcgctcccgttgcaaccccgctggatccgcgccaccgcctggtcaccaccaaatacaaccccgcccgcacctggacgcccgagaacgcggtgggcattggcggcgcgtacatgtgcatttacggcatggaaggcccgggcggctaccagttcgttggccgcaccacgcaggtctggtcgcgctacgcggactctgccccgttcgagccgggttcgccgtggctgctgcgcttcttcgaccgcatctcctggtacccggtcagcccggaggaactcctggacctgcgggcggacatggccgccgggaggggccgcggcgtcgagatcgaggacggcaccttctcgctggccgaacacgaggtgttcctcgaggaaaaccgcgaatcgatcaccgcgttccgggaaaagcaaggcgccgctttcgcggtggaacggcaggcatgggcagacgccggcgagtttgaccgcgcagaggctcttgccgccgtcgtgtcgccggttgtggacgaggtggcggtcccggacggcgggtcactcgtggccgcaccgttcgcggcgagcgtctggaaggtcgacgtcaaggcaggggaccgggtggtgcagggccagccgctggtgtccctcgaggccatgaagatggaaaccgtgctcgaagcgccgtgcgacggcgtggtgctgcaggtcctgtcaactgcgggttcgcaggttgttgcgggcgaggccgtggtggtcctcggcagcgtggacgcggaaaccgggtccgtaatcgaagcgcaggaactggaagaggcagcagtatgaccagcacaaccaccggcacggccaccgcaacttccggtaaggccaccacgcgggtccgggccgccctctccgccctcgaaacggtggaccggccggaaatctggatcaccctccgcgggaccgacgaactgctggccgaagccgctgccattgacacggccgctgcaggcggtgcggacctgccgcttgccgggctcctgcttgccgtcaagaacaatgttgacgtcgcagggatccccacgacggcggcgtgccccggctttgcgtacacgccggaacaggacgccgaagccgtggcccggctccgcggcgccggagccctggtcctgggcgccaccaacctcgaccagttcgccacgggcctggtgggcacgcggagcccgcacggcgcggtccgcgattcccgccgcccggacttcatttccgggggctccagctccggctccgcggttgccgtggcactgggcctggtggacatcgccatcggcacggacaccgccggctcaggccgcgtgcctgccggtctgcaggggatcgtaggcatcaaaccgacgctggacgttgtgtccacggccggggtggtgccggcctgccggtcctgggacgccgtcaccatctttgcccgccacctttccaccgcagagctggccatgggcgtcatggctgggggagcgcgggcctggccggcaggcatccgcttggccgcgccggagaagccgcgggtagcgtacccggcaagcctgccggcgctgcccgaatcctgggctgcggagttccaccggaacatcggccgcctgcaggagctgggcgtggaagcggaagccatcgacttcgatgcgttcctcgacgctgcccggctgctgtacgacggcggcctggtggccgagcgctacgccgccgtcggcgaattcatagagaaggccgacggcggcgctggcaccccggcgggcatcgaccccacggtggagggcatcatccgggcagcgggcagggtgcctgcccaccggtacgtggccgatacggccaggctggaagtcctgaaggacacggcgatggcgcagctggaagggtttgatgcgctgctgatccccaccgccccgttccaccccacccttgccgaggtggctgccgaccccgtgggagtgaactcgctgatggggacctacaccaacttctgcaacctgttcgacctgtgcgcggtggcggtgcccgccggcgaagtggacggtgcccagttcggcctgaccgtggtgggccggaccttcgacgacgccgtcaccgcggatattgcgcgcctgctggaatcaaccccggacgttccggagctcttcgccgggggcgcggcaccggcagcggcggacaaagccgcccacccgtcgtcgtccgctccctggccgctggccgccggcgccggcgctgtgccgctcgttgtggtgggcgcgcaccgcaaggggcagccgctggcgccccagcttgaggaactgggcgccgcctgggacggcccggtgcggacagcggcccgctaccgcatggtgtccctcgacaccgtgccgcccaagccgggggtataccgctcggaccgcgacggcgcagagctggtgggtgaacggtggctggtgtccccggcagggctgggcgcgttcctggccgccctgcccgaacccatgctgctcggatccatcgaactcgcggacggctcgaaggctgtggggttcgcctgcgacgctgttgctgctgcaggcggggaggacatcacccgctacggtgactggctggcagaccgcggcggggagccccagcccaggaacgtctggcagaacctgggagacgcggccctggccggattcagcaggggaggtggccgtggctagcccttgaaatactccgagatgtccgccaccagttcattcacggctgccgggatggaaccgtggaaccctttgggggagagctcgaacgtgctgccggggactgcggagtgcagccgctccgcagtagctttgtagtagctggggctctttccgccggccatgaaatgggtgttttcgggaagcacgctgaagtccctggcatggtccgcctccttgtacgcggcgcgcagctcgccaacgccgctgggcatgacctcgcggaacatcttgttgaccttggtccgggacagcagggccataagtccggcaaggaccggctcggggatccgtgccatcgccgatcccgggctggtggcccgcttcatgtgtgccagggcgtgccccacccggccgttgttgacagcgtcctcaaacccggacagccaggacgtgtcgatgctgccgtcaatgttcacggcggcgtcgtacaccgccagcttgtccggcacgtaggcggtcccggtgaactcctggacggcgttcagggccacggacccacccaggctgtggcccaggatgttccgcgcaccggtggcgtccaggacggtgcgcacgtccgcgatctcggtggccatggagtaaccggccggctgcccagaggaactgccgcggccccggcggtcgtacacgtccacggcccatccttcgcccaggcccttggccagcgccacggaaaacggccggtagatcagggcagtcaggaacgccccgccgatcagcagcacacggcgttctcccggcgcatcctcggtgccgtaactgtacaaagccagccggccgccgtcgtgcgttggaagtacctgttctttcaccaccccatcctaggcaggactgcgcagctgcccaggcacgcccgggaccgggcgggttgcgcccgaatccggcgtccccgaagtcccggtaaacttggggattgtgacttcccaaaacacccccgcgcccaagaacgccccagagccgctcgacgccagcgagcagatgcggatccgcatggagaagcgcgccaaactcatcgagcgcggctccgaggcctacccggtgggtgtggagcggacgcactccctcgccgaggtccgcgaaaagtacgcccacctcgaggcggacgacaccaccggcgacattgtcggcgtcaccggacgcgtcgtctttgtccgcaacaccggaaagctgtgcttcgccaccctccaggaaggcggaaccgacggcaagggcacccggctccaggccatgctcagcctcgccaacgtgggtgaggaagcgctcgccgactggaaggcgctggttgaccttggcgaccacgtgttcatcaagggcgaggtcatttcctcccgccgcggggagctctcggttatggcggactcctggtccatggcctccaaagccctccgcccgctgccggtgctgcacgcggaactgaacgaggagacgcgcgtccgccagcgctacgtggacctgatggtccgcgatgaagcccgcgaaatggtctacacccgtgcagccatcacccgctccatccgcgaaaccctcttccgccacagctacgtggaggtggaaacccccatcctgaacctggtccacggcggcgccctggcgcgcccgttcgagacccacatgaacgccttcgaccagaagatgacccttcgcatcgccaccgagctctacctcaagcgtgccgtggtgggcgggatcgaccgcgtctacgacatgggccgcgtgttccgcaacgagggcgtggactccacccacagccccgagttcaccacccttgaatgctacgaggcgtgggctgaccagttcgtcatggccgagcgcatcaaggagatcatcctcgacgccgctgacgccgtgggcgccggccgcgtcctccagaccgaggcgggggagattaacctcgacggcgattgggcctggctggccgtttatccgggcctttccgacgccgttggccaggaaatcacgccggagacgccgcttgaggtgcttcgcgggatcgccgaaaagcacgaggtcaaggtggactcgaagtgggacgccgagaagctggctgttgagctgttcggcgagatcgtggaaccaacgctgctgaaccccacgttcgtttacgactacccgccgtcggcccagccgctggcccgcccgcaccgtgaggacggccggctgatcgaggcctgggacctcatcatcggcggcatggaacgcggcacggccttctccgagctgatcgaccccgtgatccagcgcgaacgcctgaccgagcagtcacgccacgccgccgccggcgacgttgaggcgatgcagctggacgaggatttcctgcgcgcgctcgagtatggcgctccgcccatgggtggaatcggcttggggatcgaccgcctggtcatgctgttcaccggtgccggaatccgcgaaaccatcctcttcccgctcctcaagccggaaggccactgaccatggaatacgtggcagtccttctcccgtccattgtggtgggcctgcttttctggttcgccatgaaatcgatcttcaacgcggataaggctgagcggcaggccgaggcccaagcccaggcagaagctgaaacccggactgcggcacccgttgaccggcctgacccggaatcgaatagataaacccccacactttccccctaatatccacaggaaccattcagtactttgacgcgttgccataaaaagagtcatactttttaggaaacatcctgcttttctgaaaaccgaaccctttccaaaaggaagtcttttaaatggcacagaaagtaaacatcatcctcgttgatgatctggatgggggatccgcagacgagaatgtgaagtttggccttgacggggtcaactacgagattgacctttcggcgtcaaacgccgccgagctccgctcttcgcttgagcggtttgttgcagccgcacggaaatcctccggcggcggccgggccgtccgaacgaaagcagcagccagcggccgcagccatgattctgcccaaatacggcagtgggcgcgtgaaaacggctacacggttaacagccgcggccgaattcaggcagaaatccaggaagcctaccaaaaggcaaattcctagttccgcccgaggctccggtaagccctgcttcccaacaacgggaagcggggctttttcggtttccggacttaaccatgctttgccccccggtccgggcaattcggatttaacagcctccatggcacaaacgcgggtggtggcggcaggcaagcgtgctgtaccccgcagcaggcaccggcgggggcgtgcgagagccggcaggggcacccgcggagggcccgccgtcgtattcccgacgtcaccacggtttcccctgtggcgaacacgctccccaagtccgggtctgccacgtagcatcaaagtacgtcgtagctaggagtgtggcgaaatgtttgagcgatttacggaccgtgcccgtcgcgtagttgtgcttgcccaagaagaggcacgcatgctgaaccacaattacatcggtaccgaacacatcctcttgggtctgatccatgagggtgagggtgttgccgccaaagctcttgagtccttgagcatttcgctcgacggcgttcgcgagcaggtgcaggagatcatcgggcagggccagcaggcgccgtccggccacatccccttcaccccccgtgccaagaaggtgctggagctctcgctgcgcgaagccctccagctgggacacaactacatcggcacggagcacatcctgctgggcctcatccgcgagggtgagggcgttgccgcccaggtgctggtcaagctcggcgccgacctgaacagggtccgccagcaggtcatccagctcctttcgggctaccagggcaaggagaccaccggcgcaggcgtcggctccggccagcctgagggtgcacctgcaggatccgtcgtcctggaccagtttggccgcaacctcacccaggctgcgcgcgaaaacaagctggacccggtcatcgggcgcgagcaggagatggaacgcgtcatgcaggtcctctcccgccgtaccaagaacaacccggtcctgatcggtgagccgggcgtcggcaagacggccgtcgtcgagggccttgcccaggcgattgtccgcggcgatgtccccgagaccatcaaggacaagcagctctacaccctggacctcggttcgctggtggcaggctcgcgctaccgcggtgacttcgaagagcgcctgaagaaggtcctcaaggaaatccgcacccgcggcgacatcatcctcttcatcgacgagatccacaccctggtgggtgcgggtgccgccgagggagccatcgatgctgcctcgatcctgaagcccatgctggcccgtggcgagctgcagaccatcggtgccaccacgctggatgagtaccgcaagcacatcgaaaaggatgctgccctggagcgccgcttccagccgatccaggtcaaggaaccctccgtggcgcatgccatcgagatcctcaagggcctgcgtgaccgctacgaggcgcaccaccgcgtcaccatcaccgacggcgcccttgcttctgctgcgagtctcgccgagcgttacatctcggaccgcttcctgccggacaaggcgatcgacctgatcgacgaggccggcgcccggctgcgcatccgccgcatgaccgctccgccggagctcaaggccatggacgagcgaatcgccaagctgaagatggaaaaggagtccgcgattgacgcgcaggacttcgaaggcgcagccgcgctccgtgacaaagagcagaagatgatcaccgagcgtgccgagaaggaacgccactggaagtccggcggcatggacgacatctccgaggtggatgaggacctcatcgccgaggtgctggccaactccaccggcatccccgtgttcaagctgaccgaggaagaatcctcgcgcctgctgaagatggaagacgaactgcacaagcgcgtcgtcggccagaacgaggccatcaaggccctgtcccaggccatccgccgcacccgtgcagggctcaaggaccccaagcgtcccggtggctcgttcatcttcgccggccccaccggtgtcggcaagaccgaactcgccaaggcactcgcggagttcctgttcggtgaagaggacgccctcatcacgctggacatgtccgagtactccgagaagcacaccgtctcccggctcttcggtgcccctccgggctacgttggctacgaggaaggcggccagctgaccgagaaggtgcggcgccgtccgttctccgtggtgctgttcgacgaagtggagaaggcccacgcggacctcttcaactcgctgctgcagatcctggaagacggccgcctgaccgactcccagggccgcgtggtggacttcaagaacaccgtgatcatcatgaccaccaacctcggcacccgggatatctccaagagtgtggccaccggcttccagtccggcaccgacacgcagaccggctacaaccgcatgcgcgcccgtgtcacggaggaactcaagcagcacttccgccccgagttcctgaaccgcgtggatgacgttgtggtgttcccgcagctcacccaggacgagatcatcgagatcgtggacctcttcgtcaaccggctggagaagcgcctcaaggacaaggacatgggcatcgagctcacgcccgccgccaaggtgctcctcgcaacccggggctacgatcccgccatgggtgcccggccgctgcgccgcaccatccagcgcgagatcgaggaccagctctccgagaagatcctgttcggcgagatccacgccggcgacatcgtcgtagtggacgtggaaggcgaaggcgacgacgcgaagttcacgttcgccggcaacgccaagccgcgcatcccggaaatcgctccgagcgtctagtttccacagccaaagccccgtcactccacaaggagcggcggggctttcgctttgccctccgtcccttcaaagcgttggcatgcgcgtccacggtcaccacgctgcggcaccggagttatttgccgcttgctgctcctccgtcgctttgacgcaagctacacaaatgaccccggcccctccgcttcacgcgaaggcgcgcctcgcgcgggtggcggcggtcaggcatttgtgtaggcgccgtcaaagctgggcccacgctggcagggttccctggccgagcttgcgaggttagggtcaccgcggggaggaacgagcaggcgccggcaaatggctcggccgacggcgccaacccggccccgcacccctcggcccacgaagcgacggatgtgccgtcgtcgttccgcctgtagtgaagtggttgtgacgggcggcacaactcgggttgaatcgggggcatggctaacttggaaccggcgatcccggatgagcaacctttgaccccttttcatgatctggaccattacctgtccatcccgcgggtaagtgggctggccttgagccccgacggccggcggctggtcactaccgtggccaccctgaacggcaagggcaccgaattcgccacggcgttatgggagcttgaccccgaggggcgaaagcaggcgcgacggattacccgcagtgccaaaggtgaggccggagcggcgttcgcggccaacggcgatgtctacttcacgtcggcgcggccggatccggacagcccggaaggcgaccccgtgaacgccctgtggctgctccccgcggatggcggcgaggcccgggtggtgctgaaccggccgggtggcgtgggcgcagtgatgacggccaaagcggcggatgccacgttcgttgttgctgaggtcctggcggggtcggcggatgaggacgacgacgccgaacggcgcaagtcccgcaaggacaacaaagtctccgccatcttgcacagcgagtacccggtccgttactgggacgccgatctgggccccggccagccgcgtattttcgccgtcgatcagggaccagacaaagcacatggcaagccgggcaccgtggacgccgcggcgccgctggtcctgcgaaacctcactccggacgcaggacccaggctccgcgaagcggaaaccgccgtcagccccgacggcaagaccatctacgcgagctacaccaagccgctggccaaggctgacagccggtccatccttgtggccgtggacgtggcgtccggcagcaccaaggtgctcctggacgaggaaggcatgagctacttccccgggcccgtcagcccggacggcagcaccctggcagtggtcagcgaaagcgacaccacaccgcaccgggcaccacaggtcaagctccatctgctggatgtctccgggacgggcggcgacgctcccggcgggcttacccccgtagcgcacgactgggaccggtggcccaggcccgccgcctggcttcctgacgggtccgccctcctggccaccgcggacgacgacggcgcgtcgccggttttccggatcagtgtccccgccgcttcggctgaagtaggcgtcacccgggtgacggaagacgccgcagcctataccgacgtcgtggtttctccggacggacgtagcgcctatgcgctccggagctcgtatgagttcccgcccgaaccggtccgcatcgacctccagaccggcgaggcaacgcgcctgcccgccccggcggagcgtcccgtccgtcccggcaggctggaacgcattgcagcgacggcggctgacgggtcccgcatcccggcctacctggcactgccggagggcgcgtccgcggagtccccggcgccgatgctgctgtggatccacggcgggccgctgggctcgtggaacgcctggacctggcgctggaacccctggctgctgacggccaggggctatgcagtgctgctccctgatccggcactctccaccggctacgggcaggcccacatccagcgcggctgggggacatggggcaaggccccgttcaccgacctcatggcggtgaccgacgccgccgtcgaacgccctgacatcgacgctggccgcaccgctgcgatgggcggctcctttggcggttacatggccaactgggtggcaggacagacggacaggttcaaagccatcgtgacccatgccagcctgtgggctctggaccagttcggccccacgacggatgcctcgcagtactggctgaaggaaatgacccaggagatggcgctggagaattcgccgcacctccatgtggaaaacatcagcacgcccatgctggtgatccacggggacaaggactaccgggtgcccatcggtgaggggctgcgcctctggtatgagctgttgtccacatcaaaactggccgcggaccaggacgggcagacgccgcaccggttcctgtatttcccggacgagaaccactgggtgctccagccgcagcatgcaaaagtctggtaccaggtggtggagcagttcctggcaaagaatgtcctggatcaggagctgcccctgccgcctgaactgggactctgagctcctgggcacctcgtaggatggctctgtgactgagtccttccatattcgccctgcccgtaccagcgatgtctccgccatcaagaaactcgtggcgccgctggcggaccagcggatactgatggccaaggaaacggtggcctactacgaaagcctgcaggagttccgcatcgcagagtccaacgacggcgaggtcatcggctgcggagcgctgcacgtgatgtgggaggacctcgccgaagtgcgcacccttgccacgtccgaggactggcgcggcaagggcgtggggcatgtgctggtggagagcctgctcgaggaggcgcttgccctgggcgtggcccgcgtcttctgcctgactttcgaggtggagtttttcaaacgccacggcttcgaagtcatggctgaccagtccgcagtggaccccgtggtgtactccgagctcctgcgctcgcacgacgagggcgtcgccgagttcctggaccttgccagggtcaaacccaacaccctcggcaacacccggatgattcgggcgctctaggaccgaatccaaaaccagctgcagccccctgacctgcgcatacttgttttattcgaattgatggataaactatgtgtggccgggttggggggcccacaggaaagggacagtcattgggggctgtcccttttctgcgtccagggaacgggccgccgggcgacttcaaggaacctaccgctgccgggcctgccggtagtagggtcaaggtgacattctccaggaagcagagccaggagcaccgccatgaaaaaactcatcaatgacccgcgggccgtcgtcgaagaatccgtacagggcttcggcatggcctaccccaatctggttaccgtcagcacagaccccaccttcatcacccgcaaggatgcgcctgtgggcggcaaggtggggctggtctccggaggaggcagcgggcatgaaccgctgcacggaggctacgtgggggtgggaatgctcgacgccgccgtgccgggggcggtgttcacttcaccaacgcctgaccagatccttccggcgaccctcgcggccaactcaggagccggcgtcgtccacatcgtgaagaactacaccggtgacgtcctgaactttgaaacggcggccgaactcgcggaagccgaaggcgtcagcgtccgcacggtcctggtgaacgacgacgtggccgttgaagactcgctgtatacggccggccgcaggggtgtaggcggaaccgtgctggtggagaaaattgccggtgccgccgcggagaggggcgatgacctggacgcagtggcggcggtgggtgaccgcgtcaacgccaacgtccgcagcatgggtgtggcgctgtccgcatgcaccgtcccgcacgcaggcacccccagcttcgacctggccgaggacgagatcgagatcggcatcggcattcacggtgagcccggccggcacaaaatccccatggagaacgccgacggcatcacggaccgcctgctggaacctgtcctggccgatctgggcatcgcgtccggggacagggtcctcctgttcgtcaacggcatgggcggcacgccgctgagcgagctgtacatcgtctaccggcgggccgcgcaggtcctcgcggaccatggcgccacggtggaccgttcactggtgggcaattacatcacggcactggagatgcagggatgctccatttcggtcctgaggctggacgatgagctcacggagctgtgggacgcgccggtgcacacggcggcgctccgctggggcgtgtagcggtggcgcttgatgtcacctgggcggtgaagtggctgaccctgtccgcccaggccatggccgagcaccgggtggagctgatcgaactcgaccgggccatcggggattcggaccacggggaaaacatggacaggggattccaggctgtcctggacaagctggctgaggctccgccgcagaccccaggggccgccctgaagctgacagccatgaccctgatgtcaaaggtcggcggggcagccgggccgctctacggcacagctttcctccgggctgcaacatcgctgggggacgcggccgaagtcgatcccgcagcctgggcgggcgcccttgccgctgcgcgcgacggcatcgtggcacgcgggaaggccgaatcaggggacaagaccatggtggatgcgtggacgccggccgtggaagctgcccggaaggccgcgatggacggcaacggggatgccctcaccgtcctggtggcggcggccgaggctgccgaagccggcgccgtcgccactgaccccatggtggcgcggaaaggccgcgcgagctacctcggagagcgcagcgcagggcacagggaccccggagcagcctcttccgccctgattctccgcgcagccgtgggagccgctgcgtgaccgtcagccttgtggtggtatcccatagcgaaaaaattgccgacggcgccgcggagcttgccgcgcaaatggcgcctgacgtcctggtcctgacagccgggggcaccacggacggaaggatcggcaccagcctggagaaagtcctggctgccctggacaaggcgggcagcggcggcaccgtcatcctcactgacttggggtcggccgtgatgaccgcggaatccgcgctcgagttcgccgagaacccggaggagatggtgctggcggacgcgccgctggtggaggggctcgtggcagccgcggtcgcagcgcagggcggtgcggacatgcacgcggtcaggcgggcggcggaatccgtgggtggtcccgcccgccagccagaggacgccccgctgaaggctattggcgaagggccggtcaccggaaaggggccggacttcacgggcgactttgagctggtcaaccaggccgggatgcacgcccgcccggctgcgaagatagccggcgggctgtccgggctcgatgcggaagtgacggtcaacggggtggacggcgcgtccatgacgggactgatgacgctcgctgccggcaaggggtccgtgctgcacgtggaagcctggggtgccgatgcggaacgggcggtgaactacgtgggcgggctggtgcaggcaggattcggggagccgtaggcctcgtttgggtaaccggcggtgtgttcccggggtagcggcccttcctgcgaataagctcgatgccatggaacggccccagctcgaagacagccccgcagaaattgaagtactggaaggtcaaacgtccgtggaggaactgctggctgatcttgggttcgaatggcggcacagcactcccgagcaggaagctgcaccccaggccaccggcgacgacgctttcgggcagcccgcgctgttctgaacggcactcttccaaacccctcccaacgggtcagccctgctggcgcagcccttcggcgtcgagtaccaccgctgcggtgatgaagcggccgcactgctcgccaaacggatagtccccgcgcggacggaattctacgctccgcacgggcagtgccgtcccgtccggtgcggttcccgatgctgttactgccatgggggattcggtgagcgactgcagcatcagcaccccgtctttgctgccgttcggagatgcggtggctgagcagacgccgttggtgcagccctggtcgatggacgagtttcccggccggaggtccacgtcctcctccgtgcattcgccgtcctggcaggccttaaggtgcaggccggagacctgctgcgcgtagctggcagggatcgttaccgagacggcggtggcctgggcgatggcagggcaggggaccgcgccggggccgggaccgcaggccgtggcgagtcccgccgtcgtgatcaaagccaaaagcagcccatgcctgcgcatacttcagcgtatggcgccgttgccgcagcggcccgggcccaacccaactgatgcccgcattgttatggccggcgcagctgtgactgccaaacggagtccggcgtgaaattaagcagggcgcccgtgtcagtccacagggaagatactgatgaaccacagggaggcaagggcgaaaacggcgaagaaggggacgacgcaccccagcgtggaccggggcttggaggaaacctgccgcgactcgttgggattggcggggttgtaggccacctcaatgggcgcacccggcaccggctggctggcgaaggggacctctgactcgccggcaaacaatgttccctgcgggtccgtgaactggtacatgggaaaaaaccgccggctccggctggatccgccgccgccattggtccagcccgccacactgccggtcacggtggcctgcactttgggccatgacgcggcctgctgctcgtcgcgcttcgtggtgcgcacggcccggaccaccgcgagcaccgccgtgatgacgaacagcacccacacgatgtacaggatcattttcatggcttgcccctggttccagtcacctgaaaagtatgccagccagcgcatactttctctgtgttgagctcacgcgggaagccggtagccgccgtcgtgcatctctgccagaccgtcggcaagcaggccagccagcgcccgctccagctgttccggcgccgagttgagccggtgcagggcggccagcggcacgccgattcccgtcggtgcaaagcccaggtcggccggctcccggaagaacatgtccggcggcaccggagtttcggccagccgcagcacggccaccacggcgccccggacctggcggtccgtgccgtgccatgcctggcccttggggacatacgacggcggcggctcgcctgccgcgcgccaggcgcaaaggtcgctgaccgggcaggcggcgcacttgggtgcccgggcagtgcatacaagcgcccccagctccatgaccgcagcgttccaccgcacggaagaaccgtcgtcggccggaaggagggatgcggccagccgcatctccgccgcggtcagcgcaggggccggcagcgcagtaccggagacgaggcgggcatggacccgcctgatgttggtgtccaccacggtttcccgccggccgtaggcgaaggcagccacggcggccgccgtatagccgcccacgccgggaagcgccagcagctccgggtacgaatccgggaccttgccgttatggtcctgggtaatagctgcggccgcagcatgcagcctcagtgcccggcgcggatatcccagccggccccaggagcgcactgcttcccctgcgggctctccagccagggcagcgggggtgggccagcgtttcagccactcctgccataccggcaatacccggacaacgggtgtttgctgcagcatgatctcgctgaccaggatgccccagggcgaacagccgggctcgcgccaaggcaggtcgcgggcggtttcgctgaaccagccgttgattcgctcgtgcagaaggtcagggccggccacggtcccggcagcacatgcaggacccacgggatcggccgggcgcggggaaacggcggtggaggatttggtgtcgatgccaacactgtaatggatgtgtctgggcgggctgaaacggggatgtgaccagagcgtctgcggcgcggcggcgtggtgggtgaacagaatcgggcctgttctctagcctaggaggatgggcaggcaaggcgaatcatcaccacacggcagggcaccggcatccggttccacggccgtccgcaagccgagcgcggcagtttaccgccgtcgtcggctgttccttggcggtgcactcctgttgatcattgcgctggtcagcagctttgccgtagccggtgccttcagcggcaagtcggagcaggcttcgtccacgggggcgacggcatctgcagaacctgcggcaggggcttcagcgtcgccgtcggcgtccgaacctgcgccgacgcccacaccgtcagccacctccggctgcaaccagaacctggtgaccgtttccgggtccactgacaaggcggcgtatgggcctggcgaaaaccccatgctgacgctcaaggtgaccaacggcggcaccatgccctgcgaagtcaacatcggaacatcgcagatggagttccttgtgaccagcggcgcggaccggatcttctcctcccgggactgccaggccaagagcgaggacctggtgaaggtcattgcgcccggagccagcgagaccgccaacttcccctggtcccgcacgcggagcgtggagggctgccagcccatcgaaaccaagccgggcggcggcggtgcgtactacatcttcacggcgaagctcgggtccaaagccagccccaaggctgtcttccagctgaattagcatcgactgctccataaatgccgttttcagcctccataaggacaattacggagcaatcgatggaggttagaggaagcggtccagcaggcttgcttccgccatccggctcaggccttcacggaccgtgcgggcgcgctggtcgccgatcccgtcaacagtcatcaggtcatcgatggtggcggccatcaggaactgcagcccgccaaagtggtccaccagtcggtccgcaactgccttgggcaccgccttcagcccggacagcaggcggtacccgcgcggctgcaccacggcgtcaaggttggcctcaccgcctgcgaacccgacaattccggaaatctttccgaggtcgatcagctccgtgggaccaaggctgaccagcgcgctgacggcgttctcaatgtcctccggggtggcgtccggagcgccgtaatcgcggatgatgacgtcgctgccggggcccctgccaacggtgagctcatccagctggagggagaggaggcggccgtcctcaccgagctccaggacatactgggcgatttcctcggagatccggcggaccatttcctgccgctgcagggtcacggccacgtcccgcacggtcaccatggcttcaatttcaagggccgagagcgagctggtgacctggtccaggcgcgagcggtagcgctccagcgtcgcgagggcctggttggcgcgggccaggactttctccgagccctccaggacgtgccgaaggccgttgacgtacagggcgatgatctgcatggactggctgactgaaatgaccggcaccccggtctggatggcaacgcgctcggcggtgcggtgccgggtgccggattcctgggtttcaatgctggagtccgggacgagctggacggctgcgcggaggatgttcccggcgtccttgtcacagataatggcgccgtccatctttgcgagttcgcggagccgggtgggggagaagtcgatgccgatgtcgaagccgccggagcagatggagtcgatggtccggtccgagccgaggacgatgagcgcgccggtgcggccccgcaggatccgctccaggccgtcacgaaggggggtgccgggagccactctgcccaaggtagccctgagtgattcttcggggctccgcgccatagtgttcccttcaaaggtgcggaccgccgcccgcaggattgccggcttcagcaggttgccggcaggaccagaaaatgctctgtttcccgcaagctcaatgataggggcaaggaacggcgtcttccgcacgggcaagccctaaagtgcctcattagggagtgcgggaacaggggtccggaacgcgtccgacgacggatggcagggcgggcatttcggcccgcctgccgccgggttatgaggcggtttgatccgggctggcctaggccgggttcgaaagcgacctcagcgtcctggtgttgctgtcccagaggcgggcttccgtgcagtggcccgccaaacgcaggtccagcaggtccatcgccgtcccgagctggtccgcggggacgcggcgggcaagggtgacatggggtgtccaggcatccggcagggtaagcggcaaggccccggagatgccttcgtggaggagtcggtgcagttcaaggagctggcgggtcaccaccacggaccgggccaggacgtacgttcccgtccgagcggggaagatgtggacgccggaaaagctgatgtccaggggcagccgctgccacaggtcccggagggtgtccggcaggcgcatgtccgcgccggccgcaagggtgatgtggggactgttactgggcgaggtgtggcctgccaggcttgggattccggcgtccgcgagcctcgcccagtcagccctgatggcggaatcagtggagtccccgaaggtcagctcgatgctctgcatccacccatcatgccgcccggcccaacccagaccgcgtcagccgggccagcccagccaccgcacctcagccgaaccgggccccggctgcgcccggaccacaaaaggcgggatgtgcagggactgcggtagccgggtcagcgcatccgttcccgcagcatccgttccaggtccctgctgactttcgtgagcgacgccgccctgagcgctttttgctcggcaggtgtctgggttccccggtggcggtgctcggcggccggacgggcctggtcacggtcgccggatgcggccaatcccgtggccaggggatcgaagaagaggttgccggaaaaggagatgccctgcaccgttcaggtcctttccaggcgccaggggaagccgttccgcgccgggttgtctttggtcatcatgcggccacgctagcgggaggtcgtttcacggccttgaacgtccggtttcgcgggtgttaagcgggcaccgccgccggtttgccgccctgcgataaactggaacttggccgtttgccagcccgtttccccggccccaacgccgcagtgcctcaccaggcagcgcccgggtagtcccaaccgcagcgaaagtagcaccgtgtcccaagatgtcctgacccccgcccggatctccggtattcacaaagaggcgggccgccgcaggacctttgctgtcatttcacaccctgacgcaggcaagtccaccctgaccgaagcgctcgccttgcacgccaaggtgatcggcactgccggtgcctccagcggcaaggccaaccgcaaggaaaccgtgtccgactggatgcagatggagaaggaccgcggcatttccatcagctccgcggcgctccagttctcctaccgggacaccgtcatcaacctgctggacacacccggccacgccgatttctccgaggacacctaccgggtgctggccgccgtcgactgcgccgtgatgctcgtggacgccgccaagggcctggaaacgcagaccatgaagctgttcgaggtctgcaagcagcgcaacctgcccatcatcaccgtcatcaacaagtgggaccgccccggcctggacgcgctggcgctgatggacgaaatcaccgaacgcaccggcctgcagcccatgcccctgacctgggccgtgggcatctccggcgacttccgcggcgtctgggaccttcgcaacgaccgtttcgcccggttccagcgcaacaacgccggcgcgcagatcgccctcaccgagtacttcacgcctgaggaagcagcccagagccagggcagcaactggacggacgccgtggacgaggcgggactggtgatcgaatcgaacctggagttcgacgtcgaggcgttccatgcaggcaaggccacccccatcctgttcagctccgccgcgctcaacttcggcgtcaaggaactgctggacgcgctggtggatttcgctccgccggccgccccgcgccccgacgtggacggcaacccgcgtccggtggaatccccgttctccggcttcgtgttcaaggtgcaggccggcatgaacaaggcccaccgcgaccatgtggccttcatccgggtttgttccggcgtcttcgagcggggcatggtggtcacgcagacccggaccgggaaatccttcgccaccaagtatgcgcagcaggtgttcggccgggaacgcgaagtgatcgacgaggcataccccggcgacgtcgtgggcctggtcaacgcgtcctccctgcgcgtgggggacagcctcttcctcgaagggccggtggaataccccgctatcccgctgttcgcccccgagcacttccaggtggcccgctccaaggaccccagcaagttcaagcagttccgccggggcattgaacagctcgaacacgagggcgtcatccaggtgctccgctccgacgtccgcggcgaccaggcgccggtgcttgccgccgtcgggcccatgcagttcgaggtggtggaggaccggatggcgcacgatttcagcgcccccatgcggctggaacgcctgccctactccctcgccaggatcacgacggcggacgccatgccggcgctcgccaacgtcatcggcgccgaggtgcttttgcggtccgacggcgagtacctcgccctgttcaacgacgtctgggccctgcgccgcattgagaagaaccacccggacctcaccctcgtgcccatcggcacccacaaccccgcaaagtaggaaccgtgaacgcaggccccaacagcgcagttcagccccgcgccattatcaccggcgccggaaccatcaatccggtaggttccacggtgtccgagacctgggccggcctggtcgcgggaaaatccggcatcgccgcgcttgaggatgcctggaccgaacagctgccggtgaagatcgccgggcaggtcaccgcggatctctcggagcacctgagcacccgcgagatgaagcggatggaccggtgcgggcagctggcgctcatcgcagcccgggaggcgtgggcccaggccggcgccccggacgtggacccggagcgtttcgccgtggtgatcggatcagcctacggcgggctgggttccacgctggagcaggaccggacgctggcagcctcgggcccgcgcaaggtctcgccgcacacactgacccgcctgatggtcaacggccccgcggcctgggtatccatcgatctcggcgcccgcggtggtgcccggacgccggtcagcgcgtgcgcctccggggctgaggcgattgtccagggagccgagatgatccgctcaggagcggccgacgtcgttattgccggcggcgttgacgcttccgtgaatgacctggtgatcacgggcttttcccagatccgcgcgctgtccacccgcaacgatgacccccagcgcgcatcacgcccgttcgacggcggccgcgacggctttgtcctcgccgagggcgctgccgtggtggtgctggagagcgaagagcacgcccgcgcccgcggcgccgggatgctgggggccgttgccggcggagcggtgacgtccgacgccaacgacatcgtggctgccgaccccgcaatgcagcggcgggtcatgcagaaggccctcgaatccgcgggcctggctgcggaagacatcggcttcgtccacgcccacgccacctcgacgccggtgggggacaagcttgaaggccaggccatcaacgcgatctttggtgcggacgtgccggtcacgtccaccaagggccacaccggccacctcctcggcggcgccggttccctggccgccgtggtggttatcgaggccctgcggaccggcctgcttcccgggaccctgaacgtccaggagctggaccccgaggtggacctcaacgttgttaccgaagacgcccaccgcctccagccgggatacagtccggccggactggtgaacgcgttcggcttcggcgggcacagtgttgccctggtgatcaccggcgcctgaccgttgctcggcgggacggttttcgcccggggcggttttcgcccgggacgccggagcggtgtgcactcgccggagcgctgcagcgtcccggcaccgttccggcgtacgggcgccacccgcatcccggtcaggaacagaggtaatgcacatttgaatctcatagcgagtacattcgcacccgcatctggacaacgcacccgggcgctcgcgggtgcaaggaccagtagtgggtgccaccctactaggggtcagcgcggacctgttcagccagcgcatccagcaccggcagctgccccttcaccagcttgatccgggcttccggctcgtggaaccagcgggcgtcgtcgatttccgggtagtcctggatccggcctgaacctttgggccactccaacggaaacgtgttgctgacgatccgttccggctggaagtcctgctccgcggcgaagacggtgatgactttgccagagggctgcctgaactccccgaggagccggtagtccgcagccggagccggggtccccatttcctcggcgaactcgcgcagcgcagcggccaggggatcctcgtcctccccgtattcacccttggggatggaccaggcgtgggcgtccttgcgggcccagaacggaccgcccatgtgggctatccacacctggaaactgcctggatccattcttcggtacagcaggatccctgcgctcagaacgggcatctttcctccggtgggtgaatgtttgaaaacagacggaagttgccgtccaacgttaacccgcagttcacggtgctgctttaggttattccttcaggcactctgctcgaagggaccagtcatggccagtattgccgaggtgttgggacgtctgacgccggaagaacttgatgagcttcacagccttggtccgcaggggcacctgccgcggtaccttgttgacgccctggaccgggcggccggcggtcccggctctggccgcggctattacgtacccaccggcaacgtgaacagcaccggcggaccgctgctggtgctccgcagcgacgtgtccggctggcttctcaactcccgccgtgacgaccccgattcgctgccgcgccacaatggctgacgcccgcatcacgggcacggagatccggggcgcgcaaaggtcggcaaaagccgccagcagccgccgtcggtagaactaaccgatcagcaggctcaaagcctcggtaagatgctccacttcccgcacggaaaacccggcggggatgggcccagggcccgcatggctggccggtaccacagcatgggtaaatcccaggcggtgtgcctcctggatgcgctggttgatgccgggcaccggccggacctcgccggccaggcccacctcgccaaaggcgatgaggcggatggggagcggcttgcgcgcttttgctgatgccacggccagggctacggccaggtctgtggccggttcgctgagcttcacgccgcccacggtggccacataggaatcatccttgtgcagcagcgttccagcgcgctgctgcaggacggccagcagcatggaaacgcgcgaggagtccaagccgctggtggcccgccgcggctgcgagttggggctctctgccagcagggattggacctcggccagcagcggacgccggccttccatggtgaccgtgatgcaggtgccggacacgggttccttggtgcggctgacaaagagtccgctggggtcggcgaggccctggatgccgtcttcgttcaggtcgaagcagccgacatcgtccgtgggtccgtagcggttcttgacggcacggagcagccggagccgtgaatgccgttcgccctcgaactggcacaccacgtccaccaggtgctccagcagccgcggcccggcaatggagccgtccttggtcacgtggcccaccaggagggtggtcatgttccgccgcttggccgcggcgataatggacgctgccacttcgcggacctgcgaaacgccgcccgcgctgccgtcaacgtcggcgctgctgagggtctgcacggagtccacgatcagcagccgcggttcaatcttttccacctgccccagcgcctggcccaggtccgtttccgcggagaggtacagcgattcagccacggcatcgatccgctcggcccggagctttacctgggccgcggattcctcaccggtcacgtacaacacgtcctgcgcagtccgggcgaacttcgccgcaacatccagcagcagggtggacttgcccaccccgggttcaccggccaacaggatgacggcgcccggaaccaggccgccgcccagcacccggtccagttcatcaacacccgtgggcaggaacgctgccgtggtggcgtccacctcggcaatccggcgggcgggctccaggactgtagtggccgccgtcgtccgcgcaacagctgcgccggtctcctcaacggtgccccacgcctggcactcgccgcaccggcccacccacttgaccgtggtccagccgcactcagcacatttgtaggtgggcgccttggaggccctggaagtctttgttgccatgggttccaccctagtggcgggcactgacaatcaccggcaaagcacttgcctgtgatccaagccatctgtatagtcaaaccccgaaggcaatttcgcctacaggattgttacccgtgaatggggcaagacctgagaagcacactctgtgcgtctcgggtctttttttgtgcccaaaaatagacagagaggtctgacatggcaactgtggactaccggtcgctggccggagacatcctccagggggtgggcggcgaagggaacatcgccagtgccacccactgcgcaaccaggctccggctcaagctgcgggacgacagcaaggcggaccaggccgcagtcgagaaactgcccggcgtgatcaccgtgatgaaggccggcggtcagttccaggttgttatcggcaataacgtccccacggtctacgccgagctgggcaagatcaccaggctcaccgatgacgacgcaggcgccggcgacgatccagtggtgcacggcaacctcttcaaccgcttcatcgacctgatctcctcaatcttctcaccagtcatctggtcgctggctgcagccggcctgctcaaggctttcctgagcatggccacccagttcggctggcttgaccccgcatcgcagaccaatgtgatcctggcagccaccgcggacgccatcttctacttcctgccggtgttcctggcagtcaccgctgcaaaacggtttagaacgaaccagttcacctccatggccatcggcggtgccctggtctacccgagcatcgtggccctcgcggcgcaggccgagcccgtctcctttgccggcattccggtggtgatgatgaactacaccagctcggtcctacccatcatcgtggcggtctggctgcagggctacgtggaacgcttcctgactcgcgtgctgccctcggcgatccggaacttcaccacgccgctgctgacgctcctggtcatggtgccgctggtcctgatgaccgtagggccagtcactaccttcgcctcgcagggcctgtccgctggcatcaatgcggccttcacgttcgctccgtggttggccggcgccgtcatgggcggcttttggcaggtattcgtcctcttcggcctgcactggggcctggttccgggcatgctcaacgagctttccacgcagggctattctctgctcatgggtccgctggtggctgcagtcctcagccaggctgcggcaaccctcgcagtcttgttccgcacccgtaacaaggcgcgccgcactgtggccggccccgcagccctgtccggattccttgccggcatcaccgagcctgccatctacggcgtcaaccttccgctgaagaagccgttctacttcggcatcgcgggcggcgttgttggcggggcgatagcggccgccggcggaagcggcgccacgtcgtttgtcttcgcatcgcttttggctttgcccgcatacgcttcggttggcagcttcgcccttcagctgatcggaacggcggttgccgtgcttatcgccttcacgttgacctttttcttcggcccgcgtgaggaggcagcggctgcagcgtccgacgccggtactgccgtacccgaggcagtttccgttgcgccggcggcagcttcctccgtccccgccacggcggcaggcgccgcggccacgaaggcggccggcgccgtcgacatcatcgccccggtggcgggcggcgtagtagcgctggccgatgtccaggacaaagtgttcgcttccggtgccatgggcaagggcctgggcatcattcctacggacgggcacatctactcacccatcaccggaaccatcaaggccgccatgaagacgggccacgcgttcggcatcaaatccgaggacggcgtcgaggtcctggtccacatcggcatcgacaccgtccagcttgaggggcgcggcttcgaagccgctgtcacacggggccagcaggtccgcgcgggagacctgctcgccgtcgtcgacctggacgtggtgaccgatgccggctacgacaccaccaccctggtgatggtcaccaacaccgcccagcttggcagcgtggaaccggtggccggcggcacgctcgcccagggcgacactgccattaccgtccgcgtctaagcctgaaacccctggctcccacttttccagtcccactgacaaaggaacgatcaactgtgaccatcactttccccgaaggattcctctggggcggcgccactgctgccaaccagatcgaaggcgcctacaacgagggcggcaagggcctgtccatccaggacgtgatgcccaagggcatcacggaaattcccaccgaggggccgacgccggagaacctcaagcaggtggcgatcgatttctaccaccgatatgaggaggacatcgcccttttcgcggacatggggttcaaggtgttccgcttctccatcgcctggagccgaatcttcccgctgggcgacgaagagaaccccaacgccgaaggcctggccttctactcccgcgtcctggatgaacttgagaagcacggcatcgagccgctggtgaccatcagccactacgagaccccgctgcacctggcgcggaagtacaacggctggaccaaccgggagctgatcggcttttatgagcggtactgccgcgccctgttcgagcacttggggggccgggtgaagtactggctcacgttcaatgagatcaactccgtgatccacgagccgttcatgtccggcggcattcccacccccaaggatcagctcaccaagcaggacctctaccaggcgatccaccacgagctggtggcctccgcgcgggccacgaaactggcacgtgagctgatgcccggcgcgcaggtgggctgcatgatccttgcgctgcccacctacccgctcaccccggacccctcggacgtggtggcggccatgctcactgcccaggacagctacgcgttcggtgacatccactgccgcggtgagtaccccggttacctgctgcggtacttccgggacaacggcatcgagctggagatcaccgcgcaggaccgtgaggacctgaagaacaccgtggatttcgtgtccttcagctactacatgagcatctgcgagaccgccgatcccgccaagaagaccaaggggcccggcaacatcatgggcggcgttcccaaccccaccctcaaagcgtccgagtggggctggcagatcgaccctcaggggctgcgcgtggcactgaatgactactgggaccgctggcaaaagcctttgttcgtcgtggagaacgggctgggcgcggtggacaagctggtggaggtcgacggcgaaaagaccgtcgttgacgattaccgcatcggctacctcaacgaccacctggtgcaggcccgtgaggcggttgaagatggcgtccagctgatgggttacacctcctggggctgcatcgacctggtcagtgcctccaccgcccagatgagcaagcgctacggcttcatctacgtggacaggaacgacgacggcacgggctccatggagcgctaccccaagaaatcctacggttggtacaaggaagtcatcgccaccaacggtgccagcctgaaagactagcgccaccccgaaagacaggcagcagggagtttttgtccagaagtgcagggtagaagggccttaaagtccgcatatctggacaaaaactcccgcacgggggttatcccgcttcaacgatgaaaggaggacggcgtggaggtgttgcgcgttttcaacaacaacgtcgtcctcgcccgcgctgccgacaggggagaggtcatcctcaccggccgtggccttgggttccaggcaaagcccgggcagcaggtggatgaaaccaaggttgtccgcgtcttcgtccccgaggacggccgcaacgcggacaacttcggtgcgctggtggcggccatcccgcccgaacacctcgcactggcggaccaggcactggacattgcccgcggcgggctgcgcgggccgctgaaatccaccaccgtggtggccctggcggaccacctgagcttcgccatcaaacgcctgcggcagggcctgaacattgagtacccgctccgggccgaggtggcccacctctacccggacgagctgcgcatggctcagcagatcgtggacttcgtcaacggccggctcgaggaagccctgccccgcgacgaggccgtggccgttgcactgcacctggtcaacgccgggttcgccagcggcgacctctcctacacctaccagatgaccggcgtcttcgcgcagctgttcgaagtcctggaacaggcctacggccgctccttcgatcgggagaccgtcaacgccgcacgcttcatcacccatctgcggtactttttcgtccgcgcccacaccggacggcagctggccgagggggcaacagggctggggtccgccatccgggaagcgtatccggaggcattcggcactgcactgaaactgcaggccgtcctggaactccgcctgggacagccgctgaccgacgacgaagtcacttacctgacactgcacgtggcccgcatggccgacgacctgcgcctgagccagaacgcagaaactccttcctgaccagcgccgtcctagcggcggcgagaggatagcggatcattgagagagcgctctcttgacagtgatccgcgccacgcctacagttgaggaacttgccagagagcgctctctcagcgccggaagttcccacaaaggagtgacgttgaaattcgtacgccgacacacagcgaccgccatggcgggcgtggcagccatggccctgatggccacgggctgcagcagcagttcggaacaagcagcaagcgctgacaatcccgtagagctcacggtcaccaccttcgggaccttcggctacgacgatctctatgccgaatacgagaaggccaatcccggcgtcaaggtcaaggccaccaacatcgaccgcgggtccaatgcgcgcacggacgccttcaccaagctggccgcaggatccgggctcagcgatgtcgtggccatcgaggagggctggctgggctccatcatggaagtatcggaccagttcgtggacctgaacgagcacggtgcagcggacatcaaggacaactgggtggactggaagttccaacagggcaccgatcaggacggccgcgtcattggctacggaacggacatcgggccccagggactctgctacaacggcaagcttttcgaggccgccggaatgcccagcgaccgggaatcagtggcaaagctcttcggtggcggggacgcaacctgggaaacctacttcaagctcggtgagcagtacaaggcagctaccggcaaagcctggtatgaccagtccggattcgtctggaactccatggtgaaccagatggaggagggctactacaccaaggacggcgagctgaacgtcgacgggaactccgagatgaaggccaagttcgagatgcttgcggccggaacggctgccggtctctcagcgaaccagacccagtgggactggggcaacggcaaggcctttgttgacggctccttcgccaccttcgtctgccccggctggatgctcggcaccatcaagggccagctggaatctgccggcggcggcacggagagcggctgggacttcgccgacgtattcccgggtggagcctccaactggggcggagctttcctgtcagtacccaagacctcagagcaccctgccgaagccgcaaagctggcagcctggctgaccgcacccgagcagcaggtcaagcagtcggctgccgcaaacaacttccccagcaccctaaaggcgcaggagaagctggtggccgatgccactccgaacgtggtgttcaacaatgcccccactggcgtcatccttgccaaccgcgccaagggtgtggtggcccagttcaagggaccggatgattccgtgatccaggaaaacgtgtttggtccggcgctcaaaatgctcgacgccggaactgccgacgctgacaaggcctggtccgaagcgctgactctcctcaacgacctggtcgtaaacaactagcaccacccgctgtggggcctcccggaagggaggccccccgatggaggggcaaaagcccaatgacaaccaccatgaaccgccccgccaaacctgcggcggccatcaaacccaagcccaccttcaaacagaggctcaacgtcttcgacgtcaaagcatcgccctacctctatatcgcaccgttctttatcctcttcgcactcgtgggactgttcccgctggtctacaccttcgtggtcagcctcttcgactggcacctcctcaagggccagggagactttgtgggcctgcaaaacttcacggaagtcctccaggaccgcttcttttggaactccctgttcaacacggtcagcatcttcctgctgtccgcgatcccgcagcttgccgtggcgctgttcctggccgccgtgctggaccagaaccttagggccaagaccttctggcggatgagcgtgctcctgccctacatcgtcaccccggtggcggtggccatgatcttcaccaacatgttcggcgaacagtacggcctcatcaacaacgtcctgggaaatttcggcctggatccggtgatgtggaagaacgagaccctgcccagccacattgccatcgccaccatggtgaactggcgctggaccggctataacgccctcatcctgctggccgcaatgcaggccgttccccgcgacctgtacgagtccgcggcgctggacggcgccggagccctccgccgtttcttcagcatcaccctgccgagcatcaggcccacgatggtttttgttgtcattacctccaccatcggcggcctgcagatcttcaccgaaccgcggctgtttgatcccgccaccgcaggaggctcccagcggcagttccagaccacagtgctgtatctctgggagatggccttccaacgccagaacttcggcaaggcgtccaccatcgcctggctcctcttcctgatcatcgtgctgttcggtgtcatcaattacctgatctcccgtcgcatcgccactgcggatgcagcaaggccctcccggtcaacaaggagagcccgggaacgcgctgaaaggactacgcgatgagcatcatcgaaggggcgccccctgccgccgacggcgtcttgcccgccgaaaagaagccttccggccgcccggcccccttccgcaagcgctttgtgggctcgggggaaaagccagggttcctgacctacggcctgctcctcgccttcctggtgtcgtcggcctacccgttgtggtggtcagccgtcattggcagccgctccaacgaggccctcggcgaaacctggccgcccctgctgcccggaggaaacttctggaccaacgtgggcgaggtctttgacaccattccgttctggctcgccctcggaaacagtgtcctgatttcctgcatcatcaccctgtccgtggttggcttttccaccctggccggctacgcctttgcgaaactgcgcttcaaaggccggaacgggctcatgctgatggtggtggccaccatggccatcccgacgcagcttggcatcatcccgctcttcatggtgatgagaaccctgggctggaccggcgaaatcggagctgtggtggtgcccacgctggtaaccgcgttcggcgtcttcttcatgcggcaatacctggtggacgtcatcccggatgagctcatcgaatccgcacggatggacggggcaaacatgatttccaccttctggcatgtagccatgccggcagcacggcctgccatggccatcctggggctgttcactttcatgacggcctggaccgatttcctgtggccgctgctggtgctcgacgccggcaaccccacgttgcagacggcgctgagccagctgcagtcagcccgctacgtggactactccgtggtcctcgcaggagcggtgctggcaaccctgccgcttttggtgctcttcgcactggccggcaaacaactcatctcaggaattatgcaaggagcagtgaagggctaatgcagcacccgacgtaccagcggcagtggcccgagggctttatctggggatcagcgacggcggctgcccagatagagggcgccggccacgagggcggcaaggaagattccatctgggaccacttcgcgcgaatccccggagccattgcccgcggtgagaaccttgaacaggcagtggaccactaccaccggatgccccaggacgtccggctgatgaaagagctggggctggactcttaccggttttccaccagttgggcgcgggtgcgccccggggacagggccgtcaaccgcgaggggctggacttctattcccggctggtggatgagctccttgaagccggcatcctgccctggctcaccctgtaccactgggacctgccgcaggcccttgaggaaaaaggcggctgggccaaccgggacaccgcctacaggttcgcggagtacgccaatgacgtctactcggcgctgggggaccgggtccggcactggaccaccttcaatgagccgttctgttcgtcgctcctgggctacggctccggcgtgcacgcacccggccggcaggagcccgcggcggccatcgccgccgtgcaccaccagcacctggcccacgggttggccgtcaatgagctgcgcgggcgcggagcccagcacttgggcatcaccctgaacctgagcaattcgattccgcgggacagccaggacccggtggacctcgacgctgcccgccggtttgactcgttgcagaaccggatcttcctcgaccccatcctgcggggagcctatccggaagactccctgcgggacctggccccgttcggcctgccaggcctgattcttccaggtgacctggagctcatcagcgcgccgctggaattcctgggcgtgaaccactaccacgatgacctcatcagcggacacgctgacgacgccggaagcgacggccactccggcggcgcggaacgtgcctctgcatcgccttggatcggttcggaggatatcgcctttcccagccgcgggcttccgcgtactgcgatggggtgggaagtgaatccggatgggctccgcaagctactggtccggctgggggaggaatacgccacgctgccgccgctctacatcaccgaaaacggagccgcatacgaggacactgtcagccccgatggcgccgtgcacgacgccgagcggacccggttcatcctggaccatgtggcagcagtgggtgaagcaatcgaccagggtgccgacgtccgcggctactttgtctggtccctcctggacaacttcgagtggtcatggggctatggaaagcgcttcgggattgtccgcgtggactacggcacgctggaacgcaccgtcaaggacagcggcaaggcctacgccgggctgatcgccgcggcacggcagagcgcgtcccaacctcctgcgttcctgcccgcctaaactgaaattcccggcacctgtgccagccagaccacggagcgaagaaaagtgaagcaagacaccagcggaagccggccgacgcccaccctggaaatggtggccgcgctggccggcgtctcccgtgccaccgtgtcccgcgtggtcaatgacgtgccgagcgtggatgaggacattgccgccaaggtgcgccaggcgattctcgccgtgaactacacgcccaaccgggctgcccggtccctggcaagcaggcgacccaactccgtgacgctcattgtgccggagtccacctccaaggtcttcgcggacccgtttttcgcatcggtggtccagggcgtggcgctgtacctggcggacacggattacaccctgaacatggtcatcgcttccgaagccaaaccggagaaaaccagggccttcctgcttggcggcaacgtggccggtgccctggtggtgtcccaccatgcaggggaccggtcctggacccacctcagcgattacattcccatggtgttcgccggcaggccgctgggcgaaagtgccagctactacgtggatgtggacaacgaggctgcggcggcaggagccacccggctgctcattgagagtggacggaccaatattgccaccatcgcagggccccaggacatgccgccgggcatcgaccgcgtcaacggctggagggcggccatggcggaggccgggctggatgattcccgggttgagtacggtgacttcaccctggcatccggggccaaggcgatgcgccgcctcctcggcagcgggaagccggttgacggtgttttcgtggccaatgaccagatggccgcaggcgcttatacagtgctgcaggaaagggggttgcgcataccccaggatgtggctgtggttggcttcgacgacgattcgttcgccacctcagtcaatccccagctgaccaccgtgcaccacccgatcattgaaatgggcaagaagatggccgaaatcctggtggacctcatcgaggggaaagacaccgcacgcgttacgcagattcccacttcactcgtgatccgggaatccgtctgatggccggcagcacacccagtgcccccgatgccagtgcccggaccctccgctggggcgttgtggccacagggcggatcgcgcataaggtcacccgggacctcgcccgccttgaagatgcccaactccatgcagtgagttcgcgcagccagggctcagcccgggcattcgcggaagaacacggcttcgcggccagctaccatgacggtccagccggatccggataccagcagctctttgccgatccccgcgtggacgtggtgtacgtcgccacgccccatgcgcagcacttcgaggttgtccgcgccgcgcttgacgccggaaaacacgtcctgtgcgagaagcccttcacgatcaacgccagcgaagcccgggaactggtccagctggcaggggagcgcaacctgtttctgatggaagccgtctggacgcgcttcctgccggcaacccgccgtgccctggagctgatccgcggcggcagaattggaacggtgcgctgggtccaggctgatctgggctttcccgcagcctatgatcctgcggacaggctgtgggaccctgctgccggcggcggtgcactcctggacctcgcggtctacccgctgacctgggcggttgcggcactcggcttcccccaagggctcacagcccgaggccacctgaaccaggacggcgttgatgtccaggacaccctcaccctcgagtacccggagggggctgcagcccagctcacttcctcgctccaggctgccggtcccggcatggcaaccatcagcggaacagcaggctggatacggaccggttccccgctttataacccgcgcacgctggagatctgcggaccggacggcaggatcgaagtggagcatttccacgaagaagccgagggcttcatccacgaactgcgcgaaacagcccgctgcatccgcgccggcctgcaggaaagcccgctgatgccctggaacgaaaccgtgcaggtaatggagttgctggaccaggcccgggaacagatagggctgcactacgcgaacgacgcgcgggcggtcaccacctagagcgcgggcagcacatcacgggcttcgcgggcatccatcccggtggcctccagcaggtccaccatcagcggccggtacagcatcaccaccgtctcaccttcaagccgctgcacctccagcaacttggggtgcaggcgcagggcaatctcgctcaggtcctggcgggcggtgcgcaggtgggcgcgccgggcgccgtcgtgcgtttccgccaagcccagcgaaagctcatcaatggcggcagcggtctcctgcagcacctccgcgatgttttctgttgcctcgtccgacaacgccgcgtggttaattgcgcttgtcagcctgcgggcgaatacccggctgttccgcagcgccaggtcaatgaagtcgagcgactgtttgagccggtccagctcatcccggtgccggcggtaggccggcgccagggtggccacctcgccggaagcgcgcagggactggcgcatcccgtccaccagcggctggcagttcctgccccggatgagggcatgccacgcctgggtggaatcactgttaaccagcgccccggcgcactcgcgcaatacctcggcgagctcgtgcagcagcttttgcacgtccttgcggggttcacggcgggggtccttgggggccaggatggtcaccagcagggcgaacagtccgcccaccacggcatcgatgctcctggtaaacggaccgcccgacggtgcggtcagcaacaccaccagcagcgactgcagggccagctgggtggtgaagatgttcccgctgtccaggaaccttgcgagcaggatggaaaataagaggacgacggcggcctgccagattccggcacccagccagtgcaggaggaggtcgcccaccgcaatgccgatagtgcagcccaggcccacctccagtacccgccgcagccgcggttcacgggagaacccaagcgcgatcagtgatgaggtagccgcgaagagcggatcggagtggcccagcacgtattcagcgaaagcgtaggcgcccacggcgcagaccgtcatctggatggccgggatgagggaattccggctccggatcatgccggtgcggaagcggccgcgcaggaagcgcctgcctgctgagagtcctgctgcgggggccatgcggtccagtctattgccggccggcatatttcttttggcgactctttggtgccggtgcactacggccggacatgtgatctgcgcaatggtgaccgggcatttgtcagcgaatatcccgccgtcgttaatcctccgttcaccttggtccgcccgtcccgttacctgcggagcctaacttcgttgaaggtacaaaacctacgcatcgcgcagcagggttctccgtccctgtccgcaactgaaaaaccctggaaggggtacatctagtgaaggcactccgcttcggccgccacgcggctatcgctgttatcgcagccggcgctctcgcgcttacctcctgcggttcagacaacgccacgggcaccgcccccgaaggtgaccaggcttcctccggccccaaggtcaccggtaccctgaccggcatcggttcctcagcccagggcgctgccatggacgcgtggaagacagagttcgctgccgcgaacccgggcgccaccgtacagtactcgccggacggctccggcgcaggccgcaaggcgctgctggatggttccgcccagttcggcggttccgacgcctacctgaaggacgaggaatacacccagtcccaggaagtctgcggccccgacggtgccctcaacatcccggtctacatctccccgattgcgatcgccttcaaccttcccggcattaccgagctgaagctggatgctgccaccgtggcgaagatcttccgtggcgagattgccacctggaacgatcccgcaattgctgcgctgaacgaaggcgtggacctcccggacctcaaggttactcccgtgaaccgctccgatgattccggcaccaccaccaacttcaccgactacttggctgcagcagcacccgaggtctggacggacaaggcctccggcgtgtggccgggatcgctccagggcgaaaatgccaagggcacctcaggtgtggtcaagaccgtcaccgacacccccggcgccatcacctacgctgatgactcggctgtcagcggcaagctcggagttgcccagatcaaggtcggcgaagccttcaccgaaatttctgccgaagccgcagccaaggctgtggacgcgggcaccccggttgaaggccgttccgccaacgacctctccatcaagctggaccgcaagaccaccatcgagggcgcctacccaatcgtcctggtttccttccacgtcgtttgctcaacctacgactcccaggagaccgtggacctggtcaaggcctttgagagctacgtagtctccgaggagggccagcaggccgcagccgattcggccaagtccgcgccgctttcctccgacctggccgccaaggctgaaaaggccatcgagtccatcaaggtcaagtcctaaccacgctctgattccgggttccccgcctgccgaaaggcagtgcggggaacttggctttcaaagccatccgctcccacataccagcaaacgatcgaagggccgtcgaatgaccgccacctccctgaccagtacccagggcgccgggcgcgccggggacaaaatcttctcaggtgccgccctggctgccggctgcctcattctcgccgtgctcttcggcgtcgcgctcttcctggtggtccaggccatccccgcgctcaccgccccggccgaagaaatccagggcggagaaggcttcttcgcctacatctggcccatcgtgatcggtacgctgatcgccgccgtcatcgccctggtgattgccacccccatcgccatcggcgtggccctgtttatttcgcactttgccccccgcaggctggcctccggactcggctacctggtggacctgctcgccgccatcccgtccgtggtctacggcgcctggggcgcggcattcctcgcgaaggaaatctcgccggcgtacaactggctcgccgcgaacatgggctggctccccatcttccaggggcctgcctcggccacgggcaagacgatccttaccgcgggcatcgtgctctccgtgatggtgcttcccatcatcacctcgttgtcccgggaaatcttcctgcagacccccaaactgcacgaggaagcggccctggcgctgggtgccacccgctgggaaatgatcaagatgtccgttctgcccttcgcccgcccgggcatcatcagcgccgtcatgctgggcctgggccgcgccctgggcgaaaccatggccgtggcactggtgctctcctccggcgccctcaccgccagcctgatccagtccggcaaccagaccatcgccgcggaaatcgccttgaacttcccggaggccagtggactcaaggtcagcaccctgatcgctgccggcctggtcctgttcgtcatcaccctggccgtgaacatgatcgcccgctggatcatcacccggcacaaagaattctcgggagccaactaaatgacctccacgcttacccccgttcgcagcaagcgctcggcactcaccaagggccaactgcccaagtacgccccctacgtggtcctggccgcagcgctgatcgccggcgcagcgatcctggcgctggtgggcttcaatgccttcggctggggaatcgtctcggcaatcctcttcgccgtcggactggtgtcctggagcgccgccgtcgaaggctcccgcaaagccaaggacaagctggccacctgcctggtggtgggctccttcctcattgcactgctcccgctgatttcggtgatctggactgtcctggtcaacggaatccccggcctcctggcccccggattcatgaccacctccatgaacggcgtcaccggcgtcttcgacaaccgcgcagtggaggacggcgcgccggtcatcggcggcatctaccacgcgctgctgggaaccatccagatcaccctgctggccaccatcatctccgtgccggtaggcctgctgacctccatctacctggtggagtacggcaacgacggccggctggcccgcgccatcacgttcttcgtggacgtcatgaccggcatcccctccatcgtggccggcctcttcgcagcggccttcttcttcgccgtggtgggcccgggcaccaagactggtgccgtagccgccgtcgcgctttccgtgctgatgatcccggtggtggtgcgttccagcgaggaaatgctgaagatcgtccccaacgaactgcgtgaagcggcgtacgccctgggcgtgcgcaagtggcgcaccatcctgaaggtggtaattccgacggcgatctccggcatcgcgtcgggcgtcaccctggcgatcgcccgcgttatcggtgagaccgcgcccatcctggtcaccgcagggttcgccaccagcatcaactccaacgtgttcggcggctggatggcgtcgctgcccacgttcatctacacccagatcctgaaccccacctcgccggcgaaccccgacccgtcgtcgcagcgcgcctggggtgccgccctggtgctgatcatcctggtgatggtcctcaacctcgcggcacggctgattgccaggatctttgcccccaaggccggccgctaagggccgggcctttccgccccccttccggtcctgcgggccggatgacacacttcaattcatacccagttagtgaaggaacaccatgtctaagcgcatcgacgtcaaggacctgaatgtctactacggcgatttccttgccgtggaggacgtcaccatcaacatcgaggccaagtccgtaactgcattcatcggaccctcaggctgcggcaagtccacgttcctgcggacgctgaaccgcatgcatgaggtcctccccggtgcccgtgtggaaggtgaggtcctgctggacggggacaacctctacggccccggcgtggaccccgtgaccgtgcgctcgcagatcggcatggtgttccagcggcccaacccgttccccaccatgtccatccgcgacaacgtgctggcgggcgtgaagctgaacaacaagaagatctccaagggcgaggccgacgtcctggtggaacgctccctgaagggcgccaacctgtggaacgaggtcaaggaccgcctggaaaagccagggtccggcctctccggcgggcagcagcagcgtctctgcattgcccgggccatcgccgtggaaccgcaggtgatcctcatggacgagccgtgttccgcgctggaccccatctccacgctggccattgaagacctcatcaatgagctcaaggaccagtacaccgtggtgatcgttacccacaacatgcagcaggccgcccgggtttcggaccgcaccgccttcttcaacatcgcaggcaccggcaagccgggcaagctcattgaagtgggggacacccagaccatcttcagcaacccggtccagaaggccactgaggactacgtctccggccggttcgggtaaagctgacgcagctgcaggttgctcccggtgagggggcagtcccgctgcggtgcaggtctcaagccctgctagccagaagtggaagcatttagtacgctgaactagatactttggaaactagtaaatagcatgcttaggagttttccgttgacgcagatggcaaccggccccagaggccaccagcttagagtttccgggttcggggccgcgaaggttgtccagcagaacgatccctttggccatgtgtacgccgctgctgcggtgtcccccgatgacgccggagctcaggtttccttcgagggcgccgggccggctgcagctcctctgtcttttgcagggaccgacgctgcggccggggaggattacgtttccgcggtatggcgcaccagctcgtacctggaaaccgtccagtgggaactcgacgtcgcccaggagtcgctcaggcaggccatccagcaggcggcaagccacggagtggatcagggcgcgctgctccaggcggcaaacatgacgccggaggagctggcaacagccctgctggacagcgcacctgtatttcccgcagcgacgtaggtcctgctgcggcagcttgccgttactccgggacttccagctggaatccgcaccggcaccgcaggacccgggtgggcaggcagaccatgttgacgcgcccaccgttgttgctgctccggtagcaaagcctttcaatttccagccccgcctcttccagggggaatccacagtggatgtagtcatcaccgaacatgatgaccttggccatccagcggacctggtggagcgctgccgcaacatcccccgcgtaggcgaggtgctcgctgaacaacccgcagtcgttgcaggtgtaggagacagtgaccaggtccccattggctgcgcccatcgccctgatggcatggatggtcagctggtgctccgtaccgcaggtttcgcagcgcagctggcgtggctggggtggggagtgccggggattcgaagtagacacgatgcctgctcttttccacagtgtgcatcctggccgccgatatgctgcagcggcgttgtccgcggccgtgcacccggcggcggatgttggtcccttactgcttttggggcttcgaattgctggggacccactttcgaatctacgtcacgggactacggctgtacagggaagtgcaggcaaccgtagtgaacccgtaacccggggccggcccgcccgggggttagcgtgcgaacggggtcatggccagcgccagcacaaacgccagtgcggccgtggccagcggggtcagcaaccagagccccacgatccggatcaccagcttccggttcgtcacggaaaaatgctggttttcgccagcgcccaggaccgccgatgtcaccgtgtgtgtggtggacagcggccagtgcagcccgatggcgcccacgaagagcatcactgcactgaagatctgcgccacggaaccccgcaggggatcgatccgggtgatcttgtacgcgatggtgtgcgagatccgccagccgccgaacagggtcccggcagccatcatgacggcggacagcagtaccacccacaggggtattgtgccgggatcggaataacctgccgccagcagggccaatagcagcactgcgctcacccgctgcccgtcctgcaggccgtgcccgaaagccacggccccggcggcgatggcctggctccggcggaagcggtggttgaccacgttgggctgcgtgtagcgtgccgcccacgtggccggatacaccagcatgaaggcgccgctgtaggcaacgagcggggacagtaccagcggcagcaccacctggaacagcagggactggtccacccctccgacgccggagccgcctaccgccaggctggccagtcccgcgccggccaggccgcccaccagggcgtgcgtggaggaggccggaatgccccgccaccacagcaggattccccaggcgcaggcgctcgccaagccggccacgaggatgctcaggcccccgttgcctggtggaaggctgatccaggcctggctgacggccacggccaggccggcgctcagcagggcgcccacaaagttgaagaaggcagccagcagcactgccacgctgggggtgagtgcccgggtccgcaccgccagcgccacggaggtggaggcatcacggaagccgttgaggaacgtgaacgccgcggtcagcaggaccacgaatccgaagatgaccggcgtcacctcaggattccttgacgatgatgctgcccacctgggtggcgatccgccgcatgtccttggtgacttccaccagctggttggcgatgtcccggttgcgggagtactgggcccacttcatgtccgcgatcatgtccgccacccacacccgatgcgtccgctcggcgcgctgggcaaggcggaggatttcgatccagtagtcctcgaggtcgtccaggttgttgagccggcgcatggcgtccactgtcagttctgcctgccggctgatgatctccagctggtcggccgcacgtttgggcagccgctccagcttgtacagggctaccaggtcggcggccgcgtccatcttttccattgcctcgttgaggtagcgggagagcgcatacatgtcctcgcgggggagggggttcacgaaactggaacgcatgtgcgtcaggagggcgaagtgcagttcagccgacttcgcctcgtggttgtgcatgtcctccacgagcttgccgtgttcggcggcggggacgcccaggatttccgccagggtggcgctggccagcacgatctgctgggccatctgcgaaaggaggttcagcccggcgggctcctggggaaaaaggcgcagcttcacgtgtttaccggtctccgggaaaagtacagggcggggggttgctgccgtgtgacttgaccccggcgggcaactgagcccaactctaccggcccgtggctgggcacctgaaaaacagcactgcaaagccccggaaaaatgtgccgggaaaccgggtgcggaggtgcgggaggaaaaaccggccggcggcgggcatgaaaatggtgccgaaccggatacgcctctcggcggtaggccgctctaggcggctaattgttgaagcccgggggtttcgcggctcggcaccggtttcagttttctactttggctggcgcaagtcaatcttgacagatggggcaaaagcgggtctgctgggctgattcagtcgagttctcccagccgccacgcattcgcggcgtgctcaaggtcctccgcggtcttcaccagctggtgcgagttccgcgtgagtttgctggcgtgcgcttcgttgccatgctcggcaccgtcggcgatggttgcctggccgagtgccaccacccggcaaaacgctgcggaacgttccagcgcaacgtcgaattcgccgtcgaacgcgccggaaaggatggcgtccgccatgctccgcatctcatcggcgcccggaggctcggccgccccggccaccacgttggacacctgggcggtgtccttgcccgcgcggaagtacaccgagatgcgctccggatcctggaccgtggccgcacgcagggcgtacaggcgccacagggcgccgggcagggaacgcgccggactctccgcccacatttccgcaatggcttccagcccctgctcgtccgcgagcttcacgaggcgctccgtgaccacgggatcgtcgctgtcacggccgtggcggaccaatgcctgggcggcgaggtgggcggcctccgagatgcgcgcgggatccgcgcctccggcaaagggctcgaagtcgatgggagcgaagggctttggcttgtggtgccggttcgcgccgccgtactggctggatcctgcttgctcactcatgcccccacgctactcctgtgccgaggcggaaatcgagcatccgtcctcgcctccgccgccggattccgcggcaggcggctgaccgggagctccgtccgaacccgccggaaccatgggttagagtattaacgtccagaaatggattgggccgggtggcccgcacatacgctgcgaacccatccggcaggggcctttagctcagttggtagagcatcggacttttaatccgtgggtcgtgggttcgagccccacagggcccactctttgagagaagagtggtacgtccccggcgtcctggcaacaggacaccggggacgttttctattcccgggctgtgcgggctgccggccggtcatccctaagctcgttggcgaaaccggaccttgaaggcgcggtccgcgaacaagcccaggatctccggtgttcaggccaatcagggtatccgggccaaccggcgggcagaatgggcacatggcaaaaagcagcaaggggcggatgccgcgcctggaagatgtggctgaccgggccggcgtctcccaccagaccgtttcccgggtaatcaacaaccaccccaacgtcagcgaagcgacccgcaccaaggttgaggcggccatcgccgaactggggtaccggcgcaacactgctgcccggagcctggtgacccggcgctcgcagaccatcggtgtcctggccagcgaactgtcacagtacggccctgcgaacaccctcctgggcgtggagcaggcggcccggaacgcaggctacttcgtcagtatcgccgcgctgcgcgaggtcagccgggatgccattgccgacgccgtcagccacttcatggaccaggccgtggacgggatcgcggtgctggtgccccactcggacacccttcttgccctggatgaaatgcggctgcccgtgcctgtggtggccgtggggtcccttggcaacagcaacgtcagcggggccatggtggaccagcgccgcggcgcccagctcgccgtcgaacacctcatcggtcaggggcaccgccggatcgggcacctggcagggccccgggactggattgacggttcggagcgcgcggagggctggcgggaggcccttctgggtgccgggcttacggacgatctcctgctgcagggcgactggagtgccggcagcgggtatgccgccggccggaagcttgcagccgatcgcagtgccacggcactcttcgtggggaacgaccagatggccctcggcatgctgcgcgcgttcgccgaagcgggggtcagggtgcccgacgacgtctccgtggtgggctttgatgaccagccggaatcggggtacttcaccccgccgctcaccacggtgcggcaggacttcgaagaattgggccgccgctgcatggacatcatgctcaaggagatcgaagccggcgccgccataagctccaccgtggtcacgccggaactggtcctccgcgccagcaccgccccgcctgtggatgccgccccgtagccccggtgttgctgcagccgggcacgcccggacgcccggcgaaaaaatatttaaaagaattttccatgcacgtgcatccaactcccatgctgcgccggtagtagaggtgtaagcaaaaaatgcccgcgaggcgggccgatcaatggagatagacatgcgcaacaggattctcacagcaggcgccggtgcagcggcaatcgcagcagccatcgctctcgccggcccggcccaggctgcggagggggacgcccagctgtccgtcctccacggtgtgccaggcctgaccgtcgacgtctgggtcaacggtgaccggaccctcgatgatttcacccccggcagcctggccggcccgctggcactgccggcaggcgcctatgaactcgccatcaccgcctcggatgccgccgacgcttccgcggctgtcatcggccccgtcagtgtcacgctggccgccaacggcaactacaccgccgttgccaacctcgatgcagccggcaaccccactgccaacctcttcaccaatgacgtctcccagatcgaggcaggcaagggcaaactgaccgtccggcacaccgctgccgcacccgccgtcgacatcctggcaggcggttccccggtcattaccaaccttgccaacccgaacgagcagacgctgacgctggaccccggcaccgttccggcagcagttgctgccaccggaaccactgccccggtcatcggcccggccgacgtcacgatcgccgaaggcacgcacaccatcgtgtacgcctggggtagcctggcagactcgaacctgcagctggccgtacagaccatcgagggcctgcactccgctccgggttcagtaccgggtgcccttgacggctccaccgttgccgctccggcagactccaccgcccttatggccgggttcggcgccgcagcactggcactgctcctcggcggcgtgggcgtagcccgcaccgtcgccgcccgccgggcagagtagtaccactggcggccgcccggtgaaggccgggcggccgccgcttttcccatccgcggtgcaggttcctccggggcctgccgagagaaaggccgggcaccatgaatgccggacacatggaaacaggtacgacgacggcaggggagtcccgccgtcgatcctccgtttttccgggcgcgggagtcctgctcgccggggccctgatgctttcctcgtgcgcggccgccccttccctgccggcatcatccccagccccgcctgccagccaggcagctgccgcgcagcccgcccaacccgtaacccaggcccccgggaacccggccccggaagcggcaaccgcgcccgccagcccggcggcaatccaagacattcccgtgcgtgccgccaccccgtcggcggtgagtgcggcgccggtcccggtctccctcaccgttgccggcacccccatcgatatgccggtggtgccggtaggagtttctgacggtggagcgatggaaatccctgatgcgttcgaccgggccggctggtaccgcttcggccccgcgccgggagccgcgtccggcacgtccgtgatcgccgggcatatcgacacgaagtcggacactgcgcccttttccgcgctgaagtccgtagccgccggaacgctggtgcgggtgggccgtgagggtgcgcccgccttgaactaccgcgtggtgagcgttgagctgatggccaaggaccggttcgacggcagttccgtgttccggcggtccgggccccacgaacttaaagtcatcacgtgcggcggcgagtggctggacgaacgaatggactacagcgacaatgtgattgtcaccgcggtcctggagtgagcggtgatcctgccatgattgtcgccaccgacgctgcgaaggagctccgtttggtacctcccgaccaggctccgccggggtgggaagacggcctgacgccgtccttcctggcaggtgatgaacatgccctggtggctgcttaccgggagtttgccccgctggtccacaccctggcgctgcgttccctgccggaccgttccgcggccgacgacgtcacgcaggaggtgttcatccgcgtgtggcgatcccggagcactttcaatccccaggtggcccggctgccggcgtggattgtcggcatcacccggaacgtcatctcggacaccttgtcggcctcggcgcgggaagtccggaaagccgtggcagtggccggggccgggatggccgatgaagcgggtaacggccatgaggacgccgagctcctggctgacaggctcctgctggacggggagctggaccggcttggcgagccccagggttccatcatgaagctggccttctacgatgacctgacgcacgaacagatttcaagaaaactcggcctgccccttggtacggtcaaaagccatatccgccgcagcctgtcccacctgagaaacagattggaggttaaccatgccgcatcctgatccggaagagttaagcctcctcgcgctgtacgaggactgggaggacagcgctaccagggaccacctgcaggtttgccctgaatgcgcggcggacttcgcggcactgcgccgcactgtcgaagccgttaaaacaccgccggaaaccggccgcctcgaggtgcctggcccgcaggtctgggccggaatccaccgtgagctggggctctcggagtccgtgcacgacgatcccctggccggcatcagggaacattacgccgcttcccggccgggctgggcacccggggaagctgctgccggggaaggctccggtgctgcccagactggcggccaggatgcccgtcatgatgtccggcaggcggagcccggtgcggaacccgaaagcctggccgagcctgtgtcgctgaaagacagggcagcgtcccgtcctgccaagcgccggtcctcggcgtggtggcagcgtccgggaccctggatggccgctgccgcagcggcagtcctggtgaccgccggcgcagtctggtccctcaaccaggcgccccggccgctggcagaagcggacctggctccgctggcacagttttccgccgccggttccgcacgggtggtggagtccgcggacgggtcccgggagctggaagtccggctcagcaaggatgaggcgcagggctaccaggaggtctggctgatcgcacccgacctctcgcgcctggtgagcctgggagtcatgaactccgaatccgggaccttccagttgccggcaggcctggaaatctcggagtacccgatcgtcgatgtctccgacgaacctgtcgacggcaaccccgcccactcaagcgtcagcattgccaggggcacgctcgccacctgacctgccgctccgccgcactgtggaaaccaccctgttccattgcgtggtcaccgctgcggctgccagcgccgccgcaacatgaaagtgcagcacgaggtgcagggagtgggcggcgcctgatgcctccgcagtgggcacgccggcagtgggcgttaccgggattggcgccccgccgtggtggcccgggagggcgaagccgttggcggtggaaaatgcggcaaaggccaggtgcaggagctgctgcgccgcaccggccgccaccagcacggcccacccgggcaggcggcgtcgcccggtcatggcggcgaccatgcccagcagggcggccacagcgataattatgaggattccgggcgcctggccgccggcgcccaaatgggctgccaggcccaggcacgtggacacggggccggccgcccacacgggaaaggggtgccaggctgctggcccgggtgtgtccgtgtcctcgactgtgcgcacgccttccatggtgcccctcccgtcgcagcctcttccaatttcttgcccttacccaggttggcggcggctcagtcgttttcaacgttcagcctccggcgtgccctgccggatcttggctgccgtccccccgggcagcgtccggcgggcgcgggcatggctgttgacttccatcatgttagcgctcacaattgagcgcagaccgcgaagtggcggcagctatggaggaagtttcttatggacgcagtggacgctccggactcgtttgtcatcggcgtggattatggaacgctgtcaggccgcgccgtggtggtgcgggtgcgcgacggcaaggagctcggcagcggcgtgtacgactacccgcacgccgtggtgactgatgtactgccggaagatgtggcaggccgcggtgccgacggacaagccgtccgccttcccggggagtgggcccttcaggtgccggacgactaccgcgacgtcctgcgccacgcggttcccgccgccctggccgaggcggggatcgacccggccgccgtcgtcggaattgccacggacttcaccgcctgcaccatggtgccggtcacgtccgacggcaccccgctgagcgagctggaccgcttccggaaccgcccccacgcgtacgtcaagctctggcgccaccacgcggcgcagccgcaggccgaccggatcaaccaactggcagcccaacgcggcgaagactggctgccccgctacggagggcttatctcctccgaatgggaattcgccaagggcctgcagctgcttgaggaagaccccgaagcctacgcggagatggaccactgggttgaggccgccgactggattgtctggcagctgtgcggccggtacgtccgcaacgcgtgcacggcaggatacaaggggatctaccaggacgggcgctacccctcccaggacttcctggccgcactgaacccgcagttcaaggacttcgtcagcgccaagctcgagcacaccatcggccggctgggcgacgctgccggatacctcaccgccgaggccgccgcctggactggactcccggaaggcatcgccgtggccgtggggaacgtggacgcccacgtcacggcaccggcggcgaaggccgtggatcccggccagctggtggccatcatgggaacctccacctgccacgtcatgaacggaaccgagctgcgcgaagtcccgggcatgtgcggtgtggtggacggcgggattgtggacggactctggggctacgaggccgggcagtccggtgtcggcgacatctttggctggttcaccaaatacggcgtgccccccgaataccaccgcgccgccggggaagcgggcttgggcatccacgaatacctcaccgagctggcatcccgccaggctatcggccagcacgggctcattgccctggactggcactcgggcaaccgttccgtgctggtggaccatgagctgtccgggatcgtggtggggcagacgctggccacccgtcccgaggacacctaccgcgccctgctggaagccacggcctttggcacccgcaccattgtggacgccttccgcagctccggcgtccccgtgaaggagttcatcgtggccggcggcctgctcaagaatccgctcctgatgcagatttacgcggacgccacgggcctgcagctttcaaccatcggctctgcccagggcccggccctcggctcggccatccatgcggccgtcgccgccggtgcgtacacggacatccgggaagccgctgccgccatgggttccgaacccggcgaggtgtacactcccatcccggaaaacgtggccgcctacgaggagctcttccaggaatacaagacgctccacgactacttcggccgcggcagcaatgatgtgatgcaccggctcaaggctatccagcgcagggctgccggagcagtgcttcccggcgtcacggcaggatccggggcccgcgccacggccggggtgtccgcatgagcgccggaccaggaatcctggaaaccatcgcccgcgtccgggaagaagtctgcgccctgcatgccgagctgacgcgctacgaactggtggtgtggaccgccggcaacgtctcggccagggttcccggccacgacctcatgatcatcaagccctccggcgtctcctaccaggacctgaccccggaacagatggtggtcaccgatctctacggcgtgcccgtggacggcgacgcaacaggtgagtggggcaacccggcactgtcgccttcgtcggacacggcggcgcatgcctacgtctaccgtcacatgcccgaggtgggcggggtggtgcacacgcactccacctatgccaccgcctgggcggcccggggcgaagccatcccgtgcgtgctcacgatgatgagcgacgagttcggcggcagcattccggtgggtccgttcgcgctgatcggcgacgactcgatcggccacggcatcgtggagacgctgaaaaactccaactcaccggcggtgctcatgcagaaccacggaccgttcaccatcggcaaggacgcaaagtccgcggtgaaggcggccgtgatgtgcgaggaagtggcccgcaccgtccacatcgcccggcagcttggcgagcccctccccattgaccagggccacatcgactccctctacgcccgctaccagaacgtctacggccagtaacgccgcgccgtcagcccgtccacaaactttcgcaggagaacccatgagtaccgcagcaaacacttcccttgatggctacgaggtctggttcctcaccggcagccagcacctctacggcgaggacgtcctcaagcaggtagccgcccagtcgcaggaaatcgccaaccagctcaacgccagctcagccgtcccggtgcggatcgtctggaagccggtcctgacggactccgacgccatccgccgcactgcgctggaggccaactcggatgattccgtcatcggcgtcaccgcgtggatgcacaccttctccccggccaagatgtggatctccggcctggacctgctccgcaagccgctgctgcacctgcacacgcaggccaacgtggagctgccctgggcggacatcgacttcgacttcatgaacctcaaccaggccgcccacggcgaccgcgagttcggctacatccagtcccgcctgggcatcgcccggaagaccgtggtagggcacgtctccaaccccgaggtggcccgccaggtgggttcctggcagcgcgccgccgccggctgggccgccgtccggaccctgaagctgacccgctttggtgacaacatgcgcaacgttgccgttactgaaggcgacaagaccgaggcggagctgcgcttcggcgtcgcggtgaacacctggtccgtcaacgaactcgccgacgccgtgcacggcgctgccgagtccgacgtcgacgcccttgttgccgagtacgaagacctttacgacgtggttccggagctccgcgcaggcgccgccaggcacgattccctccgctacggagcccggatcgaactgggactgcgcagcttcctggaagccaacggatccgccgcgttcaccacctccttcgaggacctcggcgcgcttcgccagctccccggcctggcagtccagcgcctgatggcggccggttacggcttcggcgcggagggcgactggaagaccgccatcctggtccgcgccgcgaaggtgatgggtgccgggctgcccggcggcgcgtccctgatggaggactacacctaccacctggctccgggcgccgagaagatcctcggcgcgcacatgctggaggtctgcccctcgctgacggccgcgaagccccggctggagatccacccgctgggcatcggcggcaaggaagaccccgtccgcctggtgttcgacgccgatgcctccccgggcgtcgtcgtcgccctctcggacatgcgcgaccgcttccgcctggtggccaacgccgtcgacgtggtgcccctggaccagccgctgcccaaccttcccgtcgcccgcgcgctctgggagcccaagccggacttcgccacctccgccgccgcctggcttaccgcgggtgccgcgcaccacacggtcctgtccacgcaggtgggcatggacgtgttcgaggacttcgcggaaatcgccaagaccgaactgctgaccattgacgagggaaccactatccggcagttcaagaaggacctgaactggaacgccgcctactacaagctggcaggcgg
